United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 52

SEQ ID NO: 792 - DNA, 1460669 bp, Homo sapiens
acaggactggagggcttgaggaatgtggtggtccctctcttcgttgtttctgccccctgaggttgtgctttctcagggatatgcactctgcacttccattcctgcagtgaaattaactcgagcttggcaggtaagtctttcggctcacctttaaaaagaaaagatatgtgagctgcggtgggggtgggctgttccccatttgccttacattggatgtattttattggtgcaaagtggtatttggaagcttaaatgtggggcagaggtttgaagtagccaaatgaactctgtggccctgagagaagagaaaggataaccaaaagaaagggaaggggactcaggcatttttctcctaataaatctctaatttttcttggaaattttgcctccaggccgatgcctggccccagaacagggtctttggcatgagttatagctgtgatgttccctattttcctttttttttttttttttaagttgtcgctgcatgggagcaggcagacagaaacagggttgcatgttgtcaatacaggctgcagaagtcaataagcagccagacagggaatgaaattggaggaggcagctatagatttcttaggttatttcttgtgagtttttcagaacttgtgtgattcaggcttgtcagatactattttgagctgggctgagacaaacacattcccctagtgcaccagatattgcctgcagcctcccaatttctggaggcacctgggtcggctttcttgggggcaagggaatgtccaaggaaaggtcaggaatgagggaattggaaactatgatgggaaaaacaactgttttactgctctagaatctaacagaaatcataatgtcaccctggagataattattatgctgttagtgatcggcttgagaccagggactgtgcctcattcaattcactgcttggatcagagtgaatactcaataaatgtacaatgattaaatgttagtatcaaaatacatacttttgggataagctcggattgatattctgggttctgcttagaatgataagatggagtaataagggagagtaatgttgattggtagataattatgaagaaatgagttctgttaaatagtagattaatatctgcaagtggaattattagacaaggacacacaaacacagggtctctctgcctgcctatcgtctgtctactttcatctctgtcttgtgtttcacttgattccagaagaatttcaggcagcttatgggacaagtttaatgaaaattaacatcattagggataaaaatgacaaaatatataggcttcatccagcaattgatcttctgtggttctacagtgacatggactacagataactgaaatgtaagggttactgtaacttcatttaagcatttattttaacctcttcttccactaatctcatgcttgatgctacaaacctagagtaaagtagatgaatgttctggccctgctgtgggtcccagtgaggtaaaactagcaaagggcagataacagtcatgcaggggattgagtcatacatggagggttgaatgttttgccctttggaggtgataaagcagataattgggtggctcttctccattccataggctgggctgctctgtcatagcttcacagtgctttgcttactttttctttcccctatttgaaactgaatcaggaagatcatatttcccttccgatcctgcttaataaaatattctattattttctcagctgcaaaagtacactattatcactgatcattccctcctcatctcagagtgtttgtcactggccacagtttatatacaagctatacaggctgcctggaacttgaattggctttagagtggatgctggggaaggggcgggggggttccgggtatctgatgaattcctgcaactgcagggctgggagcctggcggggagccaaggggattgtggacagatgctatgcttgctgggtcgacctggctcagctaatattcccagacttggagctgggggacacattcatttcattcaacccatacaaaaatatggacttaatatcaactatgtgtacggcatggaattcttggcatactcagggtgtcaaacccaggagtccctgttccccaagtagctgactctgctacccacatagcaggtgctgttacattgtctagtttatttctcttggatgggaaaataattttatcctattcacaaatgaggaaaccgagactcacatattatgcaccatgcctaacattgcaggtagtgaatggatgaatcatgagggaaactgtttacttcaactgtactgcacatctgtaagaaaagacattcaggaaagacttttacaagacagtgcatgctaagggctaggaagtttggtgagagatggctcccatggagaagtagaaattaagatgggctttgaagcatgagcagatgacaaaaaagcccaatccaaactggcttaaacagcaagggggtggttattggctcatgtgattgagaagatcaatgtgaccaaggtctggatatttctgtcttgtgtctcctaccgagttggctttatcctcaattcagctacctaaagtcctctggaccctacccccccggaagctgaaggatgactgcgggagtttcagtcccctacatagttcctggggccactttctctcattagccacaactgtggctgggggtagacaggagacagtttattctgtaccctctactaaacagcataggtaagactaatagagaataaattttgcaaaaggaaaatctgggtagaagaaggggaacgaatggttggtagcccactaatgtcccatagcagaggatttagagaggcaaggggagcagaaatcctcacagcacaagcactggtagcagtggagggtgggtaggcctgagttagaagttaagatgccagtcttctgatgttcctgggaatagatgttttggccagctatgtcttattaccagtgcccactgatcccaaaactaccttgctgcatgctgatagcgtcctcctagacctcagaggttggaggtgggggtgagagggtcttagtttactaaggtagaaatcagtgaactggtagggtcagatcatgtcagtggaaatgatcccaagattccctgactggtctgaggctgcatataccctgcactctaatagcccattgatgtcagctcttggctacctgctccagtgaaactcgggtcctaaaagtcaacaggtgctcagtgataaagcagggtacaaggagacaaagagagggtcttagggactgggatccttttgaatggtcctaagaagatatgacatttgttgtttcactaactcctaccaactcatgcctaggtttgctcaaagggcttttgtttctggaggcatatcctgaggtcctgagtgggaagcttagagcttggcccattaaaacagagagctcatttttctttcttttccagaaaagcaaagaagcatcatgggtaatgaaaaaaaaatactgcactaggaggaaccaggagacatgagtttggcctgggatctacatgtactgattcctgtttgactttgtataagcttctttaatttctgctactaagccccctatcaaggtgtttttgttgttgttgttttttctcttatttcctcagatagaattattttatagtcaagctttgttattctagcaaagaaacctggggttatgctttggaaggccatttttttcctgtgtttgaaccaaattgaatttagcaggtgcaaagggctgcagaagagacttggcaattgatagaattatagccaggattcagagggccctcaggagtcctaggcattgactctttgagccctgtgctgaaatcacctctcaagctttcctctatccaggctcttctcttgtgtgtgtaacaccatgccatgcccagccacacttgggaataatctcagattccgtatctttacctctctttttaattttgctgctcagcctctctgtgctgccttcacacatcccattagtcaacgaagtcgtattgattttatatccaaattcctcttaaacccacaccatcttgttcatccccatgttccagtgctgctcctccctcactggactcttataattgctgctttactgtgcatgggatatgagaggtcctccataaatagcatttgaacaaatgcagaatgagataataacacaagtgaaatgacgtgaaacaggcctgagttctcaatcttctacttatatgggatagacatgggttggtatttctagaaataattataggaaagaactaggttcttttgtagtcaactcaccacgtgtctgaagttaccttatttccatctcatgaagatgtttaacaagttcatgtgaaacaaactgtttctactgggaagaccatgtccaagtcttcccacattctgatggaggtgccacaccctcccctgcttctctagggtctcattttaccatcctcattttgccagcctctgggaaacctgatctaagcctatgcaatgctaaaagtgcctgcttaacagcttggaagggaggagaggcaatttatttgctcaactgaattacctgtttacacttctgatctccaaagcatatgtcagaacaagaagagaatagaagaaattgttaacattgcatggaactagggagtccacatataagagaaatttatcacatgaaaatgcttgctttctttggtggtgaatctctttcaccatcagaattgcctccctcctgtcatttaccttgcaacaaattttcctttacaatatctttactcagggtgcctttcctctgaaaacagaaacacctagttgacatctcaccactttgctgctttggttgcagcctagtgatggaatgacaagcccactccataggtgcctctgaatagcttatttcagggagctgcaagacaactatttgctcagaaaattctcacgagggtgatggttttcaaagcaggaaggagagggaattcctggtacacttcccctctgcattgctggagaaatgaagaaacacttgaaggcaaagtcataagtcaggttgaagatggtttctggtggagtggtttggagatttcatctcaagttgagagctgtcctggaatagcttctacctgacttgtttatttctcagctattaatagaaactaacagagtgaggatggtccaggaatctctcccataatgtcctacttcaggacttgaaattctgttagaaattcaattttaatatcatgggataaaacataaatgcatgaatctctttgcagaacccctgccaagggacagccttcaataaatacttacgaagctggacactaggctggttgctacaaatacaaagaaaagcaagtcatatcatttcctaccaaggagctcacaacctggatgatgatgccaattctaagactaacaagaacaggtactagcgtagatggtggtttctatatgctaggtaccattctatgtgctttatgtgctgaagtcattgcattatcacaacaagcctataagactcttaaccctgttttacaggtgaggaaactgggacactgtcttgttaagtgtcttgcctgaagtcacaggattaacatgtacaaggcactatgagagcagagagaaaagaggcgtggtcagggagtaagggagatacatgtacagaccactgatgtggactcatcatctccataactgcccctttgcccttcctttgcattcaaaattattatctctctctcgttcaatttagctatttctatgaaggggtgaaaatccctaacctcttgatatgaatttagcattcaaaggcacctgagatgaggaaggcagaaagtgttcagtataatttgggtctgcttcctgatttttctcaggtttggtcaagaggctgaaaagcaaatagaatgcaatggcaggcacacacacataaggagcttattgaaaagatagatctcaatttctagtatttccaccaggcattatgaccctgacacctttttcagttatggtactctatcagggttactttgattataagtgacaggaaaacccaacccaaactgccttaagccaaaggaaattttagagggtcccataaggagaaagtctaggggttgctctgggtctaggaataccttgatacaagatctcatgtaatattgccgggttttctgttctcttctttgaacttagttctcctcctcttgcctcatgatcacaaaattgatgcagcagctccaacccttactttacttagcttctgtctagggggagatataacagttacttttctgaattatcagaaagagtcctgggcttttctatcgttggccctattaagttacctgcctgtttctagatcagtaactgtgcccatggaaataaactacactgattagcttaggccaatgggtataagaataaatgaaagtggagaaccagtaagtctctgaggaaattcagtttacgctggagaatggtagtgacatcttcaatggaagcttcttgagtgacctatgttatagctctgttagatggcgtggtccctccagggctaacagcatctataatacctatgtttccttattctcctccttacctatcagtatgtctgctctatgctcaggagtattccacagtggctcagtggcatgaataataggaaataatgtctaaatggactataagacataagctggctttttcaatggcccttaagtttcttaactcctgagccagggttcttcttcagaccagagggacctggaacatctttggtcctacagatggtgttggttgggtatcagcatatggggagatacgtgggtgggaggagctgatgtcagaaggcctgagttggaacattggattacaatcaaaggaaaaatcttgagccttcaattgatgaaaaaacctccttagttgaaaaatgcaaaactctggcagactccttctgaggatgatgaagaaaagacaaaactctctgaaataattaaaactccgcaggagggatattattatatatggggttactagaaggggagtcaggattagggttgggattaggggagttattagacagggagtcagggcctcctgccatgggaacttcttgtcagtgatttcttcccttggccctgagataggcagcttggtggagaaggcttatacttcttagctgggtgaccttggataattcacttaatctcgctgggtctagatttcataatctgtaaatgaggataataggaagaccaagttcatgaagaaattatgaaaattaaatgaaaatgttaggtagttatgttcaaactcatgcaagcttggccaatagccaaccatttggtcaacattagtttcagttattttctccctgtctgtaaactctagagtttacaaactcaacaatttggaggtttttcttcccacgcagcacatgacttcacaacactaagcatgtcgatagtgaattaacttgtcattattgtatgggttttattattatgtttgcttttgaattagtattttgagcagttgcatcaaatcacagaacagtggaggggttctgattaagctgagcctttccctgctgcagcacaggccctgggtgagggccatttgtattaggatccctgccttgcccctgactagccagatcactttggtctctgacctcagtgtcctgattagtccacatggggataataataccttcccacaaggttattgtgagaatttgagacaattcctagaaagcctggttcttttatgagctgtgtattcattcattgtcagtgcccactctgtgggattttgcaatttaaaacatcacttccatgcatggctgtctctggaagggtataggcccagaggacctcatctggtgatggggaagccccctaaattgctcatacgtatacatgtaaaatcaaaatccaccagtgcagttctccctgcacctccccctatccaagcatggggccagggtggctgccagattgttttttccaagggttgaccctgttttcatgctcctgtgatttacttacagaagggattatcacattggatgagaggctgaatttcatagacctcaaatgtccttttccaactctgagattttatgtgtctatgttttcatttccaaatagaaaataacccttatcattgctaatggtattcccttaaggaagttacttaatctttctatttctcaatttcttatttgtagaatagaatggattatattccctacatcctaggatgggtgtgagatttaaacaaagaatgcatgtaagatgttcagcacagtgtagtaagacgttaatggtgctcactgatagacatttcttatttgggacataatagagtgacatttcctgactcacttgccattggaaggggctatgtgactaagtctggccagtgagctgtgagcccaataaggtctgtgacttctggatcagggcactgaagtgtgcatgtgtgacttctggcacagcaaccataacattcaacatggtggctgctcagtcagcctgggtcccgagcatcccagccaacataatggcaggtactgtgagagggaaataacttgtggtgtactaaggcacttgaaatttggaggtgtttttttactgttctgtaacttcatctacattgattgatacgcacattgttttatccaagataataataactaatagtacttgggcatttgctatgtgccaggtgagtattggttcacattttgcaataccctagaacatacatattattattaatctcatatttagatggggaaactaaggttagaaatgttaagtaacttacccaaggtcacccagccagtaaggggaagggtggggatttaaacccaggtcacgtgacttcagagcttgagctcttaaccgctgctcacccgactccatagaccaaacctgtggtttcatggtatgatcaactaacattaattctgctttccctttctcttgaactgcatcccctgtagtttcatttggaagtgatttcctttgttggccattactcttcagagtggtggtgaggttgggaagccagcagagtggcctgctgtgggtattgaatgctgatgttgtcataggaagtctctcatttgctttgctttgcttgactactttttggtttttaacctgttatttaagccaaagtatttgatatgggaacaggaagcctcttaagggtaaggaaggcattttgtcttcttacctttgcttgaaggcatcaagatgattgtcttgggtcagagtcagagcctgagatggggattcttctttaagtgatttgttgagggagttcttttggggaaaagctacaaggaagtgagggaggaagagcagggccagggaagctaagcaaagatgtggtatagctgaggtctagctcagcctgatccacagaggagctgagcatgacttgtgacacagagtttgctctgcattgaggcaacagggctaagtttgtttgtttgtttttttggacagagttttactcttgttgcccaggctggagtgcaatggcataatcttggctcaccacaacctccacctactgggttcaagcgattctcctgcctcagctgctggagtagctgggattacaggcatgtgccaccacgcccggctaattttctattttcagtagagacgaggtttctccatgttggtcaggctggtcttgaactcccgacctcaggtggtccggccgaggcctcccaaattgctgggattacaggcatgagccaccgcacctggcctgggctaagcttttatactcctgcatcaggtggttattggccttgggtgtaacctcccagatgtctccaggtgaagtggctcccattagctaaagacaattctgcagagaaggatgaggtgcagcgtaattagcagccaacacctgcagcagttgggggatgagtgcacttgccaggtaaaggagacctggaaggggcaccaaaaacatccactatagtgtttgaggtcagtggcccatctgatacggcttagctctgtgtccccacccaaatttcaccttgaattgtaataatccccatgtgtccatgagagggaccctgtgggaggtaactgaatcatgggggcaggtttttgccatgctgtttttgtgacagtgagtaagtcttatgagatctagtcgttttataaaagagagttcccctgcacatgccctcttgcctgtcagcatgtaagacatgcctttgctcttcctttgccttctgccatgatagtgaggcctccccagccatgtggaactgtgaatccattaaacctttttcctttataaattacccagtcttgggtacgtctttattagcagcatgagaacaggctaatacaccatcctttttggatttgtgatttttttttttctgggggtgatattgtcaagttgagaggaggtagcgaagtgtgtaaggtgtaagtgtagtggtggcatgtggccttgtcagggcctcagcacatgccttttattgacactgaagtgttgtgtgtaggactgtgtaagggcagggtggttgttgtgcacactgtcctgatctttggacctagaactgatacattgtgtctagtcaccaggggagttgtccctttctatctttttagacgggcaagttggctgccaaaaatgtttaggcaattctggtggtgttttcctttctcatgaaataggcggcttcaacctcatagaataagaatcagccactctgcctaacaatattaatactaacaccaatgccctttattaagtgccaggggatttacttgtattaccagatctattcctctccatgaccctgcaagatgggaatcataggatccatttgatggtccagaataataaatattaggaagagtcagcattttgtccaagggcacaccattaaaacagtttgcgtcaaagtagcaaagaaaataaatcacagcatcaaagaacaggagattaagagaaactgaggaaaaaccacacgatctcggaggggtagagaatactatatttataatgaagaagtctgactctttggattaatataaaaatcttgccatgtagcatgtgggagaggagagcaagggaggctcacatgctggagacaggatttggttccaatgctatctgactctaaggctgatacatctttctgtgccatggtgttttaataagcatgtaatttagaaatgtccacccacttacttcggaaccatagatttcattaaaggagagtaaaaacccaggctttggatacagacagacttgagaaacagctctaagatttgggcaaggctggtcttgaactcctgacctctctattcatcctctctatgcctcagtttcctatttgttaaatggggatgatatttagcttgcatgactgtcatatggatgagatgacagcatgtatacaaaatgcctatcatgtaaaaagcacttagtctttaccagttattttaatatattcatgaagaagtttcagttttgtcgaggagaaaagaggctgtgtcagttctttattctctcataacaaactgtcacaacatttggcagcttaaacaataacaatttgttatttcccatgagttgaggggttgactgggtaagccgtccagttagttatatttcatgtaatgttagcttagtcatttatgtggttgcattcagctgtgaacttagctgggcctgggatgtacaggaaggctccttcacaagaccttcacaactcctctccttgctcaattgtctaacccagattcttacatggtgactagatttcaagttctccaaagtggaagcatccctgctgctatggactgaatgtttgtgtccccttgaaattgctatgtcgaagcccttatccccagggtgatggtgtttggaggtaggacatctgggggtcattagagtttgatgaagtcatgacattggagcacttatgatgaaattaatgcttatgaaacgaggaagagatgagatctctgcatgcatgcaccaaggaaggccatgggaggacaaatccagaaacacagctctcaccaagaacccaactatgccggcacactgatctcagacttccaacctgtagaaacatgagatataaatgttcatggtctaatctccatctgctgtactctgttatagcagcctgaactaagacacttgtcttcttaaggtttagcctggaattggtgcaccgtcaattctataagtaaagcaagtcacatggacaatgcggattcaaggggagggaaattaaactcagagtattgttggcagaatggcatgcatgtacttgaaggggaggagtgattggcagccatatttgaagactatctctcttggatacattcatcctagatcattcataaacaaggtgattttatgagaagtttaattcttactgttctgcatttgcagtgcagacatttaccatgatgacttattccctgtagagtgggttaatgttttcagacatggcttcagaggacctggggcttcagttgagccctgaataaaggataggaaattgctatggaaggaaaagaaaagggtctgttgtatgctttgtttttttcactcacatgaaccaggacaaactcagtgtgccttgggtaaggagggtggcgacactgattttaactgtcaaattgatctagagttgtcagatgggataatttaaccctcaaatgaaggtgatttatcctatgtattgtaatcaaatagtcatctaagtcactccccatgagctctggtaaatcacttttagtacatattgaaagtgaccgtattgtattttattgcagaattgcgtcttatagtaataactaatgcatgccattggcttttgctctagcaccgaattacactcacttggaggcacatggatccaggtgggcactgttgcttccatttgcttgtccacagtcagaactgagaggcaggtaggaaaactgtactgctgcagtctttgtagattagctcaattcagagacacctgtggtcttgtgaaatgccaaactttactccagtggcatttgggtcaatgtgaactaggatgggcctagcaattctattaggtgaatgacaagtgctttgtaatgaaacagaaggactttatttaaacagatataaggactggacagaaatcaggcttaaattataccttatctgggctcctgctgtaaccttgtaactggtcttaccacttgtggtctcaagactattttgtcctgcagcccccagagcaatctccctgaaatgcaaggtcaactatgctggcccccggcttaaagccatcatggcttcccaatgcctgtgggatgttgtccacactcttagcttagcttacaaggctctccatagtctggctcctgcccacctgtccagcttcatcttgcgccactgcccattttgaactttccatgctacctacataccgtgattcacttctccacactgttgttcatgtccttctgtctgcctgagatgtgctctcccagcttcctgactctgacctcctttgcctggccaactccttctggtgctggaagatgcaccacaaacatgcccccatgggagcatgcgcagatgctctcaggctgtgctcataatttcctgagtctctcccctcatcatttcacttctcacatagcattattatgacttatttaggcctgtagctctactactagatggactgtgagctccttgaaggcaggaacccatcttaataatatgggtatcccaagaaaccagcacaataactggttggcccagaggagatgctcaataaatgtttgtggtattagtaaatttatgaaaatacctctttgggttgtcacagaagcacatgagcagtggagacaagattctcatcttgaatctgagtctcctttgatctgaggagcttcctgttttgaggttacacatttattttagagacagagtctcactcttgtcccccaggctggagtgcaatggcacgatctggtctcactgcaacctgcacctcctgggttcaagcgattctcctctcttagcctcctgagtagctggaattacaggtgcatgccaccacgcccagctaatttttgtatttttagtagagacagtgttttgccacattggccaggctggtctcaaactcctgacctcagatgatccacccatctcagcctcccaaagtgctgggattacaggcatgagcccccaagcctggcctgaggttgcatatttaggttggaattagtgtgcatgttctccatgaaggtgaaatttgtatggctctgggacctaaaagcctaggcaagggcatagagatatattagcctggggtggactggggaatgttttactagttagcattacgtgagaaattaagcaagtcttacacacatggatttgagacccagaatctgctccatttctggggcttttgtgtgttagaaataagtacagctgattatttcatttatgttggtggatttggggctgccaagcttctctgaagggcccacattttcctttggtactctatttctcattttgcccttagaaataaggaatcttggagtaaattccagaggtggtaggagaagggagaatgcattcccacattggtagctaaggttcataagctcctagaaaagaagggaaagatctctgagcctagaacatgggactcccctttcttactgtaatttgcagacagattggggcaagaaactccatgcagcttggaaacatgtcagagtgtgccttacaaggaaacaaggcaaatacaggaggaaaaaggtaggctgctgtttggtctttagaaacaagcattttcttacatccttttattcccggtatatgtcctatgaaagtcattctggtagcaatggtaatagtactattaataataatgatgtacatatattggatgtgttcaacatgccaggcaccatgccaagctttttacctggcttacttcatttcaatttataactttatgaggcagatacattttcatttctatgttacagatgaggcacagagaggcatagaaacttgcccaagcttggaggagctgggatttcaacttaatctaacacagcactgtatgttctcaagttgtcactatattacctcccaaacaacatttacactaacaagtgcagccaatgtttattgagtgctaactctgtgctgggcacattgccaacctttacatgaagagcctcagttacccctcagcaccatctttggggtgggttattattatccttatttcaaagatcaaacaactgagacttagagattcagtaacatgtccaaggtcacacagctagttcatggtgggacctgagttcattcttaggctgcttgtctcctaagcctctagtccaactttttaatttttttattttattttattttttgatagggtctcactctgtcacccaggctggagtacagtggtgtgatcttggctcactacaactctgcctctcaggcccaagcgattctcctgcctcagcctcctgagtagctgggattacaggtgcttgcctctaccacctggctaatttttgtatttttagtagagatggggtttcaccatgttggccaggcttctcggcctccctgagttctgggattacaggcatgagccaccatgcctggccatagtccaacttttaaattttggtttaggaagtgttttttatcccatccatccagatctccctctcatagtcagttttcacctcttccctggggatacggctcaaggagaactttcatcatcttcaaatgcaaagaccacgtggcaattagagtgtgggggattccaagccccttctggtgattgtggacttgaaaaacagtagtggtaatgaataattaaaggttaaacaaagggaatagttctagagactgggtgaaggggagcctgttttattccactgagtttgaagccagaacaccatgtcttggcactgacatgccttggagacttcgtattgatgatcatggctaactgactctttctcagctctcagtatcattcatagtcaggactttacatgtgtgtgtgtaatgtatatatatctgtgtgcacgtgtgtgcgcgcgcgcgcgcacgcacacacacacacacacacacacacgtaaagtcctgactaccagtgataataatacatagttttttgggggaagaagggatgcctcttgtatgcacagcactcaacttctgcttttgggcagggaagatggaaaaaaaaggtaaaatggggttatttgtcccaagttgacttgacagtctaagcagggggataaggcagatgaatatgtgaacaatgttttggtagattagcttggttagaggattttcaaactttttgaaattataaaacctacaaatatatattttttaaatcacaaaacaaaaccttaatgaatcagtaaaattctcataatctttatacaggaaaggtagtagagaaaagtttatatcagtttgcaactacagatttatgcccttacatatgagtggtagatatgtgaaatatgattattagtaataaagtgaagaggatgttatagagagggatgcaataaaatttatctttttcatcatgttcctcatctgggttaccatgaaactaatgtgaacagtttccagctccaggcaaaacatttacactcctcacctttcagtgctatcatttgttgcatttgggaacaaatgtgcagcttcagggtgagaatggaagaatatataggcaaaagaagagctatgaaatatattaataacgaatattctcacctgaaaactatgaatttcaagatcacacttaaggtccacttcaatttaaaaaatgtcctgaggatctgaataatgacaattggaaaattaaaagagcattgatagcttaagtgccaatgaactcaaggccaagatctcagttttcatgcaaactggtggctctgacttcgttccactgctatagccttggctgaggatcttacaagtgggtttttgaaatggattcgggtggaggctcagggagtgcacctgttacctccatggggcaaaggctcaatgtagggaacttatgagagttggagagcatgatgtgtgctgtgtagacagcacagcatggggacccagcactgccctcatcgacatttctcttagaaaatgtgattacaaggcaggcagatcacaaggtcaagggatcaagaccatcctggccaacatggtgaaaccctgtctctactaaaaatacaaaaattagctgggtgtggtggcatgtgcctgtagtcccagctactcagtaggctgaggcaggagaatctcttgaacccgggaggcggagcttgcagtgagccgagattgtgccattgcactctagcctggtgacagactgagactccatctcaaaaaaaaaaaaaagaaaaaaaagaaaagaaaacgtgattacattgtaggagctggaggattgttactaaatcattcaaaacagcaaaagttaaaaataaaatagcgaccagttaaaaatattccactggtctaacaaggaggatataaataaattatgatgccttatagatataatattaggaatatttttcagccattaaaaactacgttttaggagagtatttaataatggggatattatagataaatacagatagatttaggtataaaatggagactatttctttctttaaagtactttcttgatttttttaagtcagtatatccatctctctttccctagcaaatattctccagagaaacagacaaacatttttcattggccatctctggatataaggtaattttagttttctttctttctttcattttattttttaaaaaagagatggagtctcactatattgctcaggctggcatcaaacttgtgagctcatgcgatctgccctctcagcctaccaatgtgctaggattacaggcacgagccaccacgcctggcctgattttaattttcctatttacatctttctgattaactttttcccttataatcacatattgtctttgcaaccataaaaaaaaagcaacaagcgccagctatttctctagtggcatgttaatcttatgcagtattggaatgggagcaggcagagggcttggtcctagatgctccgtttattagttggctcatggaggataagcctgagcttctgagagtctggggtaaacaagtggccatgccttcctcacaggtccctggaggatcggagaagtgatgtgtgctgtgcaaaggtgaaggtttctagccaaggccactgctggacttgcacttctgcctttctcctgggggtcactttttcactcttcagggcttggctcaaatggtacttccccaggtaaccttccctggcccccacatacgatcaggtttcctctttgaatgcccttgtaacacttcagaactcttatcattgttgcaattttgcattcattcttgaggttattggatgaatgtgtggctcctcctctgaatggtctgtttcgtcacttttgaacatccctccattactggcagatagtagtctctcacaaatgtttggtaaacgaatgaactcttcaatgcaaaggtttagaatcagctggtggggagacagatctagtattttgaggtggttggagggatcatggtgttaaccaagagaaagctcttagcagagtcactgtataatttttttctttgggaaagagtgtgtgcttcaacataccagagagctaaggctttgcactgtaatatgggttaatcaatcaagaaatcaatcaacacctacttatccagtgcagaccatgtgcccagcacaatgctagaggcactaagacttttgggaagtggctttgcctctttctttcagttcacaaaatgaagtggttaagacttgcagaaatcagaagtggaagaatgcaaactgatcagtgattgcaatgactggaaaagggctatgaaacgccagtgcatttgagaccaagcattatggtgatggagtctcacatcctgaaacccagggctaatcctccccaagagagacgtggataggaaaattcccctgataattattgcaaaagtgtcatcttaaaaacaaacaaatatcacaagatgcctccccaaacttgaaagcatgaaacaaaaaagcaaactattcctaatcaggctaattgtagagttagtggctctaaattgtgttggttttgccagttctgccttttggaggtggggacaggggagatttggtttaacttaattagcatttccaactggaaatgtgacaatataactaccctaaactgttgctcagtaaaaatgcagaaggagaattcctcctcagtcacatttatacagaaaccaaggacaggaagagaaagaagacataggctattaggggaaggaatatgtgggctacagatacattcagacgccaaaacttgctgctcattttcaacctctcacctaattttttttctcctcctggaatctatgactataaattcacttctaaggggaaaaaatcagcccatgctcacagcctgctaggagcgcttatacctcccctcctccaaccttccactgcccggtacattattttggaaatttgagcagagttgtctttggaatgacggcgcctcatcaatacagaatttgtgataatctggtccttgggtgggcttgagtttatccacataatggaggtggagtggggagacagaagtatgttaattaagactaaaggcccacaaactcttttcaagtaaagtagccttagctacagctgattcttttctcttagtaaaaacattgataagtttaccaagaccccttgcatgttccctgtctccacatgtgctagaaagtattacgttggtgcaaaagtaattgtaccaataatgcatctgcatttattaagtgtcctttaatgcccacttcactgtagcagtccagttagggactattagcaagggtttatagtattattatgaaagaatctggatactagcagtgagaggaagactttccgcttaaggaaatattgttcccgtaggggcacaaatatatgaacaagcgtctgcaaaaactccaggctagggtcagagcatcttaagtgaattccaggaaagtggtttatagtctagatgaaagagagaaatgcatttagcgggggttcttgaccaaactcaaggctccctctttggatcagagtatggggcctaccttggcgggtgcaggggttcctaggcaggtgggaggtctctatttgtgttgaggttgcagctctcttctccttctacattttatctcctacgtttttgctaccatctggttgttttcttaccacattgttcttgcctctggcctgcagtgggcacccttaagaaaagtccatttagatgtcttctttccttgctagtcttcatgtttgtcagttctgaatttgcatccaatgcctgtcctcagtccctgggccttccccttgatgtcttcaatgtgaaagctattcagccatggggactgtgctcctcccttcaccctcctgtcctccaaggaaaatcaggaagtatctggacagactgttggaacaaagcaaaatatttaagttcctgtcatcgtcccactgtggcttttgatcatttctttcagtagccagtttagtttaattatttatagaaagacattcatagtgctagaggaaatgtcctataaagcatttatcaaagaatgagtctttgtaatctgagacatccccagagcaaaagcaaagtatctgggctgatgattcaggtattacctttggagggaagcaggatgagatttctagagttgctggagtttgaatctctgggttgactcagtagataagcctaaaatctgtaggaggtacaatgcctgtgcacggtcccagtccttccaacaacaaaatgagggggtcattcccatatcatcattatacatggagaaactgaggcacagagaaataaagtacattgcccaaagtttctaaaatacatagtgaagtggaatctagatttagagagaggcagtctggtgtaattgctgtgttcttaatactctggactcctgttgtggacatgctggtcccttggttgttcagtgtctgaggacagtggcttgtctgattttctcagcttcctcgagatggatctacaaattggactgaactacagcctcagaagtttataaggagtttcatcttgataatttggtgggactggaagatgtctttgaccaatagaccagtatccaatgtactcaagatggatcagcctgcttctgccacttcctcgatctttaacttacccaagctatttaatttttgaaagtctctgttttctcacttgtagtttcacagtggtctctcattctgtgttgtgaggataaaagagaagagggagcatgtggaaggcacttggtacatagttaagtgtttcagaaatgtttctagattttagctgaggtcctgtggcatcttagagtattgtccaggaatcttggtggcagtatttcccaaattttagcatgtacaggaatgatctgtgggggaagtgtcaaatctgcatattcccaagccccacccaagtgattcagattggaccaggtggtgctacagtggatgcagccatccagatggcaccactgagaaagctggctcacaggccagcaggggcccctcccaccccttgactaaaccctctgcattccttcagactcttcttaccctgaatggagagtgctagaaacgttcttagtagctttctaaaggctttataaggccaacgagtaataatttggtgatttcagaagcagccctcagaataatatattttctaccccttcccccacccactcttggctcctggccctacctccttcacccctcttcgatttgtaccacagttcgtggcattttctgaacctcagggctcctgtctggctagttatttatttagctgaggaactgcagcacctaattaataggaaattagctgtgagtgtaacatttggcccgtagtcaaggcccaagaagttataaatacgcaccacgtgagtggcctgggcacctgattcttggaagatccagaagtggcacttcctgtgcagttccaggaagtgaagtatgtgctgcataggttgtgggtagccaggagcaggcatcacctgccctgaggccagcaggaccatcctggggagcacaggggcctgtctgcttctccccatttcccagagagctcattgactcttctcaacttagctgtcttttcaaaggccaggtgggagaggacacatcaaggaaatgagagcagaggctggaggggacttaggagagggtatagggtcccttacagggtggcccaagcaccgtgatcctccaaagacactaggtctgctgttgtttcagacacttgcattggcttcttccaggggcacgtgaggtacagcttcatctaacaccttgacagtagggactctgcattgaaggggatctcactgccattcacaggttgcagaggaaggggaaaaatcttttccttctactcttctaggttcctggctggggcccctataacaaaagatggattaagaagagaatagcacacaaaattatttactatgttttatgtaacaggggagccttcataaggtaaccaagatttgaagaacagttaaccctgggtgttttttatggcagtcttgatgaagagtgaaaaggcatggagaaacttgatagggcaaacagtgtgaggtaagcatagtgaactccaggaaatgtagctgggcctgtctggattcctccctgggtccctagtcttggcagataagtatgctcccttcctctgggcacctctcatgtgacctgcttcaggggaaggtcagaaaattcttcctgggttttctcaaatttttttagattaaaatattcaacatgccaaagtgctgtattttggggtagtgtgttctgaaccccatcacagaccatgggaactgagcctagaggaggttagagatcctgcccaaaccagagagaggcagagttcagatttggaataaacatgttcagccctcaagtttgatgctgtttgcagaatctcatagtttcctgattacttcaaaaggaaaatcaggctgggaggagaaaaatgtttttaaaagccccaaggaggaaaagactgagggggaaggaggagcaaaagggtcaaggggaaggtaagggcaagtctaggagttccttaggaggcagcggtgcccccacggaaggaggaggcggtgtctgtgggtcagaggcaaagctattttctctagatttgcttgatttcagttatctcactttcttttttctcaacttcccctgcagggaaataggaactgggcaacctgtctattcccttgtgcgagttaaaaatctgctgataaaagtacctattccaattctaagtgtgtttgttatgagccaaaccctggagggtgggaggagggaggtgcctggttccatggcagagcagggccaggaggtaaagctggttggaggacatcagggaacagaaagcacagagtaagtgaaatattttgccagctttatttaaaagatcgatcgaagcctctttaacacaggcttctacctgagaactggtataatgaatctggcatttatgtgactctggaaggagccttccgaaggaggagaaaaatgtaaaagaaattgcatctttgggtgggtcccagaaggggttgatatgaagaaagaaaataactcattgctgatgtcacagagcagaagatggacatggaggctgcatatcacttagactaagtgggacagagtctcccttggaaagaaaaaatgcctctagtctcactcagggaagcaagttatcaatcagagcccaggctaagaacacagatatcactgatgccctgaaagaaagataatacatcttccttttcccacctctacccattagccagaggcatttcctgaccttccactgaagaagaaaggggtccctcctgatttcttgtcctttgggggatgttaccaattctttactatcccaggcagtgcttaggcaccaaatgactttggagtcagaaagagctgagttcaaacatcacattcctgcctgtgagtttggacatgtttgattatctcttgatgacctcagttttctgatttgtttaaaaatataagataatatctactttacagggtttttaaaaggactaaatgaggtaaaagtcaaaaccacaaacatagcacctgccatgtagttgagacttaagaataataagtattgctgttattgttatgcaaataaaagaatcaagaataatacttggtagccactcaataatcagtttctgttcccttgttaaaggtcacatcagtaatagtgatgctagacattttgtctccctccacaactctcccctaattcaaccctaagccaaaacttaggccaacatcaaccctattcccaacaatatgcccagctgtattccccaatcctaaccccaacctagactaaactataaccccaactctatctcaatttccaactctatcccaactatattattcagggttcttcggagaaacagaaccaataggatgtgtatgtataatatgcctctctcctattgagagagagtgaaagagggagaggggagagagacagtgagagaggacagaagagagatttttattaaaagaaattggctcacgtgattatggaggctgaaaagtcccaagctctacagggtgagttggcaagctggagacccaggaaagctgatgttgtagttctagtctaaagactggcaggtctgagattgaggaagagccagtgtttcagttcaaaggccattagacaggacagattctgtcttactgcgggaggtcagcctttgtgttctattctgctcttcacccaattgcatgaagcctatgcacagtcaatctgttttattcaacctacaaatttaactgttaatctcacccaaaaaaacgccctaacagaaacaactagaataatgtttgttcaagtatctgggtacctgatagcccaatcaactttgcacctaaaattaatcattttaatcatcacaccaatcttatccttaaccctattcccagtgatattacaaccctaaccctaagtctaaccccaacctcagaccaataattactattattattattattttttgagacagagtcttgctctgtcacccaggctagagtacagtggcataatcttggctcactgcaaccctccacctcttgggttcaagcaattctcgtgcctctgcctcctgagtagctggaattaaaagtgtgtgcaaacatatatatatatattttttgtatatttagtagagatggggttttgctatgttggtcaggctggtcttgaactcctgacctcaagcaatccacccgcctcggcctcccaaagtgctgggattacaggcatgagccaccacgcccagtcagtaattactattaaatatgcaacatgtgctagatattgttagttcctcagctttcttctttttagtgtggatacaaatcctactctagttgccaaaacttattaatcaatgtgatgaatccgcatcataaagtcaacttaataatatatctccagagtatggacttgaaagggagctgtgcttggaatagattttactcagatagtcacacaagatgatcagcacctgctttggcatgaggagccactcaggcacacagagggagttctatttgttgtgccagctcctgctccattctcctgaccaagccctgctttaatagggtctgtgtggagttaagatggccagtgatggaggcctgggcacaacaccccagagatgtcttaactcagagaagatagatttgtagaccattaggagctgaaaatatgtgttagtattattactcatatagatcacttagttttctgtcagatttttgtctcagacttatcccctatgatgaaaaggaaacttcttgatttctacaaagattcctactgaatcaatgagcattagaattgaaagggatgggctgagcatggtgggtcatgcctgtaatcccagcactttgggaggccaaggcaggaagattgcttgaggccagatgtttgagagcagcgtaggcaacatagcaagaccccacctctaaaacaaatgtttaaaaaaattagctgggtatggtgttgcacgtctacagtcccagccactcgggaggctaaggtgggaagaccacatgagcccaggaggtcaaggctgcagtgagcagtgatcacaccactgcactctagcctgggtgacagagcaacaccctgtctcaatttttgaaaaatgaaaaagaataattattttatcccattgttctcaactttaaaatcactgatgcttgagtcttgtcttggagcaatccatccatctgtggggtgaaccctgggaattagtatttttagaggcactcttctagcgttactatggctaaatgtttccaccagtctggctaaaacttctcatttcatggatggaaaaagtgagactcaaagaggctaagtgactttcataaaagcagacttgcagggacaaagccagcacctaaggttttataaatactagtccagtgctcttgttcagacaccacattccttctcatcttgtttcctcagatttatagccaaaaacaatgggaccatcagggacccaccttaggaccctcatagcgagtggtcctccagctcagcccatgtgcatccagctgaaaggctttcatacctctgccctgcataggtcttgttcagagaagtgggtgcactgtggcagaaacaattctctactaacccatttggaacaataaagaaataaatcctaatccaccaaccttgaccagacagctgaaggttgtgctcacttggtactgaccttgtaaagatggattgcaattttggggagtcgattttattttgtttttatgtttatttttccttctgggtacctagagttcatattcatcctagagagttctgggaattgcaggtccaatgctattagcatctgcttcattcctctgcctttctgcccaactcccttgttttctaattcttaaaaaatttttctattttttaagacaatttatactgaatgaattgttattttaaaataggtgagtgaaatccaccttaagtactgatttgatgtatttagaaaatatggaggcctctgaagcagaccagcaaggcagcctgtgtatttcccctaggtgtggttccctctttattaccagagggtacataggagattctgcattcatttagtcattcattcaaataatgtttatggatttaattttctttaggtccagggaacttgataggcactaagggaaactaaggtgaattactgtcatcgcttgacctcaagaagcttaaatctaatgggaagggaagaagagtatcctcgaacacccgtactgtatgcaatgtgatgttccctaagggtatggcaataggagtataggaatgagtgggattatttctagctgaggatcagggaaggttctgttgatgatttgacattttagctcagttttggaaaattgatgtgattttgacagaaataagtataaatcttttgtgtaggcaaaggaacagctggagcaaagaaagacaaaggggagggaaagtatgtgcttgtgtgttggggagtatatctttggtcttcatatgataggtaggagggagcatctgaaaaaaaaattatgtgtagacctcacggatgcttatgggttgaaactggctttagtgactggtctacttcctcagttttacagattataaagtaataataataatagcaatatttgaacttaactctcattgcatgctttctataggcagttactgaactacagccattacatgaattttctcattattttcttacaacattccttggaggtaagtattattattatccccactttgcagatgaggaatctaaggctcataggtcagtaagccagtaaaaggcagagttgggatttgaacccaaggctacactctttccgtggccaggattttaaccggggtattcagtactggtgccattatgggggaggaaaagatgatggattcattttggacatgttgagttagaggggcccatgagacctccaggagaagaggtgagtctgaagcttgaagatggaataatttgaaataaaatgaatttgtttctgaaagttgtatcctaacgttggcatattcagaacaccagtcacattgacttgccctgcagaatttccagatgggaattctagcagctcacatgccaaggctgctccttagtgtgtgtatggcttgccagacccatcttccaaagctgcactcaggttttttttttttttgacatgtctcagctcctttctccaccatgtgtgcctgcagtactgtctccttttatctaaaggtgttttgcaacttgaccccttgctgcctgccaaggtttacctctgagaagtatcaagctgttcagcattggctagaacaagctcttctgaccctgtcgacccaacagtgaaaaagtgtcagtgtagggaagcggaagatgttaagcatgtgcatgaggaaggaaatagtttctttccagcaggtgagaagcccagagagttttggtggcctgggcaagctcctatgcctcaggtgaaaaagagaagttcagtaaagctgccttgcctggttttaagttatattgtcttctaattccttcttccctcaccttcctcttgtcctaataccttcaactccaagtctcttgtcatttcctgacagactggcaggtatacctgacagactggtataattgttggaatcaggaatgtctgaccaatggggaaactgtggcagtaaggagtggagaaaacttagtgaagggcttgcagtccatgactaagaacacagacttcacgtgatcctgtaagaagacccgtcagggaagagatctaagggttggagtctgtattattcttctattgctgctgtcacaaattacctcaaacttagtggcttaaaacaagatacgtttattagctcacggttctgtaggtcagaagcaaaagcaggctttgatgagtccccctccttagggtcttacaaggctgcaatcaaggtgttgcctgggtgggctcttatctgcagattctgggaagaacccctatccaagctcaggcctattgttggccaaattctatgcctcacagttatgggattgaagtccccattttttttcttgttgtcagccaagagctactcttagctcctaagggtctcttggattccttgtcacgttgcctacatctttgagtgtagcaatggttcatcaaatcctacttatgcttcaaatctctgatttctgctacttgctggtgaaaatgctctgccttttaaaggctcatgtgattctattgggcccacctagataatcttccttttgccatgtacgttagcttgctaggactgccgtaacaagctgggtggctactgtgtttgaatgtgtcccccaaagtttatatgttgggtacttagtccccaatgcaacaatgtgagagttgggacctttaagaggtgattaggtcacgtgggctgtaccctatgaatggatttgtgtcattatcaagggagaacattagttatcattgaagtaggttcctgatgaaaggatgagtttagctcccttcccttttcttgcgtgcatgctctcttctatcttccactatgggatgatgcagcaagaaggccctcccaagatgtgggctccttgaccttggacttcttagcttccagaaacggtaagaaataaatctctgctctttataaattacccagtctccagtattctattatagcagtacaaaatggactaaaacagtggctcggacaacaaaattttgttgcctcccagttctgaaggctagaagtctgaagtgaagttactgatgctccttgacttacaacgaggtgatgtcctgacaaacccatggtaagttgaaaatattgtaagttgaaaatacatttaatacaccaaacctaccaaacatcatagcttagcccagcctacgttaaacatgctcagaacccttatgttaccttacaattgggcaaaatcataaggcaaatcctgttttacagtaaaatgttgaatatctcatgtaatttatcgaaatgttgtactgaaagtgaaaaacagaatggttgtatgggtgctcaaagtaaggtgactactgaatgcgtaacactttcacaccatcgtaaagctgaaaaattgtcagtcaaatcttcccaagtcagggaccgtctgtattggcaagattgattccttctgagggttgtgagggagggatctgttccaggcctctctttggcttgtagatagatgactgtcttcatatttgtatggtgttttccttgtccaaatttccttttttatcaggacatctagtcatattggatttaggccaaccctaatgaccccatcataactaattacatctgttaccatgtttccaagtaaggacacagcatcctgagatactggggtttaggacttcagcatatgaatttagggggatgcaattaaactcatagcaccatatatcatacataatcataacagtcacatcttatttgctcatactcaaaagggagggatttggacaaaggtgagggtcattggaggtcattcttagaattctgcttgtcaccctgcctctgagtcaggatacctgctcagagggatgtgaggacagctatgatgaataaaaagaatactgctgaccatggtgagaacagctacagaggagtgggtgaaggccatgatcaatgggttgcaagtgaacaagaagtgaagaaaatgcagagactgctccactcaagaagcagctgtggccaagaggaggccaggtggtgagaagagagggaaacagaggtgaataacagttccactaaaatccaagagacctgagcttgctagttgtctagagacaactgacagagaggggcttgcaggcggctaaagccattcaacaatttctggttgtccacatgccccttctatgggaacttgacttggtaccaggtagaggattttgtagaactccacatgttattaaatggcctttgcaaagagacttgtgtgcaatctggctgaattatagttcctttggagattcatgtttgcttacttgtggctctgtaactctcagccttaatatcacagaaatgcatttctatctggtcttcacttccctgattctttaaaaattttatgtgattgttcttggaaggaaagctttggtggaatccagacatagtattggccactattgattgagggtctgctgtatgacaggccctgtgagaagggtgcatgtatattagtccttatttcctttttaccaggtagattgttaccttcatttcacaaatggggaaactgagtctcagaaagcttcagggctgtggctgaggttatagcattgctaagcagtattgctctgcctcctgggttagtcaccgcactcacattaaagacctttttcttctgaaagttggcaattttcttttgtcttgataaatgttattttcctaggatgtacttagagcaataaatgttctgtgaaaacaaaagtgtagtgttcactttctattcccctcccagtcccaaacttctgggcttcccagttcacctatttgagaaattacttagtgaaacattttcatctcccacccagaataattcattgccaggcaaagaacaatgcagagacattacagccagtgagactttttccaaaggtcacacatcgacgtccagggatttgtgatggacacagtgcccaaggcacaacatcacatttgcttctctttctggatgcgtttcatcatgaaagggtttgcaagcctccatctgctgacttgcagtgggctgttccccaaaatgcatgccttgttctcatttccaaggagaattgcaaatcttagaaggtattttaagggaatatgacaggagcaggaacccagagcaattggaattcagagtggtggagtgaagaatcagcaggcatggctgccagagtttgtaggcttgagaagcaatgaattctgccaggagtgagagtgcttggtgaaaaccctggaaagaaaatcacaggttaactgggttttagaggcagtgtaggaatctgtcaggtgggcagcaggtagaaggtgggagagaagaacatctcaggtataggagagatacacaggtttaaatgtcagtgctgtggtgccaagtggctcaagtataattgagtatattagtaatgatgccaaccgcccccgtaataataaacacatacatttttatgtcacctactgtatgtcagggtacattaattatattctaagcacattaattatattaactcgtatattcctcagtgcaaccacacaaggtgaatactgttattatccttgctttacagatcaggaaactgaggcacaaggaggaaaataatcatgccaaagaactatcaatgagcagattggggattttattccagcagtttactctacagcagctctgtccagtggaaatttcagtgatgatggaaatgttttgaatccttgcttttagcaaggaagccaccacccacatgtgctattgagcacttgaaatgtggctcgtgagacacatgaattttacattttaattttgatttattatatttaaatgtagacaggcacatgcggctagtgaggacagtattggacaacacagttagttagagtctgcttatctataaccccctgctgcctttcaaattggggagtgtcaagttgattctgtcatgatagttctagcattaaaaaccaccacaggaatcatggccatcatttatttagctcttatgtgcagggcaacatgctcagtgcttcctgtgggttatttcatgtaatatccatgacaaccttatgggtgatggctaagagcatgaactctggcaggtttgaactaccagtgttcaaaacccagctctgctatttgttagttctgcagccttcagcaagttgcttatcctttctatgcctcagtttcctcatttggaaaatggagtaaataatagcatccccttcatgtggttgttatgatgatcaagaggctgtcctttggaagacagcacagtgcctgacatgggacaaattcagtatctgaaggtattgttattattacccttatactttagatgaagaaaccaaggcatggaaaggtaaagtatcatgctgaaaggtacagctaactgagggagagttggaattcaacccacaggtagcctgatttcaaagttcaggttcttaacaattatatggtggtttatttttttcttttcttttctttttctttttttttttttatttttgagacagagtctcactctgttgcccaggctggagtgcagtggcatgatctcagctcactgcaacctctgcctcctgggttcaagtgattcccttgtctcagtctcctgagtagctgggattacaggcatgcgccatgatgcccggctaagttttgtagttttagtagagacagggtttcctcatgttggccaggctggtcttgaactcctgacctcaagtgatccacctgccttggcctctcaaagtgctgagattacaggtgtgatgagcccagcccatcctgtggtttccgatcacagtttctaaaattgtggtttgtggagaactggtactaaaatgcttcagagtgcttgttgaaaatatgattgcctagactcactaaaaactgttcaattagacttttggggtcagagacctgggaatctgcattttaataaatttcccaggtgatttttcatgaacaccttaactaataataaatcaattaaaaaatttaacggtaagagaagtagaaggagagaccaggttttcagatgtagaagataccctggagagtagggttattctgcaaacagacttaattttagaaagatctttctggtggctggtgttgaagatggacttgataaagaacgtcctgggggtagatgtggggtgtggtgatggggctcattagtacagtgacagagtggacagggagggagggacagattctttggatgttttatagtaaaattgacaggatatggtagattactagaaactgaggagaaggaaaattaattgagaatcaaaaataatcctcaggtttctatgacacctgagtgggtaatgatattattaaccaagatggacaaggaattttggagattcagataaacttgaggacttctttggacatccaggtggagagaatcattaagcagctggaaatttggttttgagttcaaaagaggaatatatagcaaaaataaagtttggtgtcctgtcaacactaggggtggtatgtgacctgtgcagtgggtgagattgtcttggagaaactaagtggcaaggctcagcaactcaaatattgccaagggtgaggggttgaaacaagtgtgtgtagtggcctggtataagagaacaggtgttaagctgcttttattgcagctaatctaataactgcccaatcacacagcttttgaaaacactctatcagccacttagctgtacgacactgccccaagctcttagcctctacacacctggcacctcggggtctaagcctactgggtctgaccctattgagagcactcgggtgctgcccatgccagaagagaaggtcaccaaagcctagcccctgagggacaataacactcgagggctaagaacaggagctagtgaaagaggcataggaaaagtagatagaaaagaagtaggagaacaaggacacagctgtgttggagaggctgaaagaaagaaggatttcaatgagagggttgtcagcaagccacatgccaccaagagctcaagctgaagcctggggagaagttttggcatagacttgacaagctggacgtgcttggtgtcttttgccaccagtagagtaatgggggatggagccagggagggaatgagagtcgcaagtggaggcaaagaacatagattactttcttcagtggggaaaggaatgtgaaggtcacttgcttgagggggagacatggttggcacggggttgtttgtaggataagtggggcttgatcatgtttgtagggagagggaacacagagccagtggggtagaaggatctgaagatagttaaaaaaaatgacttttggatcaaaaccccagaggagggaagaatagtttgtatcttgaaaaaaaccagggtacctctttctttgggctaggaggaaaaggtagagaaaagcttagatctaggggcaagaatttgtaattggaattcttgcaagtgtaaatctaggttgtctgtttaaaacaagggcattggtgaagaacaaggataaacgtggtaatgtctacagcacattgagcatctgcacctgtgtgccaggcattgtttagcgctctttgggaattgtcttttttattcctgaaaggcaaatgtaattggcatacccattttacagcccacaaagagaagttaattgcctgtggtcacgcagctagtaagtggttgagctgagatcagatcccaggaagtctgagttcagagcttgctgtagctgctatacagtgtaataaagcagcaataatgatgacttgcattctcatagtactttttttcttaaaactttatccctattttacaggtgtggaaaccaaggcagaatttttacaggtgtggaaaccaaggcgaaatttgctcaactcatcacgcatcttggtagggtcagagctaggactggagctggggtctcttactttctagtcctgttctgcttcccaggaagcgaacacccacaagtagctcctgagtaaattatgttgcatttctgacatctcattccctctcttcctccttctattccagtctgcctactcctaccctgatctggaccccaggccccaaatgccaggaaggtggcctggcacctgctccttccttttggctggaatctttgtcctcccacatgagggcattgcccgcattccccaccaccactgccttgccttagtatgaggggcctcatgcaggcaagcagtggagtagaaggccgcatttgttttgcttttattgttaaataatataaatctcttggctgcaccaccggccagtacgtgagttgtgtgtcttcctgcatagttgctaatgagacagttaatcatttgtttattttgtatgaagagaggtggcagccatatctctcaaaccagacattgggctccaggaccctcagggaagctgcccacccctggcacatgagtcacccacagtcccagcacaatcctgccctgcaggccccatcaccttcttccctgaggaatggccaagatgcaggcatcagctgatgatgatgatgattactgttattgcagctattatttttataaatactcccttccttgagatgcaaaaaaaaaaaaatgtaatttgcaaagatgctttgttgggagataagtaggcttcctcttgggcacggagtttatctcactcgtgcataggttcctagaggtcgtgcaactcacgagataaagctccaggatcctccccagggaaggccagagtcagtgttcagctgttttcctagatccagggttaaagaggtgaaatcaactatgttcgtcctgtaggctccctggggccgaggctgcttttattagagcaaatcaggcctgtccagaagctgtgctatgggggaggagagagccaggaggaggtgaggaggggttggggtggggtgtgctgcagggattgctgtctgcacctgggctgcccaaactgaatgattgtcttaaagggctcccatctcatcgatttgcatgctgtcagcatcctcctgctattttcttggtgtttgtacaaatcctattgcccgaagcttaaatttcaattaactgggtccaactgtctgtgtcctgaggcacagggaatgggctggggttgctttgttttctgctgcggcactccatccttggcagtctgtctgtctgtcttgaacctcctgtcctgaaggctgcacctctctgtgaattgcttgcattccacagtcaggggcagaattacccagggcagggcttatgttttaggagtagttgatggctagatcaagaaacaggagcatgcagtggagtggaatcatccccttaccatggttgatttctagctttctgcttccccctgtgacatggtgagatgcttttatttttacttcctcatccagatatattcttgatctcatccttctttctcctccctattttcttcttctaaatatgtctttttaacctctgcatctttgttcttgcaatttccttcatcagaattttcttcccttccttttcctaccaatccttatcaaaatccatccttcacagctcaattcaagcgtcactccctccaggaagccctcccactgtccttcccagaagacttgaccttgctttctgtgcttccgattccttggatctcacagttctcccttcttagagtcagagctagcatctcattctgtacatcccacagtacagtatcacaccattcatattattttttttttttggttttgagtttgttctggttgagttttgttgtggattgaatggtggttcccccaaaagatatgttacatcttaattgctggaacttgtcaatgttaccttattggaaaaaatggtcatagcagatgtaatgaagttaaggatcttgagaagatggagagatcatcctggattagccagacggccctacatttaatgagaagcgtttatgtaagaaatacatagctgggtgcagtggctcacacctgtaatcccagcactttgggaggcccaggcaggtgggtcatctgaggtcaggagttcaagcagcctggccagcatggtgaaaccctgtctctactaaaaatacaaaaaattagccaggcgtggtggcggggacctgtagtcccagctactcgggaggctgaggcaggagaatggtgtgaactcaggaggtggagcttgcagtgagctgagatcttgccactgcactccatcctgcgtgacagagcgagactctgtctcaaaaagaaaaaaaaaaaaaaaaggttaggtgattgtggtggtgcatgactgtagtcccaactttgggaggctgggacaggagaatcgcttaaacctgggaggcagacgtcacggtaagcagagatcatgccaccgtactccagcctgggcaacagagggagaccctgtcaccccccagaaaaaaaggaaaaaaaaaaaaagaaatacacagggaagatttgacagaaagaggaggagacagtgatatgaagatggagacagagatgagaacgatgtggccacaggccaaggaattctggcagccaccagaagctggaagaagccaggaaggattatccccaagagccttcagagggagcatggccctgccaacacctagatttcagactgttggcctccagaactgtaagacaataagtttctgctgttctaagccatccagtctgtggcaatttgttacagtagccctaggaaagaaagggttctccttctctgaaagggaagacagggagaggcaggaagaaaacaaaataccagcatgaggaacctgtacccttccttccagattttattatcagcttgggtccttctgttttatttcatacaatccaagtcctgttactcccacaccaggccttgggttgtctaggcagctgggtgaaaggccacatttgttttgcttttattgttaaacaacataaggacagggccttgtcatgtgagaacatcaatactgaataaataatatatttataataccaataagagcaattgacatttgtatagcctttacaacttacagattactctgacttacctcattgcgttttgtatttatggtaaacctgagaggtggttgttgagatcctcattttacatttgaggaaatggacagaggtgggaaggggcttgtgtatgaccatacagcagatgtggttgggccaacgctaaaccatcttttggttccaaatctatttcctttaactgtgcacataatattctttgattatgagacccagtaggtcaaatctgtttttaaaattcttttcaaaatgggaatatcctttgcctgagctagggatacctggtttccttcttttcctcaaggtgtgctcaaactcagcagggtttggtagtagtggagaggctgagagaaagccctgcttattcaggggtctttgttttacaagttgtctctgtatgttgatcctctgttattgtttgggtaggcactggggaacctctgtgcttgcatgtgggcatgtacacacatgcactgtgcgctctgccagctgttatccccctctggtgctcactggcataaatctgccacctgatcatctaaaatcccagtgaaaggaaaattgccaggccaggagggtccaggggagaatcaatatatctagtatagtttatatttgtaccttctctccttaagagttacagtgagtgactctactcctcaaatggagcacctctctccaggagagtaagaagatcacataaatagaaagtgagctttggactctaacagacataggttcatattcaactctgctacttaatatccatattggtttgagttatttaaccttgacaatccacactgtaaaatgggtaaataataaataccctcctctcagaagtgttacaaagtttatatgaaataatgtgcttaaaaagctgggtacatagtaggagcttagtcattgtttattttctccctcatacccatacatgattcattctactgttaaaattatgcttctattgtaaccacactgtcatcagggaacagttagtagcattaggttggtgcaaaagtaattgtgtttttttgtcattacttttaaaggcaaaaacagcaatgactttttcaccaacctaatagttttgtcacattgtcctctagtaatgatgccctttttgcaaaggggaagccaagggcttgaagagaggaactgaaatattaagatttcacatcaaatcagagttagggcttaaatagaagtaaaggcactcattttcccactttagtgggaagggaaataaaccaacatttattgacctcctaatataagccatgtccttccctcaaatattttattctcacaagaacatgatgacatgaatagtgatattatccccattttacagatgaggaaacaggcttagaggatttcagttgctgtaggttacttagcagagaggctgccctccttcccagggttcctggccccagggtgcccagctcctgtgtttttctgctccatcatgcggctttcctcggagtcctggggaaaatacagctcaaggagggtccatgtgtaaggatgaatcaagaggagcatctcattatcacccctagttgtcaaagaacagaatctacagccccttgttgcttgtttcctcccagtcattcagctctcaggagtggagttaagatggaacctgactggtaatgtaatgcaggacccaaggtgtttcccataggtcatgttgtttatggatctgatgtccattatcatttgaaggagtgtttggccaggcgcagtggctcatgcctgtaatcccagcactttgggaggctgaggcgggtggatgatctgaggtcaggagtttgagaccagcttggccaacatagtgaaactgcgtctctactaaaaatacaaaatgagccgggcctcatggtggatacctgtaatcccagctactcgggaggctgaggcagaagaaccacgtgaacccgggaggcagaggttgcagtgagccgagatcgcaccactgcactccagcctgggcaataagggcaaaactctgtctcaaaaaaaaaaaaaaaaaaaaaaaaaaaaaggagtgtttgagtaagggagtaaggccacccaagatatttaatacaaggcaggttgtaagtttaagtgagtatagttggagtaaaaatagaagaaattatatctgttcttaaattaaactccagggctgtgttttgcgaaccaattaactaaaacttggagtcatcctgttaggctttgctgagcagtggagggacttgtggggaaatgtggttgcaaaggagacaggagggaagctgaggaggctgaggagccacagatgagctagggagatgcttgcagcatagcacgtcttcctgtttggttattggaaaacctgggtcctagttcttgatctactagctctgcagcataggagtcattatctctccggaactcaggttgtaaaataaaaaggtccaaccagatgatatctagggttccattcagatataagcgtgtgctgttttttgaatgttagtgcagccagagggcctgaaaagtgacggggaggcagagagccttatcagatagaacaagcagcatttcagcagggtgcagaaggagctttggtggctgtctctgtatgtgcactgggtggagaaatgagtgtgggcattgtggttgcattaggcccctccccatgttctctgttctacagtgccttgagcacagctttattatcttaaagcatttaccaagttctagtgtctttgggcagcaagtccctcaacagactgtgagctccatgatgggaaagaccaactattgttcactgtgatagttgaaaaaatgaatgcatccaaatgcttttggattccagtttctctagagatgtcttttatgtgtcatttttgtagtttggtctcttctcaatggaataatagatactaaatatcatattaggatgggcaggtgaaagtgagtcagtgcttgcagagatagatgaacattggaagctgttcttgaggttctgttcagaaagcctgctcgctcttagtccctttcctgcttgtgggagagtgggggtaaagcttcccggcaaagtgtgagtggcaggcaagcctagctattcattggctcacagcttcggcatagaccccatgcccattgctggcctatggcaaggcacagcaagcttgacagtgcgtgcacctgaccttgcccataaccattaatcagccatcatgtccacagtcttccccacttctataaactactgggacagtcactggaggaactgtcattttttaactcagcgcaagttttgttcgctttagatttttgggctactcccacaatttagcctattccctctcttttttccccaaattttatttttatcttggtaccaggtcaatgagttgagtggggcctggggaaggatgataaaaaagaccaaagatacacatgcaagatgggggcgtgcttatgaaactgtccactggacacccactatgtgcttaacattatgctctaggcttttttttttttccattataacatcatcatttcccggatgctttcctcatggcctctctatgtaaggtatacttcatacttgctattatagttaaagttgatgacataacatttaagtgtctaggccaggacctggcacaaagtaagaacttagtagacattaattgatgttgttgctactgtgttcacatttgatagtttaagggtcttcatgatattctgcaatgtaaaaggagaaaacaaacttggttagttggagatagtccatcatttgtagagcaggataaatattgctgatcattaaatcatctcagactttaacaggtgaagaatgagtagctgccctggttaaagatcgcatttgcctcaacctaagttggggctcagaaggggaggggaaggtgtctgttccagtctctgatttgtttctaagtgatttttattgccatcacttctaggtgtctaagtgatttttattgccatcaacttctagttctcaggatgcatgacatggtccctcattccagaatccagcctctgagctttactcgccatttaaagaatggtgttgggcctgagtgtttctgtccatggtgctaaacacagaactctgggactcaaaagcagatggtactacatggtcactctcatctccatagcctgcgagatgagactgctgtgaaaagaaggctggtttgggagttaggaggtctagtacagtttcaatcacttgctgtgttgcctcaggcaaaccacctaacctgtctgttgcagtgttcccattggtaaaatcgagttgctgcattctgtcattcatatttcagagtgctgctgatttctgtgtgagtaaatgagataacagatgctaaagtgggatatgaatgcatagtatgattatgctgcaattgcctctcattcttttaatcatacattttgactgtatcgttttaatttacggaggcaccctaaggcctaataacatataatgcagcatgcaggaaatcaaacaaacagataaatgcactggaggaagaaagaaataacttttttaatatgttgtttgcaagtggctgtatggctgtagaacctggggtgtgtttctaagaggaaagataatgaccagtgaggggccagcccttgtctggaaggagagaaaaactcataaaatctcatcaccactccaagccccaaaggggagacccactttactgtcacagtcctgaaatctcaacattagcttgatttccttttttagcttggtattccttgtccttcacagaatagttgcaatctccctttttgagttaatcatgcttgctatggcctgagatttgaaaatggagtctgtgggtttaagttcttcttttcctagttatagaaacttcataaagcaagtgaggctcttatagcctacctttcttcatctgtgaaatgggctcagtagtcataatatctccatatgggatgattgaaaagatacagttgtaaaaatgggccttataaaaatgtaccagtagttgtcattgttattccctgacatgctctgttcaaagtattgcatgagcaggttttgccttttccccatcctgtgcctttgtgtgttctattctttttactgggtgtatcttcttcatctcttcttttaaaaatctcactcctttaaagcacaggtcaaatactaccttctttgacctccccaaccataataattttttcctttctagaactcctagatagtctatcatctttactgttcaacttatgatctccttgcacggtggcatctagtttagtcattttttttactttcctaaatagattataagaccctgaaagacggctacttatctagcacagtgtgtagcacagagcaattgcccaatacctgttttaattggaatgcaggatgaatattacacagcactcatggccttaggcttttgtaaaaatacaagcgttgctggaggaggtgactcaataggtcatgggtacttgcatatgcattaagaacattgggtttgggtagccaaatgaaggtggaaaatctggaaagaacaagttgaataaagaagcaggagctgctaaaacacgtttttttcactgtagcagtttttcctaggctagtcctggtcttggaggtgctgtgaaaccagtgtattgacttggaaagatcccttagatctctgaactgggacaagggttgcaattcacggacaccggatgttgtgcaatattcaggtctgccagaaggtggcgcattatcactaatttcatggtctggcagctttgctcctggggatccccaaagttggtgtgggcattctgatgggtagctctcctccgcattttgtgtggttcagagcttctcccctcttatcccctcccctgcctgcattccactcagcttctttatgatgtataaagatgaaactgaccccagtcttcagcctgaagagtgccttccattgggcttccacatttgggaaggttcccgctgagatgggacagaagtgtctcagcagtctctcagttcctgcgtaagttcagaaccaactcaaatcatgctctctgcagtggaatctccccaccctgggcgcggagagagtgagcactcggtgcctttttggataaaccaggtaaagaagaaaacaaattactttttagtacactcctttattcctcattccctccgcagcctcctatgacttctgatttcttgtctgaacttcaggaacagcacctctctctgtgtcttcctcatctcactcctatatggtgtttcattctctttatggtgttatcacatttatttatttatttttgagatggtgtctcactctgtcacctaggtaggaatatcgtggcgcgatcttggctcaccgtaacctccgcctttcaggctcaagtaattctcatgtctcagcctcctgagtacctgggaccacagtcacaagccaccaggcctagctaattttttgtatttttagtagagatggggtttcaccatgttggccaggctggtcttgaactcctggccccaagtgatccacctgccttggcctcccaaagtgctgggattacaggcatgagccaccgcacccagcctgttatcacatttattatcttacattttcacacaatatctctaaaatgtgccacagatatttttctctattttttattagagcgttcacgtttatatcacgcaccatttaatttgaccctcacagcagctatgagaagttttggggcatgagcattaatatctccattgtacagatgaagacacacacaggaagagtaagtgattttctcagaaagtataagatgttcaagaacctgttcatcttgttgctaatgtactttactcttcttctcactatggatgatgcaaataaggctcaaaaggaagatatgacttatccaacgtcctaaagtcaatgatggtataaatggggctggaattaatatctctcgattctcaattcagtgttctttgtatcccactaaggaatccttctccattctctaacagaccattggctatctgtctacccaactcatttcctatgtcttcaaactcttaagcacacgtcaatcagcatttgacagagggtcccaaaggtgaatgcctgaggcatatggaaagctcatcaggaattattattttaaatttaaaatggataaaacaagcactggcaagaaatccatcaatctgctagcaatgactgtgcaaatgactgggtataggtattagaggtgtaccgcaatatctctaatactgttacccagtcatttgtactgttattgttagcagattgagaaaagtgttttcatttttctgtttctatgttttcaaaattttcttcagtgagatttttaacttttataatggaaaataaacattacaaagtggaaaaaaatgttttgtgccacaggtttgggatgtgtttgtgcagctgtgtgcatgggagtggctgttgccacattgtgttaaatgggatggaggctgggtagggcaggaactgtgctccagtcttctccaaggacaggtcattgtgtcattcactggttcccattcctcccctaaagccctggctgatgattttcgcacgctttacttaataacttcctccctacctggagcccggtggaatccacaaagccataagcacacaccagcctggtaggttggggcaggtgggaaggagctctgggaggctggggcatcagaacttcaccctctctggtcagagctgtgggctcctgagcttctccctctgcctgctgtggacttatgtaacacattcacaggacttcattttccagtagattgaaagcaaagccgctgttgattttctccaaaatgatctatttggaagtgcaattgcctggaattacatggtggcgcgagaggttagaccttgctgtaaataactttcctctcagccacacaggggctcagctggaagcagtgtctgggctttagatgacggtgtttggggtgtgtgtgtgtgtgtgtgagtgtgaatacatgtgtgcatggtcttggggcctttgctcaccttgctaccacttcttctacctttggagctttgcatcagaataaggaatgagggcagagatggggaaggatggggttgtgcttgtggtttcttttatcagctggtttatagggcctgtctctggccacctcttccccttattgctgcagggtccttgagtcatgtgaggttgagtaactcaagcacagagtgtggagtggcacaaagaacaagcttaagaattggacgtttctgagttatagcaccacatgtgcccaattacaacatacgggaccttagacaattgcttacatctatgacctcctgtgtctttatacattaaagcaaacaaacctaaaccaaacaactggtataaggtgtgggagttgagagtacctacatttcagtattgttgcaagagttaaaggaagtaatgctggagaaatcacactgcacagtgtctgacacttggtatgtgttctgtaaatttagttccattctgtgccctgccttgcctttcatgacagattgaaattaaaagcaaaagcaatgggcttggaaccaggatggcctaatccaaagttgtgaaacatgcaaagtctggggtgtttcacttctttctatactcccttcccgtatagatagccatagcatacatacatgattcccccaaagaaagactgtaataaacgaactctcactgcagcagatgggacttaatgctgtctgctcctggtgggcatttgtattttaagagtcctgcgtaggcacgtagaggacaatgtttaacccaaagatggcagcattttatgcaggatggcatttagatggcagagctatttttagattagaaagtcttacatttactctggccattcttcagaccagccttatttgcaggcgttagaatgggattatgtgctagatcaagtggacatttttctcaaaactcacctagtgttgtccttttcacatttccccatgaaatttagaaaataatagaatcttatcaaatatggactacatcctcaggagaagacttccagacagttctggagaaggcatctagccgcccacctacctaacattttttggaatcctacactgtaatataataaatatagctgacatttatgaaatattttgctaaatttttatgtgcataatctgagttaattcttactacttccggtggtactgatattatgatgccattattatagcatattggccaagagcaaagatgctggagccaggttacttggctcaagtctcagctcaccagtcactagtagtgtgccctaaggcaagctgattctctgtggcttgatcttcttatatttaaaggaggaatataatagtactacttcataaggctgtttggggcattaagtgattcaatgtacataaagtgcttagaagaatgtctggctattattatcaccattaaacatctgagaaaattgtggatgaggggaagggaagtgattttcccagtgacacccagatggtgacagatccaggtcaagatttcatgccttaggactcccagcctagtgcttttttcttggtatgaggaatatgtggaggatctttaatttttcccacattattatctctcaaggcagctgtcagtcataagtaacagcatttcagaatggctgaaaatctagatgagaacaattgaaaaggtgagagcttgtttaattaaactagttcctgaaagcatgtaaaaagaagttttttcataaagtggtgccaatttgggtgcccaccccagcttggcagttgcagcttaagcactagttagtgggcttattaatcaatggcatcagagccaacatccaggctacagctagccttctagagaggtggtgctgccaggtgcaatcccaagatgagagtcaacttgtatgataagcataggtcaagctctgagttttcattagaaaaaaaataagtggctacttcataaaatatgttaattaaccattgatggagttgggatagaatgcgaaagttacattttctttagaaagtataaaaaccctttagagtttttatttcctaaagtgacccagaacaagccttcaatagaccaagtccaataatgcctcatgtgtttcagagggagagggtgggccagatgaggagggtggtcaccaggagttctcctttgtcctcctcccatttctcttgacctctcttgtcataatggctacagttccactgttagggatgtattattttgggcattgatagtgtttaaagagaaatttaatttccaacatctccaagagacaacaaaattatatagcatcttatatggaactctcttcctccctgttcagatgcagcagccaactaggaccatgcggccaactaagaactggaaaataaggcaaggtgccttgggaggagaaagggtggatgatatatgccgattgaccattttgctaaagcccaggtctactttatgccattttgctctgcaaagtgctgctggaagaagttctgtttggaattaagttagaacagggagctctgatccaacataagagagcatcccactcaaccaagataattaagagtttgtcctttcttcattcctttttccagcataagaaagagcatcctacttgttttggattgaattttatcctctcaaaagatgttgaaattctaactcccagaacttgtaaatgtgaccttatttgggtctttgtagatgatcgagttaacgtgaggtcattagggtgggccctaatccaatgagtatgttctcataaaaaggggacatttggacacagaaacagacacatatacacagggagaatgccatgtgaacatgaaggcagagatccaagtgatacatctacaagccaaagattgccagcaaatgaccagaaactaaaaaagaggcatgaaacagactctcccttagagtcctcggaaataaccagctctgaaaacacttgatcacagtcttttagtctccagaactgcgagacaatgaatttctgttgtttatatcacctgctttgtcgtactttgttgccctaaaaaactaatacaccactgaaccaagataattaagagcttatgtcctctcctttccttctttcagtaaatattagatgagagtctactgtgtgccaggcacaataccagatcctgagaacaatatcttagataagatctttgcttttaaggagttcatagactatcagggatacggataagtaagcaggccattactggctgtatgataggtatttcatgtcttttttcccctctagaccactagctctcaaccttcaccatactctagcttctcctgataacttaaaaaaaaaaacctatgtccaagccccattcccaggcattttgatttaggtaccctgtggtgggaacaaggctttggtattttatgaatcttcctaagaaatcccaaaaggctgttattgatgaaaaccactgttttcaaatatacccatcatcagggccccagtccacactaataaagttggaatggtaatgatattttttagaaagcttcccaggtgattctaatgtgtagccaggtttgagaactgctgtctctcctgagaggtagggatttggtctgtctcatttaatgctgtggcctctctacagtgtctgtcacagaatagacagtcaataaataattgttgagtcaggatctatgatgagaaaaacataaggtgctatggtgcatagaagatgagtgctcagggcagtcattagagaactgagacctgaaagatgagttgacttatccaggcaaggagggaagagaagagtgtgtctggcagagggaacaggatatgtatagagccaaggagctggctgtaacttggcatagctggagcaaaatctatgggtggtgaggggtaagactggaaagcggagcaaggactgggtcatgaagagccttgcaagccacgaggagtttggattctgccataggcttgtttgtgttgtccaggggcatagccatgaactctcaaggctgatttttgtttccttggccttgatgctcacccaggtcgagagtagtatcttgcactttttctctttgaagacaaaagcccaaggagggtgtggcattttgatgcccagggctgtaggcccatctcataagaggagcattgccgtctttctggagagaccatcaagtgtcgcaactgcactgcaccccctacatgggaccttccatcaccaggacttgggagttagattccccagccctccttctatacttccacatcttgggtggaccctgggggagcttccacatccctctttacacatccttcccattcctttcagtccagttttacctggacacacatgctaaggatggagagggaggagaagactcagtgtgatattccccagatggtccccttagggagagctcctgggcagggcaggttgatctgtgcaggaggaacctaaccctccatcccaggggcttgcgcatatatccgctgggtgcttgcttgtctgagccgtgctgttggcagcagtgcccgatttagtactctgcagacttcattaacagcctgcctgttccactccgagttcttaatgaagatgttaaataaaatgtgatgttagtattgccatttgtacagcacttcatatttaccaagcacctttagaacgtttttattcttttccaagtgatagccccaagaagtcgattagtactgctgccccattctacagagaggcaggcccttgggagttcattgatctgttgaaagccaggtagccagccaccaccccaccttctatcaccagtgggcattactcaccctcttttgcccagaactcaatttgttgagctgctgtagctcctcagggcccaaggacatctcacattcctccctccaaattccagactttgctctctaaatattattcctcttcatcattcttacaatgttgtgttttcagtttgggaaagccttagtcttctcttggtcaatttgaatgaatttgcaagtgaaatatcctgatggacatcaaatgtctccctgaccatctaaacacacagcacgcctcagggcccctgttgtccatcctgcctctttccaaagcctgtcaatggcactgtgtttgtgtctggcacgatctgtcttctgtaaacagtcgcaggacaaacagcactgttgtcttcctaaatatgacagtcgacacccccctacgacagtttttacttgtgaaaccataaatcagaggctccaagtggcagcatctctaaagaactgaaagaggaagtaaaccttgtaaagaaaagtacaaaaagcggctcaggtttgcttctctgagccttgttggagcagttgaataaggcttattaataggtttacttagctctctgtgccttagttttctcatatgttaaatggagctattaatggaaacacaggtatgtaaagggttttctgctttaatgacataagcattttgggagggacttcttgcaacactatttttgacttcacacttttaaaaacctatcactaactttctttttctagcgtactatgctgtcttcatgttgccttctttgcgtgtacttcatttctttttctttcttcatccggctttctcttaccttcttatcatctgtcattgcattcatttattccttcttccactgtcctaaatctcatcaccttcttattctgttccttatcctagcccatgggagggtcccctctgctattactgactggcttatcccacaggattctgccttttctccccctacaggctctgcaggatttctttccctttctctctctctttctctctttctttctttctttctttctttctttctttctttctttctttctttctttctttttctctttctttctttctttctttccttctttcgttcgttcattcctccttccttccttccttcctctctccctcccttcctcccttcccttcccttccttgcttccttccttcttccttctcctccttctcctcttcttctttctcttcctcctcctcatctcccttccctcccccatcccctctcccccgccacctcctctttctcctcccactctgtggtccaggctggagtgcggtggttcaatctcacctcactgcaacctctgtctcctgggttcaagtgatcctcccacattggcctcccaagtagctggaattacaagtgcacaccaccacactcagctaattgttgtatttttagtagagactgggttttgccatgttggccaggctggtctcgaactcctggtgatttgcccaccttggccacccaaagtgctgggattataggcatgagccaccacgcccagccaggattacttcttgatggaggatttgtgatgtggtgtgggagtacagagcgaggatgatggtggaaagatgcaaggccccctcacttcgttattaggtgatagaggagagggtgacagtgagatagtaaatagctgaggggattctgagttctttgactcagggagctaccttctggtccaggatcaggtagtactgagggttacaaaacaggtcaaaatggcctggcaacacattgtagttcttcaatggaaagaacattgcactgagaattaggattgttaagtcagaaactgtgaagggtctgagactgcagcctacttgcaagctaacaagttaatctgccacaggtagatattatatatatgtatatggtgtatacagatatatatgtgtgtatagatatatctgtatatgtgcatacacacgtacccacactgctgtcagggtacataatgagagaagatacaaactctagatcaaacacaaagatcattgattacttatggcaaatacagcaatcaaggtgatctcttgcattagttctctgaatcctgatgcccatgggtgatgtggtaagggccagatggtagttgcacatatagtggagcctgttaagcaggagacaccccccgctccagtttagaaaattctctgaccttatctagggctgctggtgacctgctcatactcttccctgcagagagagaagaccttaactttactctagaatatgagcaaatcttcagagaaaggagggagacctaactatcctggaatgtctctggggaaggagacagtctctatctttgttatactggtcaggaaacaaatctgccttctgacctagagagagacactctatttcatttccaagaatttttactatgcaaccaacccagaaaaaattgtcagtagagccctttgctcagaggactcaaactgtgcagaaatgtgagatattcacagagaattgtcttccaacagggactcttaggtgtgaagtgaggggcttagacaacattagagacttgaaaaatgtggaatgtgtgtaccaccactctccaaatctatgcccaaggcagccatcactaattaattggggttttttggtgcaaaaccctaggcagtctgtactatactgattattacctgagtcccctctagctgtgtgaaatcatattcttcacgtttcctcctgtgttccatcttttctacttttgtgaatctgtgtatctatttatatctttatctgtctctaagttggggaaaaggagaacatctcttctgaggcaattttgtggtttaagattttcgtacaaagcaagttcttaatcctaccaaataacattctcaatttagtctttaatccatgagaactgtagctattaacttagagaggcttcccttgcaaacagggattaatagaagaataggtgcctgttgttatatctccttctcaccattggctatgaaagtattctccaaattcctctagagtgatacattggagccatctaactaaggagaagactttaaaagaaatatggcgcaggtgaacatttgcttggagaggggaatcctacatcagaatagatacagtctgagactccttccaactctgagattcgaccaatgatgccacctgggcacttggaagatgtccctttacctttgagtcaatttggactctactcccagcccaagtaatcttttccttcttgtgttctatacttcaaattctgcgtttattcagtgggtagatgtggacttacatagctaacatactggggtttctactgaagacctggttatattttattgccagccactgaaatgaaaggaatcaagagaataatgggaaaagtatatgaactgtgagtagggcatcaaaagatagaggatgctgattagctaagtgaccttggatgcattacctagcctcctcgtgcctcaggtacctttcttgaaaatgaagaagttaaggcctgcctggctgtctatctcatggagatattggcagagcaaatgaggtcatgttcagtgtatgaggtgcccagaaaagagatgttggttgaatgcaaagctggcttttgctgctctgaatctcatcagcctctcgtcctgctccaacccatggaaggtcttccctctgctgtttctgactgggtcatcccacaggattctgccctttctccccagcccctgtaggactatgtcttataagggcctgatgggggacttgtggtgcagtgtgggacatacaaagtgatggtggaaaaacccagtgtcccctcaattttttattgggtgatggagtgggatgatggtgagattgtgaatagctgagaagatcttgtttttttgactcaggaagtgtaagcatacaaaaaaacaaactcactttctcgtactatatattcacaacacagtacttctgtgacccctggccgtcaaaatgtgtgaggatttcttcccaccaagcaattctccaatagacaccagctgggtggcctctaattaaatcagattctgacactgtctacctggagatagtgtccagtcctacaggttaagggctcagtcccacaagacggtcctccacttcagatgtcagttacaagtagtaggttgccaactgtgcttctgaccaactggctataaatcggggattcccacaatcccctccccagatttgattgatttgctagagaaactcacagaacttaggggaacgctttatttacatctacccatttattataaaggatattacaaagaatacttatcaacagccagatgaaagagatgcagagtgggaggtaggtggggaggggtttggcgcttccatgccctctccagcacaccaccctccaggaacctcgacatgtccagctgtctggaagatctctgaaccctgtcttttggggtttttgtggaggcttcattacataggcataattgattacatcattgccattggggatcaactcaatctttagcccctctctgtttcctgcaggttgggggctggatagagctgaaagttccaaacctctaatcatgccttagtttttctggcccccatctaggagctatggtggagtccccagccactagtcatttcattggcatataaaagacactatggcgattccaaggattttaggagctgtatgccagaaatggcattttgggagggggtataggaaaatgttggggtggagagtgaggagttggcaaagaccaacaaagaccaaatatgtttttcacactgtcacagggggctactttctcgtcaggagcaggtggcactaagagatacagaacagataaaaatgaggctggctatgtacacagatgaagtataatgaaaaaggttcatggattaggtctgagattctatccctgttgggtcaataattagttggtatgtgactaatgtattgggaagatgcccggtggtctatgatattgggattttttttttctttttgattctttgggcctctgaagataattcagcagtttaccagaggagtacccattctgcctgctccttccctctctaacttcctttctccctccctccacaaatatttatttgtaccttgtttgtaactgaagataagcacctctgaaatcaggcctgttggcatatgtctaaatactctttaactgagagacatatattcaaagaaacgtttttatatgtccataaactgacacatagattgtcaaatccctaataacaaggttcaaattagaatcctgacactaatgttttcaaatgttctaatacaggtcaccgtttttcctggtacaactcttgtgagtcttatgtgtgtgcatgtgttcgcatgcaactgtgtgagatgctttgttaattaacattgtgaagctaagtgctcagtgaaaaaagtactagagaattgcatattgtccttacagaattgtttgtaaatacaatcaagtaaaagctgtattgaaagaggtaggccttgttcagagccatgttactaatctcaagtctaggggtttgctctgagtgtcttggtgtcttggtggccacatggatgttcctttactctgcttattttcaacacaagaaaggttcttgcaaagatgccttggatgaaaaattctgctgccatggctggtatgcaactcattttgcatggatgttctctcggttctaacctagtttgtgttcaggtaattctggtaatgggacatttgcctctcccctgggggaccatttttagtgtctgtccatccaaccagttagtcagagaaaagagccctgatgtaagtagagaaagaggtatttgtagaactgtgggaaaaagaaaaacataacacactgacctgttttaagagtgcagggtgggttcaaggcttttttaaatttggtttcccaagatgttggggtcactataagcttcgagaatggctgaggtccaaatcctaaaaattactttcatctcagaaaatttgattagcaatcagaataattgaagtgtacctttccagacactatttcctaaataaaatgtatgcataagtgaagtcagacctgatttaagatgaatctttcttccattgagcaggcagtgctttggggataaagggaactggttcccaactccagctttgcattgaactgctgtgtgatctttaaatttcctcctaacaaaatgaggagagtaatactttccccatgggcttgaatgagagataaatgaggtgaagccccaagcacaatgcctgttgcagtgtgttcagcacatggtcatttgctttccttttctaggaaggaagcccggcttcctggtcttctgctgagcttaccctgggttcccagaggctcctttggatgccttgatccatggatatcttctaagatggtcatgataatgtcagtcttcaaagtagctgctttccctcctctgtactgcagagaccaggcacatacagaggccgaagggtggctctgtctcctagggtggctgtcaccaggtgccacatcattctgtgtttatgggtttgctctgataagcagatgaggggggtgctcatccattttttaaattcaagacattcaagttcaacgtatgagacaccaggagtaattgtactatgaactgacataaactgcaatgaggaaagaccttctctcttcccctgtcttagattgcacgccaggatgtgataattaaagcatctgtctctctccagctccccttatcagacatcttaatttatttacttgttaaaaactaagaggagaattcatgctttgttggttttcctctttattctactttcattgttacatattaagtgatctcttggcaaaacgaatacataacatagctataattaaatataattctatttggtatggtgtttccctttcaaccattggcagttcttctaatgacaatgaccttgtaatttaaaacatatcctaggggcatctgtttttattctggactactctgacacattggttgaggaatgacaataacaatggcaggaattgggtacaagtgcagttttgttacatgtgtatattacatagtagtgaggtctgggcttttagtgtatccatcacctgaacagtgtacactgtgcccagtaggtaatttttatccctcatcccctcccattctcccaccttttggagtctctaatgtctttattctactcggtacacccacgtgtactcattgttaagctcccacttgtaagtgagacatgctgtatttgactttctgtttctgaaatagttcacttaggataaatggtctccagtgccatctatattgctgtaaaagacatgatttcatttttttatgtctgagtaatatttcatagtgtgtgtatacatatatgtatacatggtgtgtgtgtgtatatatgtatgtatatctcaaattttcctgatccagtcaccagttgatggacacttaggttgattctatgactttaactttgctattgtgaatagtggctgcaataaacatatgagtgccagtgtctttttaatataatgatttcttctcctttgggtagatacccagtagtgggactgttgaatcgaatggtaattctatctttagttctttgagaaatctccatactattttccgtagaggttgtattaatttacattcctacagtgtataagcattccctttcctccataccttgttgttttttttgactttttaataataaaatatgtttttctttctttcttccatgatggtgcacacataatagattatcaatttactcttacatattaattatattaaagatacagatgcatactagatgcaacacagaagaaagatgccttgtttctggccatagatatgacagagagatcaataaaggccacagaattctcttcctgtttattcctgtggttgttgttgggattttttttagatatagcaagtactcagcaaatttttgctgaatacatttacttagaacaaagggacactggcctcctccagccagccacatattattttatatatattattatgcaaaacacagttgttcagtattgcccctttgcaagatgctccttgacctttatctaagggaattaactgctattattattactcattcttttttatgctgcctatttatatattttttaaacttgaaaaggcgagttttatttttatttatttaattaattaattttttttttttttgaggcagagtctggctctgttccccaggctggagtgcaatggtatgatctcagctcgctgcagcctctgcctcctgggttcaagcgattctccagcttcagcctcccgagtagctgggcctacaggcacccgccaccatgtccagctaattttttttgtatttttagtagagactgggtttcaccgtgttggccagactggtctcaaactcttgacctcaggtgatccgcctgtctcggccttccaaagtgctgggattataggcgttagccactgcgcctagctgaaaaggagagtttttgatgaagcacaaatgtgactagacagtaagggaggaggctgttgggatgactgagaaaagaaataaagagtgtcttagaatcatataggtgagagaattcagaagtcattactgtatacccattgaagggattagattctctgaaggcttaaactagacagtctgacttaatctctctcttaaaggaaaagagttgtatttttgttcttcatgcttttaaaattatacaagaaaaaataaaagcaaaatttataaaagcaatttgtatacattgtaaaaatattcaaatatttacaaaacagcatgaagagtaaaattatctcctctgagttccattctctaaggataaaactgtaaaatgcttcaattcttggctcttctgtttactaccaggattctaacatactttcttgttttataaaatttagacagtagattctgactttttgctatgagagtttagggccatatacgtaaatgctatcttccactcatcattcctcctccgaattctcagtcgtattcttacttatccattatcaaggtatattaacattcacattctgttccctaaatgtaattagattttcacatgctttatagttgattctaaagagtttgtttggatagaatgcctactattcattttttcattcatttgtttatttcattcaacccacactgagagactattttgtgccaggtatgagcctatgtgcaaagtatgtgcaagtgttcacagaattgtgtgtaagacaattgaatgagttttgggcaggagaagatactagatgcatatctcaattctatttctaaagatgtattaaaagaaaatttagatgaaaagggttacggagaaggacactatcatacttttagagaaaaagcaccctggaaattgtttagatacctaaatattgtcaagtattaaataaattatggaaaccagatggattggaatcagagccattaaaaattaaaattttgagaactattaaatgatgtgataaaatgtcataatctagcaatttaataaaataagaaactggatatgaaactagatctataatattatcccagttctgtaaaattttaaaaagatgatatgggaaagaaatatcacaagtgatgacagagatttaaggttttttgtttgtttgtttgtttgttttttgtttttgttttgagacagaatcttgctctgtcgccaggctggagtgcagtggcgcgatctcggctcgctgcaacctctgcctcccaggttcaaacagttctcctgcctcactctcccgagtagctgggacaggcatgcaccaccatgcccggctaatttttgtatttttagtagagatggggtttcaccgtgttggccaagatggtctcaatctcttgacctcgtgatctgcccgcctcggcttcccaaagtgctgggattacaggcgtgagccaccgcgcccggcctaaggtatttttttaaatttttatttatttattttttgagatggagtcttgctctgtgacccagactggagtgcagtgacgcgatctcggctcactgcaaactccacctcttgggttcatgccgttctcctgcctcagcctcccgagtagctgggactacagatgtccaccaccacgcccggctaattttttttgtatttttagtagagacggggtttctccgtgttagccaggttggtctagatctcctgacctcgtgatctgcccacctcagcctcccaaagtgctgggaaggtttcttcctttatactcactttcaatgaggaagtgttatcctaactacaaaacaaacagacaaacaacaacaacaacaaacctattgtcttcaaaaaaataaaaagtaacaatagaatcattgccttcaaggacaagattctcaatctggtgaaagagacattttaagaagttctcataatgtaaaatggaataaaatcagtgtctgagtgtctgtacaaagggataaggatggagttttgataggggtctgggcatcagaaaggacataacaggttgcatcatgaagactgagtagtatttctatggacagaggagaacattcctaggcgtgaagggatggaaatgaatgttgagaagtgagctatctgaaattgctggactagagtgtgggctaaaagatgtagaaaagaaagtggtttaatggcttgtggagaaccttggatgctttgctgaagaattagaatttaattgaaaggccatagggagctatggagaaatttttaaagagaggggtggacttgacctgtattttcagatgcaaagtaaagagagcaacctttggcaccagacagacctggagtcaaaatcccagctctgccagttccttaggataggttcttagacaaatgagttaactcttctctatttccttatccattaattgggggcagtgatttcaactttacggtgtgaacatgaggatagaacaacttaatacagagtttcaatatcatgaatgatgaataggtcttttttaaaggtaagaaataatacctggtgatgaaataatctgtacaacaatcccccatgacacaagtttacctgtgtaacaaacctgcacatgtacccctgcacttaaaagttaaaaaaaagaaaatatttggatccacctatgacctataagctctctctttgagttgttctgcctttccagactgaagtaatgtatgtctcacatgtattgattgatgtcttctgtctccctaaaatgtataaaaccatgttgtaccctgaacacctgggtcacatgttctcaggacctctcacgactgtgcctcatgccatggtcactcacatttggctcagaataaatatctttaattaaaaaagaaatatttgcaggatctcaccccctagtctgtgttaaattgtttctattataatgttaaatatttacaactatatttgttataaatttctcaagtttcgtgctctgctacaggtataaaaccaaaacgagtttaaacattataaacaacacaagcacaataaaattaaatgaagcagtattaatttaatagacccatttgtaatcaatatgaaaataaatctttgtggacgatgtgaatatagtactaactgctacagcccaggttattaaagtttggcctttcccatactctgtgtgttatgttgactcagtctttccccacttttctctactccaacttattgtttatgcagtgaacagtggtattatttaaactttgcttagcatgaacacatcttctatgtatcaggtccacctctcttcctcactggcccatcactattaacatctcaccactgtagacatgcatgcaagtgcaagcattgaaactgcatagcaggactcaattatgtagtggttatctagatgattttaaaaatgttatcagtatgaaaatttagatcacacagacatacccacacagacacacatacacacacaccacacaccacagccctcttatggttctacacctcctatttgtaaatacatatatcctagaagtcttattattattgttttgttgttgttgttgttgttttgagatggaggctcgttctgtcgcacaggctggagcgcagtggcacgatcttggctcactgcaacctccgcctcccaggttcaagcaattctcctgcctcagcctcctgagtagctgcgattacaggggcccgccaccatgcctggctaatttttgtatttttagtagaggtgggatttcaccaagttgggtcttattattattgttaatggcagctttattattgttagtgatcttggttaggtagatgtatcagttggctattgctgtgtcataaagcaccccaaaattccgtagtttaaatcaaccagccatttattatttctcatgagtattaggttggctgtacacacctgctgatatggtttgggggcataatggggctgtctctcatctttggtcagttgcacgtgggcttgttggctttgctgatgtggctgagcttcctcacatctttgaagccttgtctgagatggtttggctttgctccatgtgttttcttcacctccagcaagttagcagaggcttgtttttagggtagtctggacacattcttatgctgatcacagagaagcagggaaagaaatggataagtgcaaggtctctttaggcctcatgttagagctggcagactaccacttctgtggcattctattgattgaaacaagtcacaaggccaatccagattcatcagctggagacatagactctatagtctatttctagatgagagaagctacaaactcaaaattcaaagaatatggttatacgtatgtgtgaagaattggaggcacttttgcaatcaatccagtagagcagttaagaacattgaaatctattaggaagtgacatagatcttcttggtgagagggatcctgccttaggaaagaatgaatgtgtgaggtgctctgccagtctttggtgtgggagtgagggagagggaagagtcaaagatggctttgaggaacctgggcttgggtgactgagaagatggtaaagctactgagatgagatggtcagcaggaaaagtaggtttatattagggggcctggggcatgggagaggtcaaagatggagggagaaaataagtttagagtttagcaaagtgggactcttcccacaaggagaaaccttctccacctagttacacaataaaatcgcctaaagagcttttaaaattgataattgagtctcatccaaggccaattaagcttaaatttctgggtagaaggcctggtattttttttaatattcacaggaaatctaatgtatggcaaaataggaatcattatctaaatcagtgttcttcttgtgcccatacgttagaatcacctggaagccttatgaaaaatactgatgcctgggcctcactaccaaagaatctatttagtgagtctgggatagggccttggcatctgtattaaaataaagtctgtctggatatatgtgatgtaatgtaatgcagccagagttgagaaccactgacctagatagttaattttcactgtgaataatcaatgttttcagggttgcaagccatggcaaaggggcactatgacaaagtctctttaagttcttggcaggtccagaattagcatgaaattgctgggtgccaactggggcatggggacaggagcagtcagaaggtgaattctatacacttcgaagacccaacctggatcaacacctggtgtttgaagcacaagggcttgttagtgctaatcctgcatcaagtagagatggtgggaaatcgccctgaaaagctctatagtgtataaaatgtcatgatgctattgaaacccctgttgtcccattcaaaccgagctttctttacagtagcacctgaaaaatacaacttccaccatttcctttgagaaggtaaattcagtctgagatctcagtatttgttttccttgattggaaagctaaaactgcctcttccttgattttgtcccgttagtctgagctttgaccttgttacatgttagataattccttgatatgcttgttgttaatgccttataaatatttgcagaccaattatctgtctataggcagccactgagtcaacaacagaatatctgggtttttttccatgttcataaatcattcttggcagaccttaatcatttgggtttttggctggcctctctgactttcttctagtttatttttatcctccataagcctcatctattttggagaaatatttaattgcataagagagaagttgactcctgttaggtatgacactgacaatcttccctgggttcagggtttcttcagagtggcatgagaatccctttggggatgggagaaggcttgtgaaaaggacatatttatgagtcccaccccagttctctgaggatgggactcaggcatctggaattttcacttctttaaagggtaggtgattcttatataaacagttttagagctattaccaaagttattgcttcaaatattatacttagaggagaagttggggcaatttcttttctcggtgggagaggctttgctccataatcctcgtcagtaatcaagagatacacctttccttaaagagtttccaaaaatgttctgcatgaggaatcaccatttcatgtcagtcttgtatatcagtggggctggttggttaatacatatggattgtattgtgttcatctgacattaagatataagctgaggcaaagtgaagagaggaggaagaatgaatacaatagataaatagtaagatagaaaagagaagagaaatggagatggggaggaaataaagaagagatatttgtgtaaatatggtttcatctatgacaatgtttagtatcacgcttttttacattttgaagcactttacagtataaaaaatccttttatatgcgatcctcacaactgtcctggggtactggaccaggtaagtgttaacatacccatttcacagatggaaaaattgagacttctgacagcaaccttccgaaggtcagatagctagtgtcaaaaccaaccctggaactcaggacttagttctaaagcaggaattttctgccaatcctaatctatactcagcctgggtaacctagacttgttcttgcttgtgtaatgacaaggccttcattctgaatgagtgctctgatgtgatttgatgtagagtggttctttggggagggacatggcactggcacactgaacagagtggacttggtatcctgaggaggtccttggaaattctcataaaaatcaacaagcttattgaaagagctcatgttacatcttataaacaaaataaaactggtacatgattcgtgagtgtcttcattcttctctttcttccctttcttctcttcaacacactcaacacacacacacacacacacacacacacacacacacacacacccccaagaaattcacctctggctctggaatctggagaaagttcaaagtcatgcagcaatgaccgtcagcatgattaggcctactggaatcaacaagataaattcagggcctgatcaccatcagacattttcttggtctaacctattgtggccaaaggaagggaagtctcactcaggtctgctccctctccttcatttacttactgagcaggctttttttgctttagggcatggttggtactgaccctcctgggactataataaaaactaacctgggtaccagggttgaatgttgatgagtttttttaccctcgttatttctcttgatcattacaacagcctggtgatataggtaatggtaatatccaggcataattacgataccattggtctaggcatacttgtataattctgtagatcagctacccccctagaaagtactaaggtaaatttatgcacagagagggtgaaacaatgcaaagggacactctattgctagttggggcttaggcccctcaaatactgaacaggattttggtgaactgggctgcaccacaaagagaagctgggtggacttgaaccaacctaaaagaaaagtcaaacctacctttctgattttggttaggaagggaaaccaaactctgcatccctgctgagaatccccgaaaaagaaagtggctgtaaaagatggaacctaagcctttccaagccagaattctgtgctttgtaggaaaagacaggcatcagaagagaaagcctcaaagagctttgaagagcaagatagcaagatctaggacacagcttactgtttgaggcctaagttcccctcagtgttggaaactcccactattatggccagatgaagtagttttgcctctttcttggtcactgtctttgggatgtggaggtggtgtgggggctggagggaaaatgtgatatcctggggatatgttttactgtgaggaacttaaggatcggggaagttaagtcacttactcaaccaaggtcatttgtttagtgtgtggggaagctcagatttgaactcttgaatcttggcaacaacatttagtaattttcccattttgctacctatcctctctaccaaacaccattttgttcttatgtggaaaattggttctaccctcctgggcttcctctggcaggagcagtgtcattaaaacattgaagagaacccaaagaatatatttttctccacttaatgcttgctcagggaagacatccacatccatgggagttgtctggctcacagtttaggaagtgtcatgcacatggaggtagtctgctagatgaggcttagatcacatgtctatttcatctcactgttcctccttaaaagttcagatgatacaaatggccacactgtcctctaaaagaagcgttggagtttattttgggaaaggggcctattttaagataaaggacaggggctccctattctgccactgtgctggcttgtctccactccacactcagcaaaaatggaatattctctaaacaataggtgactcagcctttgcaaagtctcaggtgaaatggatttagccagcaaagagagaaaatgtctttttttttttttttcatttttccctggtcctgtttgatgataattctcagtgctcagtgctcctttcatccaaagatctgtaattaattaagcctcacaactcccctggcaagtagagagaggtacaaggatgttcatttaaaaccaatcctgtttgatacagtaggactgttaccaaggctctttaaaagaaaaacctttctggccgggcgtggtggctcaagcctgtaatcccagcactttgggaggccgaggtgggtggatcatgaggtcaggagatcaagaccatcctggctaacatggtgaaacctcgtctctactaaaaatacaaaaaattagctgggcgtggtggcgggctcctgtagtcccagctactcgggaggctgaggcaggagaatggcgtgaacctgggaggtggagcttgcagtgagccaagatcacaccactgcactccagcctgggcaacagagcgagactctgtctcaaaaaaaaaaaaaaaaatgaaaaacctttcttttgtgaaacttctttttaatggactaaattaaaaaagaaagggaagaagtaactttatctgggatacctgctgagttatggccacagacagagtcctaagttaggagctctgatgtcattcttggattaaactaggtgtataagctactgctatgtagcaaatcaccatgaaacttagtggctttagacaataataaacatttattgttaatacagttactgtgaatcaggaattcaggagtggcttatctgggtggttctgccttgagatcatagtaaagatgatagcaagggctgcagtcatctgaaggcttgactggggccggaggatccacttctaagatggctcactcaaatggatggtgagttggtgctggctgttggtagaagactaattctgcatgtggacttctgcaaagggctgcttgaatgtcctaattatgaggcagatgctcccctattacaagggacccaaaagagcaaacgtgtaagtgtcagtgtcttttgttacctaccctgggatgtcacactgtcatttcctcaatgtcctgttgactacacaggttagctctcaacattatgggaggggcctacaacaagggcatgaatatcaggaagaagactcactggaggcctgcttggagcctggctactgtatgaagacatattaaacgtatgtccatctgtaatattagtggtcctctgaaaaaccagcttagaggactaattatcattcatctgataagaagagagagtaagagatagggaatggtgtaattaactttctggttatttgtagttttagaaaaaagagccaccattcttcatggttaagtgattaagcctatattggagtgtacataacaaggggtgatgctcccatttttaggagctggatagctgtcccagaccttatagcagatcactggctcctcattgttggtccatggaccaatgttatattaactgctaaaaggcatccctgaggcatttattaaaaatgtggataccagctttctactcttagggattctaagtctgtgcatttggaacccactgtgctggctcaacttatcaagttatgtggggtgagaattatgacttatggcagttatagtcatttgcttagcatctctccatgatctttttcttggtctcagaacaccaactaaaaataagttcctggttgctaagggcatgaatatcaggaaggaattgatagttgccaatgttgtttgcataccatattagttcaagaaagtgcagagagtagaaagttccctaccataagggctactagaaaggcagagaggggatagggttgctgaccaatagcaacagtttggaagattatcattatactgcatcaatatatgcaaggaactggtctaataccaggtacagaagtacttttgcatcctgcatacattttagtccagtggttctcaaatattagtatccagaagaatcacctggagagtgtttaaaagtacagatctttaggtctgcctctgggattctgattcagtgggtctagtgtaccccaggtggttttgatgtaagtgatctgggaccacactttgatatacactgttgtaggtacagcctaacttaattgcaaggtattgacttcatatctatttaatctccagtagcaagagtttaaccgatagagtgggtgacatataaggggtacatgaatgacagttgctaggtgaactgatgacatgcatgaggggtacagggagactggacaggtgtgaaaaagcattttattagcattatctttgtggatattcccctttcagatgataagctcttagaggtaggacctatatgctatttaattttgcaactcccgcagaggttagcatggtaagctgcttgcatcaggcttacaatagatgtgttaacacataggggcaagttcatctgaagtggccaggaattctgcctggttgggaattgattcatggtacccagagcatgttgcatgttgtgctgactgctttatgactttcgaagttgagtgactctaggttattgccaagctctcctctcacctcttccctctttctttcaagtatctcaggtggtattgatagtaaaacagtcttggcattaatgagtgtctgactggagagtgaaatgtaaataagagttgaatagagcacagccaaagcctacaaattaccgctgacaaataacagggcagacaaagagtatttcagccttaccaaacacctctgctacaatcagctaagaacacctgggaatgtcagggtggcagacacagagccaacaacatgatcaagaagaggacatttgatggcaaagagcaaagcagcaagttgcttgtgcattgcttagagaagaagaggaagaagaatgatagaactactggcttcactcaagaataatttattgaacttctactatgtgccagtacttattataggtactagagataataaggtataccaagtagacataaagcttatattttagcaaaagatatagataatggataagcaaatacttagtacatagtacaatgtcacatggtgattagtgtcagtaagaagaataaagcaagggaggggaatacacagtaaaaataaagtaaatataattcccaatgacattgctatatataataatttgacaaatccattaaactaatacttactgagtgcttactatgtgtcacacagtattgggcaatggagatacagtgataagacaagttttgtaatttcacagtgcctaatttttttaggccaggaaaaagactataaacaaagaaagacacataagaaacatatgagatagtgatttgtgctatctagagaattaaggagaactggtagagtgactgggaaggctgctttagtttggttgagggaattcctctccaaggaggtgatattaaattgaaatctgaatgacaaagaggagccagctatgcagaaagcatcacaggccaagtggggagggcacacgggtgaaggccctggacccagcagatctaggaatagaaaggccagtaaagctttataaaccatgaggggctggggtctggttagaataattaagaagagaaataattttttgtttttcatatatatgacctggggaacaaatataaatcctacaaaactatctttctttccatttaaatattgtctagttctttcatcagagacaggtgtaatatttaagtcaattgatttataatatgaatttcttcctgtaattagttctcttttccccagcacccctgagataattcaaaatgcagggcaagtgttattataataaaattttatgttagtataattaacaaaaataccatatagcaatatgccagtcattaagcgtgttgattcatgtagtaactgggaattcttagttaatatttgtctgcagatccatttatcttccataacaccttagatgaaatgtttctttttgggctcgtattcaagatcttggggtgatctttttctgtgtctagtttccatgcaatctgagctctgcagcagccagtggaaatgcccttagttgtcttcagtttctctttatgggtgctgcaatctctttaacccctgtccatacaggaactttgtacactctgctgtattctccatctagggttcacatatcacccaaattctcttctatgtctctgggaagggaagcaattctttttgcaggtcttcactattgtctttttcttttttccattgctttttctgtgctgtctggagaatcactttccataccattgggtcttcttttccccagttaatataccagagcctttctgctcattcattctctacatttcatgcctctctgaagtattaatacctttctctttacactggttacagatgtatatgcaaagatcaagtggatagattgtgtttgctgagaaactttagtgttgaaaatgcaatgcaaatctttaatgtaagtttactgtatatttgagtgtattgtatatttattctccaatataaatttagcaactttcacattatgaatcactaagccttatgtttctccaaagaagggagcatgacttctcaaaatacaatattgttttagaatgaaaatttgtttcatgaccaatgcaaatcagttctgaaattccaaactccctcagccttgaataactttaaaatgcaaatgctacccataaggaacaaatgtcttttcaattattaaaattgaatttcaagatttggtttcttatgataaaaatgtttgaatatatctgaaaaatctttcttaaatcctactattaattaaaaaggataaaagcagaaagttgcaggcaataacaagaacaaagattgagttacaaaaactagaatgtgtttaattttcatagaagttctaaggcattacattagcaccattagggtagggaaacaggcttatgtctctctctgtctcacacacacacacgcacacacatacacaggctaacgggaaaggacagactcatgtacacacacatacacgcacacatagttgagccaatatgctttatgatctgtgaaaattaggctcaacatagtgaccgaattgagagacaggatgttgatcatagttttgctttctaacttgaagaatatagctgagaagccagggtttaatggttttgatattctggaaaataggtatcatgatagtcaaacgtttctgctctgttgggatacaacagaagtatgatgtctgtccttaggaagtttactagtgatttggggggaaaatggctttatattatacaactcaaacagtatgagccagtatacgcttaagcactagatactgcagtgcacagagacaagtagttatgagaatcaagagaaaggaacattattaatactgtgtggggccaacatggaatgcttcatggaggagaagaagtttaacttaatttggaggaaaatacagaatttagcatcattttctctttaatgatagcaagtcatttttattaataatattgattatctctctgttgactcacagattagaggatggaaaagcatgacaaacccacagggtaactatgttttaaaggtttttaaaaaagaagtcagaaaaaaaagagaaagcctttctaagagcctagtcttggggaaaatgtaggagatgcagaagagaattaatggctaatgcttatcattttgtacaaaataaccttgacacaaatggggcaatttaaagaagggtaagtgactcccagcccactcaccaaggttgatggtggaaataatcatggggttgagggcagactggaaaaagaagaccgagggtaggtagctttctcttctacattatgtgtgtttctgatctagaggtaggaagctcatagctgaaggagcattttagaaactcagcctcttccactttccaatcactttaggtacttaacttgatctagctgcaagttagatgtgtctcttttttttccatcctccttcaagctctatgcagagatgtgttagttgtcatatcaccaacgtccaagaagttatagtgaacaaaacacagttagagaactaggataattgtaaatattttttatagcaaaccaatgtgctacaatatgtaagttagggtgtgactatccctgtgcttcataagtgagaaaattattattgctctaagtcagttttccatcttggctacacattagaatcacctggcgaactttaaaaattaccaatgcccaggaccttcccccacctgctctcccaagaggcatagtgagtctgagaagtggcctgggcattggggtttctaaagctccccaggttattctaatgttctgcaaagttgagaaccactcctctaactgctgatataaacaaagtgcagctggagagtttgttaaaccacagactgttgaattccatcggcagagtttctgattcattagatctgggatgggaaccaagaatttgtatttctaacacatccttgggtgatgctgatactgctggttctggggaccacagtttaagaaacgttgatttaaactattgaggtcaagacaattcaggttgtacaaagtcagcatttcgtaaggtttgtccccagaacatacttattaaaatgcagattctgggcacctccctaaactcactgaattagaatgtccaggaatttgcaattttaaatgagctcttccagtttttcttttggacgctagtgaactatggtggaggttaatagttttatttcttatcttgctccaaatattattttatataagttgaatgtgtgaccctatgaaggtttttgtaattattttatgctatattttgtgtgtgtgtggaagaaaacctctatagattggattgcattaggtaccctgaggaatatcagtagtcaaatttggggaaataaggctgggcatggtggttcacgcctgtaatcccagcactttgggagagcagggagggcaaattacctgaggtcaggagtttaagaccagcctggccaacatggtgaatctctactaaaaaatacaaaaattagccaggcatgatggcagatgcctataatcccagctgctcaggaggctgaggcaggaagaattgcttgaacctgggaggcggaggttgcagtgagcagagatcacgccatggcactccagcctggatgatagagtgagaccctcaaagaaacaaacaaacaaaaaacccaaaaaagaaatttggagaaataagcttcgtcatggggcttatattataacaacagactcacctgtttatatagtggctgcaattctcattgcatctgagatgttcaagaggtaactttcaaaaccacacttggcacattcaacataattaggtaattgcacacagcacaggttgtataaaggttagaggagcatctttcaaattttagaggatattaaaattaccaggggtatttgttaaaagttagattcccaagtcagagctccagagagtcccagctctgggtggcatccaggaatctttatttaacaaaagtagattcttatacaatgggtccaggaatctcattttaagaaatagtggattggagaatatgaagtataaaaattgttttcacagttgacctgagttgctaataaacaatttgctatatatttactatttttttcacattttgtaagtcagtgtcctaatagctaggtataagtgtaggctaaaatggcaatgttcaggatacatcctttaagggtgtaatattattacatacatctgtctcctttctcatttacatattgtgcagctttttttgtccctttctatactattcccccttttattaaaaaatggagcagacacatgattaaaatgaggaccaggtcaagtttgcatttagctaagtattcttcccctttatttccctgtcttggccagcttactgtcattcctctttttccctttgttcttttgtctgtcttttcccctaccagtccatgttccatctttcctctacgttgtctctcctttgtgacctctttctgtggccatttcagtgggcatgaagggaaggggtggtcactgtaaaccttgccaatccatatttctctctccacagccaggtggtggtgtagaaagttagtaaagaataaaaacctacacaagtcttctattatattctggtgtgcaagtgtggggttaatagaactgaataaaatgatttttaactaaaactcagagtccacaggtaagagggagagaggtctggacaaaaattgtacaaaattttgttggtgaatgatagtctctgtaggggaacgctgtgcaaaatgagtcttaactgatttagaatatagctggacattcttatcaagttaactgtccactgttttgaatcacaggggctaggataggattatttctttttctttcatgtttcggatttccttctacctgcgaaaatattagctttcactcaagaatcctctcccaggcagaaagaaggaaagaaagtcttgctagaggagaaatcttattaaggctcatggtgattcaggagtgacagccggggctttttcaatggacttatctgctgtcacagagacccactatcctggaagagcccaggcaaagtctgagggttttgaccatcaaaatgaatgactgcaatatgttttgaattgcacagacaggaggagaagtgataggtattctttatggaaaatcacaaagagaaagagctagcaatcttcaagcctttttatcttcataccaaaaacaatatgaatactttctatggagaaaaattgtggcagcaacctgagctgaacataactacaaacagaaaggatatcccctcctacagccctcagagtcatctggcattttgcttatcctgcccctgaactcaagactcttttatattatagagttcttttaggaaatatttatttcttgaacttccccttattttttagggtatctccccatctttttgccccaagagcctgaatcacttgagcaagatataatatccatgtagataagatgataaagggattccttatatcaaggagtcaactaaaagttaatccctgtgaaacacagaaacccaccacaaatggtaaaatcccaagaaaaagttttgagttttgaccaaagagctaatttcatttcccacaagtgcaaaactttggatgtatttatatcagctgactactatatcttttctcaaactccaaagcccacatagctgatatactcttgtcaactgatattgtttccatgttacagatcaggaaacggaggctattcaaagttactgtatatgcgttgtctaagtgctatttgtatacttgtttatcactcctttgatctgccccattgaggtagacaatgattcttgctacttcttggctctcctatatacccagggctatcctgtctcataatagaagcttgataaatattgtcaaactagatcatatgctttgtttgagtcctcaaggggagacaatgaaatagctggggctagaccctcctctctctctcagacatcttgaaatgcagtcaggacgtagcggtgctgagcccattataagacctcaataaatacctgtcaatggcttgactgaaggactgattcaagactatcatattctttagtacttgtctcatgtacttcaacaaggactttagactaaactgatttgattggttatatttttagacttgttacttctgttttgacagaaagaatagacaatacgactacaagcatagtgaccttctggatttgttcctgtggataatcttaagataatttgaaggaagtttcttaactttttaaaggcacaggtgtcagaagtgacaggcttgataattagtcagcattaccccctcactccttttaatgttgtttctcacgctttgcattggttactagtcaatctgggttgcagttctgatttagatgtcaccgtactctgctttaaaggttattttggatctttgcctgtctttgatgtgttctagtacccatcttcctgtctccatccccagcatctgagaacacttctcatttccccactagattgtttttttaaatttttgagcatgctctgttttattttctgattatgaagggcatttctagtagtcctgggaagagtgagctcacaaaaagacagctagagaactagtgatcatgactattatcacatcaagactttggcttaagcaaaacagaacaacaaaaccccaaaaaaccccacaaaactgggaagtgcttagagccccttctacgtgactctgtctgcatctgcagtaggaaagtttacatttactgttaatctgctgttcaactttttgggaatgaattagcaactcttaaatttctctccatttcctatttctagtaattagctcagtgtcacagctaaggttttcttactgacttcagcatggagacttagcagttacggaaaggagaggctagagctttccaccaactgcatgtcactggtgactccaagagagaatccaacaaatcaactactaataatccttactatttaaaccgtgttcactattatccaataacttggctctcagttatatcttcttaagaattctaataaggcatttagtttatacaaaggaggagtctgatctatgcagtggacatgagagacaaccaaagttttgttcctctttccaatggcatagagaaaaaaataaaatttaggcagaattagaattcagaatgcctgggagttcctccagccttgggaaattccaggtgagaggggaggactctggagctttttaaaaagaccctagagttcattttacccaacaattttatttcataaatgagaaaactgaggcctagagaagtatggcttaccaaggttacaaactaaattatggcagttttagctcatggcttatgttagctagactgctggttcgatttttcagtggaagcctccttttgaagaagggcaagccattcatttttcagcataaaccaagggatgctcttacacacacacacacacacacacacacacacacacacacacacacacagagagagagagagagagagagcaaaaaaagaatagccatcataaagatacatttctgttctggattcaagaggcagaattattaatacaggtagactgccaggaatgcagaatgttaatgcagctgcggaataatacactagtgccacagagtttaataatagataatgacaaataatacagttggggaattgtgtaattcaataacagagtaaatgacaaggaaacacacacaccaatgaatggttctagtggggacgcttaggtgttttcaatttaacttacctctccagccctttggcctactacccttttgagaggcaggcaggacatgcagagatgtgcccagctggggtttttagtttgtgcagtgaagttgcaggtttcaggggctgagtcaggaagtatgaattgtgctcctgggcagttatcagctgatccctttaatgcatgtattactttcctccatgtcatgactggatagtttctttttttctgggggagagggggcctagaattgtcccaggttggccattctctcctattacccactctgtaaatcactgcatatgagggagtggtactggaacatggagcttgaagatgggaagagactgggagttggggtttgggtttagggtcataatgggaggtaaaaggtttagccacagctatggtttagtaagcataccagtgatctggtgtgtacttccctgtcctcagctgcattagagaaaggcagccgctgatcactgttagacctgtattctttctctaagagaatgggatatttccctctcattcttttaaaataagataaaaagcaaggggtggggaaattaattaatgtcagtaaatgaagcatgagacacttgtccggatatgataatgactgtgaattagtgcagaataaataaaatggtataaaaaatgaaccttgccagcacactcctttgggatgggctcagtcacccttataatgcattaactcttcccttgcctcatccttggtcctgtctatgttactgtgtcaaagctcccccactgcagagtctcaaggctacagtattatagcctgaggtgcccaaagggagccctggctccaggagagattgagccagctggtgactgcatactttataatgtaaatagaataacttcacatctatttattaataaaaccacactaaaaagaagcaattgtgtgtcccccggttgggagattcaagaaggcagacagaaagccactggaggaagaaaaagggataagttcctcaaaataagttgctccctttcccccagagccaaagtttacctttgtgctgctggtaagttatctacctcccctctctacttttctgtaagggccccaggctgtatgtcttttatatcgtcttcagatgactacaataaacacacactaattgggcacttcctgtgtccaagcactgtagaataaacagagagaaataaagcaatctccattttcaagttttctcctttaagggtgtggagtagtgcttgacatgtagtaaatgctcaacaaattgttgctattacatcagcattgtttcactgaatttaatccctatgaaattttcactgaagacaagtttgagagattcagagagcccttggccactttattttctttacttttgtttctttgctttccttttctccttcattttcttatctcttctatgtttcaaagttcttagattattggcaaagcaaatgcaaagaacatggttataataacctttgaatgttaacacttaagaaattatttgctattaacagaaactcaatgcagtgtagtcaccaaatatgaatcactgaattcagaaatgttattaattcacactacagtatgggcaggtagacaagtgtcggaatactagtttagagttgtttgatgacagcttatatctttttgtattctcatcagtggtgactatatttgcagagtgatttggaaataataacaaaagattgaatttgtaatgtttggtattttcttaaaatactctggaaccacaacaaagagagggctggatgaaaccatgtggacaattattgttgaagctgagcaataggcttatggtggtacttactatttttgtgagtgtttaaatactgctataataaggaaggctaaagtgttgagggatcctttgggaatgtaagcctggatgaatgacctcctggggcctacctttttcctgcccctccaagtccaagttgggaggtagatggtgaatgttttacattcctggtgtgactcaacataaccttttaaggacagtgttaacatgagatgcctcctgttcctttgggaggtctgtaatttttctcagaaggctaacttatagtccaggtatgtgtgcactctgcccattcagtctttgcctttggtttttctttgatctggaggatcataggaggcaagtgtggaaatacttcttcctggagacaatggcagaggagagtccgtgtatagaaattgatttgttaacccttgcgatggcctccctctcccaccctgggatggtggaagagatgccactgagagcctgggcttgtctggtgaaagagtgggcttaaggaaaaagcaacaacaggatcacaaatgagaccctaaatctggttttttccttgtcctcagtagcttattagagataactacatcacataagctctgtccatgactgtgaacttttatggttttgtctattagagggtgatgtcagaggctgttatcactggcattaatgatttatttgggcacaggtagacttataaaagtaggtgggggtattgattatagtcatgggccaatgagattctgtttcatttcctaaccaccaaacagatgtaaaggacttctgtgtgcagacctcaagattacacagcaaaggggcttccaaaggaatttacaatttgaatgagacctataagaatcaagaggtgcccaagagcagacgtaggcctgtatgtccccatatggttgagttttgataatccttcatttccagtcactgctatggtctggctgaccttctgaatgtacccagtattggctggctttagatctatgatatgagctatttttttactcattaaagtgtttaaatttctgtgcttagtttctcagatgacttttttttctgtgtggaatctggttgatatttttggagaataatttaaatcagttctaattccaccctgaagagctccttttgacacacaagtggctttgtgtcattgcaactctggaggaggccagggcaggcttcctgggtgctcagaacactggctgcccttggaattatggctttatctctgggggatagtacttcaagaaaaaatgccaaggaaatgtttgtcttagtgtatttttgtccattttgcctcaaaaaagatttgtcctgcccaggagcagtggctcacacctgtaatcccaacactttgggaagccaaggcaagtggatcacttgaggtcaggagttcaagaccagcctggccaacatggtgaaaccccgtctctactaaaaatacaaaattagccaggtgtggtggcatgcatctctagtcccagctactcaggaggctaaggcataagaatcgcttgaacccaggaggcagaggttgcagtgagctgagatcatgccaccacactccagcctgggccacaagagtgaaactccatctcataaataaataaataaataaataaataaataaataaataaataaataaagatagatttgtcctgaaacttaaagaataaagactcggtagacatggaatatattttttttcaaatttcaaaatgcaaaagagaatacaggtaaatacttgtatttacttcataaatgccctatttttcacagggtgtatcagtgtgctttgggctgccatagtaaaatagcacaggctggaggacttgaacaacagaaattcattttctcacagttctggaggctgtaagtctaagaccaaggtgccagcaggtttggtttctccaaaggccattctctttggcttacagatggccatctttttcctgtgtcctcacgtgacttttcccccatgtgtacatccctggtatttcttcattccaaatttcctcttgttataaggataccagtcacactggattagggctcactctaatgacctcattataacttaatcacctctttaaaaatcacctatctccaaatacagtcacattctgaggtcctgaaggttagggcttcaacctatgaatttgggtaggaggcagggacacaaatcaactcataacacaagatgaggaatattgttaaatgataaaaacaaaacacttgatccctatgatctaaagccctgctctgcaattctagagattgctttagaagtttgcatttaggtatagtcgtaacatcctagaaattaatttagaaagctgcttttacattaaaaatcaaaaaggtgagcaaaaagaatcatggctctgtaaattttcttttattttgatatttcagaggacattattactattactaaaatattgtgggtggggggaaggaaagttgggagtaggatgagaaagaatcaagtgttgagggaaatttttcatgtttgttggaggaaaagaaaagacatgaaaggaagaaagatgaaagaaagagggagatggagaaataaggcaaaagaagagaagaaggagaaagaaaggaggaggaggatgaagaagaagaaaggggagggggaggagaagggaggaggagataaaggaggagaggagaagaaatgaagagggaatgggaggggaaaggtggagtggggagtgaagaggagaagggggtggaggaaagagatgaggaaagggagaggtaaagaagagagagaaattagtgtaggtagcacttaccatggattgaaaaagagagttcacgcttttccctctcttaggaaactcccagctgcttctaagaaaataagagtgactacatcagagagatgcaaacaggaagagaaagtaaatggaggccctggagagggagagcttgggtattgaggtttggtgtggatagctgagaaccatccaacattaatgagcacaaatgtgtgcacaggctgaaaatgtctctccagggacgctgatgacttgagctttgtgtgtgccattggaaatcatgaatgagaaaataactgactcgctctctcagacaatctggtttatggacctgaagctcttatttgctgtcaggttgttcatctccacgcctctgtgagatattattgaaacagaacccagcactgtcctccttgccaaagtggttgacgttggccttaactttccccagttctgagacagggacagactggctaatgtaagtgtgccctgtggatgtgcaatttagagggaggaatgggaaagtatgttgtatgcagctagggacgcacacacagaggatattttcactgattcctctctgtgggcataactactgtcttgaaggcctttgcttttctggttttatgatttccaagcctctttcctgaatcttagaagtcaaaactcaagctaagctgcaacagaaacttcatcttttctcagaataaaatctattttcttccccttcccatggtaaacaaattatgttgacagacaaatgagggattaggtgaggaaatttgtgattttggaagctcagggaagcagatgtcaggattcagctgagagggaagaatttgggcggggtgggaggctacatggagaaatcagaggcaatcaggaggtgctgtccaagatgaggcatggtggtgagatggataaagaagcagtttctaagatgccactcaagagctctctggagatttacagagagctggacttttttttttttttttgagacagagtctcacgctatcacccaggctggagtgcagtggcacgatcttggctcactgcaacctctgcctcctgggttcaagcgattctcctgcctcagcctcctgagtagctgggactgcaggcacatgccaccatgcctggctaatttttgtatttttagtagagatgtggtttcaccaagttggccagaatggtcttgatctcctgatcttgtgatccacccacctcggcctccgaaagtgctgggattacaggtgtgatccaccacacccggcctcccaaagtgctgggattacaggtgtgatccaccacacccggcctgagttttctaaacttctgggtaaggctgtttgactttggacatgacgctaggcttaactgagcctctattttaccttatgcacagtgggcatactccttaccttacttacttcacaggttggctttgaaaacaaaatcatataggaaaaatattctgaatatgctgaagagccagaaaacatagtattatcactttcttggttttgctgtacccatgtatgaatcttttctgcagcatccctgctgcatgcttgtttctatgtccccatgtcctgcctcagttgaatgcatctggtggtggggagcttactaccctttaaggaaagtcattgtttaaaaacatgtatatataatttttaatttttacagaaaaatgtttgcattgagcccaagtctgcctaataataatagcagtaagctaactctcatgtaaggtatactctgcagcagacccactttgggaactttacatatattaacatttattacatttattattcttagccaccctataaggtgggtactgttattattccgattttacatgcaagaaaaccaaggcacagacagagtaggtaacttgtcctaggtcacggggtaataatttttacctgctggctcttgtttttctgtccatagctgacccaaaatatttgatgaccggtattttgtcctctttgagtgctccctttgccggtctaccatctcctttcccttgctttcttctgcatgtgcctccttctgaagttttcccacagcaggccccactctccaagggtgtttcgacctattcagaaaagagttgcattgctgggtccccttggacctgctgctgccggtcggctgggaagagttataaagaagaaaggacattttcaagctaagctctcctggaaactggtaggatggcgtgagctggtccacaggccccagctgccagatgatgggaattgggatcagctgtgacctaattatgagtctcgtaaacctgcattgtgcccttcattttccagctcattgaccactcagagggggagggaaaagggatgagattctggtcaagtccttcctgccactaccatgtggccaaggtcacaggccaatgatgtccagagggagttggggcaggggatgcgctctttgtcttctctgaatgaagcgagcgaggagtgaggcagagaggaaggaagatttgcagacaagcaagcctcccaggagcttgttggattggaatgtattctcaggtctattgtagagacagaaattccagatttagcattctgtcattgtcagaataacaaattaatatgtcttatgcccacacaactacatatacgcaaatatacaggcatgaaacggaatatctggcagatatcatgtattttataactctttggggacaaagactgtgctgagaattcatttttatactgatagagaaccccagctccccacctccaaaccaaacacataatctccacatcacatagatgtgggcgattcaaattgctttctcctgtcaaaaggtagcatctatgaatcactaagtagagtctatgaaattctcagttgagaatgtgtctataaaatttcctcctttcttacctttttaaataaaattactaatttctctctcaaatctgactgtggaagccttaggactagtgggatattgcagaaagaatgtgacgtttgggaccaggaaggtgctgagattcggattccgcctctgctgcttaccatgtgggcaacgctgactctgggcaagttacttagctctcttagcctctgtttcctcatgagtcaaaactgggaataaataataataaccttttagggttgttttatctctatgattaaacaaaataatagatatgacatacattatgggtctatcacatgataaacgcttaagaacagagactccttttactttccagttatccaaggtatagagtatgagaggggcaggtggctgtgcagtggtacatcttagtgcataatctctagatttttggatttttttatattgagaagtggactgccaaaatttttgttaaatgaaaatattttaaaaataattaccgtcaattaacattatttcataaaaaagacattctaacattctaaagaaagccttcaaaggagtgtgtgaaaattaaataagatcgtgcatataaagtacttaatagtttatattagttcctagctttgataagcattttaaaaagcactaggtatagtttttagatatattagttttagtattggtatagtataaatgttaccataccaagaatcaagtccaaaatctctaacatgacatataaatgggtgttcacacacacataagccatttgtaccccacaaccccagtataaagctatttacagatacactctactccagccaggggtcccagatataaacacttgtaggggctgggtggataatatcattaagtaacatagatagcaggtaagaaaaactctgacgtggtgttagtctgtcttttatccttcattgttgttttaaacatggattcaagctctgaataataataagagccaacatttataatggcaaagaagaatatcatcttgctatgtgttcaagctaagcatatgtttatgtgtaagcatagctttgccaagtataaaaactagtttggaaatcctgtatggactcaatcagcttaatttttacatttttaaccctctgattttgtctttatgtttatcttcaccagttctggttctgcatagaaagtctttagaggaatgtaccctttccgataatgcttccagatccaaaggatgcctcgaaagtgaccaggaattgctacagatggttgacttttacccagttgccaacgttcttctggggatgctgtgcgttttgtgtcctcatcccaactcctagccacttcaggtttttatagatgatcttcagacaaaaatagattaagaattagccaggaggggtcaggcattgtggctcatgcctgtaatcccagcactttgggaggatcaggtgggtggatcacctgaaatcaggagttcaagaccagcctggctaacatggtgaaaccctgtctctattaaaaaaaaaaaaaattagccaggcatggtggcacgtgcctataatcccagctacttgggaggctgaggcaggagaatcacttgaacctgggaggcagaagttgtactaagccaagatcgcgcctttgcactccagcctaggcaacaatcgtgaaactccatctcaaataaataaataaataaataaataaataaataaataaataaaaagaattagccaggaggaatgacaaatagatttcatctttggactaccctctttaggggaaagttgtggttcttcatcctgctggtatttaatggattcagcttcatataggggatactagcttggaaggggagatacttagagaaaaaatgactttcagtgctatagcaaaaaggaatttaaaacatttcaaaagcccccaacctcagtacattccaaagcaggataaaataaatacaaacaaaaaatcaacacctacaccaaaccaggctaatataaaacaaaacctacttaaggtccagatttttttgtcccagcatttaaaaacagtgccagcatggactgaagtaaacacgctgcaatgatttctcagcttgggaaactgtcctttcttatatgtgagatgcctacagaggaagcagaaagatagtaatttctttcccttgcttttctgggagatggatctcagtgtttttgtcccttggtcctagccattttaaagagactgctgccagaagaaccacttagcacaattgtgaaaacctagtccccatccatagcagagatgctttcctttaagctgtactttttgagatattattgacatcaatatttgttaaaaccaaccttcgtggagctgttgctatgtaaaatatattacacttaggtcaccaagtcattagtccaatataggtatttggaagttggtttttagtcattctctttaattcaaatggaattagggtcagaagaaatgttcaagtcctaatcacttagaaacccatatttggcgtgttttgttgcttgggtaaagggagtaagacctcatggcttgaaagaatcctaccagaggtgttttgtttttttttttgtctgatttcctttttcaaacttgataagggagtaggcaaaaaatgtctgagtcaccagaactggggtttcacaaatgaatggtctcgctgtaacctaaagtaagggttgaagtgggggaagatgaaacaataggtggctgtagcactggaagaatatttgcagccccacaaactaatgtctgaattacttaggatacatccctctgtctagagccagcccaaaaaaatatgtgattcctgccctgattcagatagagatatctccaggctacttactatatgtatttattatgaagtacatgaataaatcgccacccaaatacagtaaatgcattggtattaaaaattaacacagactttttgttgtctgtcatcccatcattttctctttaatgaaataacggtctggaataccacctaatggcctgagatgcctcagagtgaggtgtgtttttaccaattctttaacttaatcagactggcctcttgatatggggccaggttcttctgagtaactcactctgaagaaaagcaggatggattgattcatggaatatggaagtgtttgcctagtgggcttcttttcaaaagctcaagaactttttctaaggtccctggtgtaccctggggaaaaaatattcttgactttttttttttttttgtcaaactgtttgtatatgtggggtgtgtgtgtgcgtgcgtgtgtgtgtgtgtgtgtgtgtgtgaagttgcatgttggtacatacttgagatgtcactatagcttttcttgccatttttcattccatttctactgggatgagcaaaattgacagcttctagacatctggaaagaggcttttgatcttaggaagtgaagtacataatcatggccaattttacctatgaggaagataactaagtggtttctcaaatgccagaataaaaaaatgacttcttgtttttcaaaacaaggcatagagatcccaatagcaacacagaatgtttctgtgtatcagagcagaaaaaggggaattgaggtagcattggttgaacacacactatgtgccaggctttacactaatttgcttgaataatttaagtgagtaacagaacaatgtttccactaagttgcagcaaaaactacacatcttagactttccttagtgacatctcgaatcttcagggaaggtggggggtgaataattgaaataactcttgatttcttatattagggaccaggaatatgcccttgataggaaatctgtcatttggaggtcattttggccctttctggaagaaaaggagacattgagtgctttgaggttccaacatcaccacataccagttagtgaaggtgacagtcttctggatctctgaccagcaccagggctgttggcccttgttgctgcccccatcagtctgaacagactcttttcccaaagaaatttgctaaaatgacaaatcagttatcactgtctattaggacatccactgcatccatctatcctaatatcttcctcacgtatgcctcagcggcatgttttacttctatttactggtaccacagtcttagcaaaagtagcacattgattataggagttgtgaagccttgagccctgacaaatggggaccacattgaagaaaatggagggacaagatactaatacaatttccattaatgacctggatagagtccccaggcattgcttatgtatttaatttttattctgattatttttaacattgtaggcagaatgccagaacgccaaccatcttagcttcttcaacattatacagtgaaagccagaggggaaacctaactcatcagatcatagttgacattgggggaaaaaaataaaggtcagcctacaaaatttcttcagactttgattaatacagttgtagatttgaaaaaaatgttttatttgagttttcttcctacatattttgagtttggatgtaaaatattttcttttgaatttggaagaccacttctctaagaatggagagttaattagatgattttcttttctttctcattggaaatgtaaaccgtgttcatttattcaacaaatattaattgagtgtctgctatgtgccagacactgttttaggaacctggaatgctttcaggaacaaaaagagaggaaaaaatatccttccttttgtaaagtttacattttagtaaaaggagaaagaggcaatgcaataaacattacaagtaaattccttttatagtatgttagaagattatgagattataggagaataccaagctgagcagggtaagaggatagaggtgctgagtaggaggataggtgaatccaaagatgaaggggttggttatgtcgttatttggggaatataaggccagtacgtctggaatgcagggaagagggagaagttaactactgggagccagagcatagtaggtctttttggcccctgaaggactccaacttgtactttgagttaaaatgggagccactgcagagtcttgagcagtcttaactcatgtgactagcatgagttaacttgagtcttaagatgcttgtgttggcctctgtaatgtaccaagaacagtttcttgccctatgattccagttttcgataagttatgccatcacttgctgcaaaacagacctcacccaccatgacactgggccagtggctatttattcctgatgaggcattgtaggatctagatcaaactactgtttcttccaagcttcctgattgcacattttcatggaaaaatgcaagggtatgtggtgcctaggaaaaggacagtagaaacggtaatacattttactcttgagcataagttttgattaactttgtcattatttcaagccaatatagccacaaacataattggtggttatgaaattatgcaatcacactgtctgaggcctcattaccctttaacttataaatctgccttgccatctttccatgatcctcttaaagaatgtacctacccaccacctacataataaaaaaagccacaagccccagccttgggggaattgtattgatttataaagagagaggctatcacttgctgttctcattaacctggaaatagacaccacattttatctgctgctctgtttcctgctgtagatctgtgtagtaaatccattaatctgtctgtccattcatccatccatccatccatccatccatccatccatccatccatctatccatctgtccacccatctgtctttccatccaaatttccatttttaaagggactattttgtgtcaagtgtcatactgggaggcaatatatttcatggttagatatataggctgtatgtagcctcagactgtctggaattaaattctgcccattactttagctatatgaccttaagtaagttttgttatttgagcctcagcatcttcctctgtaggatgagaatggtaatcaaatgtatcgaagagttgttataaggatcacaaagttaattaattcaagtccttttcattttgtcccggaggaatagttttagtagtttgagtttgcattcaatcatctcccctttcgctttttcatcagtttattcctttgcagttcatccagcagcctatcaaggacctagtatgtgttaagtattatggagacggggatatttttctgagaaatggaggctgtaggtgtgtctctagcacctaacacagtgcttggcacatggacaatgccctgtatatatttcatggaatgggtgcaactccctgcccttgaaaagtgttcagtgtgtctgtagaagtccagtgccagatgggagtgtcactggtgcagtgagccagggacagggagcagagaaagaacaattgagaatatcagagggagatgatcctccggctgcttctgctggcctggacatttgaagggatttcttactgggactggctcttttgttctgtggtttgtatttctgcctttgtgcgaatgacttgtctgacatttctgggactccatcctgatatgcaggccagacaggtgggatcccagtagggaactaggtatgcctttctgtgtattccaggaagagtttaaccttgggcagacagggctagtctttttgactttatggtatgtttaatatcaacacctggttgggggtagggataataaatgtttggcttacaggacttgcagctttgcaagatacagtggtggtgcatacacttatatttgttatgactcatcttagtgcaaaggcaatggagtacctctagaaaaattgcacatttaaggggataatttcagtggtgactttagtgggttttagaagcacgtgagaagtaaatatgggggactctggagctagaatgcctgggttcatagctcttatcttttctttttctttttttttgagatgggggtctcactatatcacccaggctcaccttgaactcctgggttcaagtgattcttttgcctcagcctcccaagtagttgggactgcaggcatgaaccactgtggctggtcagctcatagctccatcttttattggtcatgttaccttgggcaatgttgttagcttctctgtaccttagttttattgctgtaaaatggttctaataattacaggctacctcattggaagttgagaggattaaatgagatgatatatttaaagtgcttaaattcttggctcataataagcattcagtaaatgtgagctattatttctctttctcctcctcatttttaattttttaaatactacctctattactattgtgaataatgtcattataaaggtgcaactagatcatgtttatgaaggtaggtaattgcctagcacaggcctggcacagataagcactgagcaaatgttagttttctttcacatgggtcattaaagtccgtctgtaaagtctcagggactttctcatcattttccctaaacctaatgcaagatattcacatttctttttgtgcaaagaacaatcttaattcagctgataatcggggcctcccttaccttcccactgctcactataacagagaacaagtactagctcataactttttatgactttgtattgaattaaaattataatgctttattagttatcttttgctgtttaacacatttccacaagcttggcagcttaaagcatcacacatttattatctcatagtttttaagagtcaggaatctgggcacagcttagctggatcctctggtttatggtttcttacaggttgcaatcaaggttttagccagggctgagttctcatctgaaagcttgactggagaagaacctgcctccaagttcacctggttgtaagcacaacttcattcctggagtgttgtgggattgaaggtgtcagttcctagctggctgttcactagaggctgccctcagtttcttgccgtgtgggctttcccatcatggcagcttcaccaaagtcatgagagagagagggagagagagagacagagcctgctaactagatggaagttgcaatcttatataaagtaatcacagaattgataccccatcaactttgctgtattctgtttgttacacacaagtcacaagttcaacgcaaactctaaaggaagggattatgtaaggatgtgataccaggaggtggggaccattgaggctatcgtagtctgccatagcatgcctgacctgtgggttgtcttttagatgctttattttgcctaattttattttattttttaacctcagttcagagaattcaatttattagaacaggtctgaatggtacagaggtgctttaattattcagcagaattctggaaattttaagttttctagaaatgtatagttttgctttactttttctccccttataaatagaaacctgtccttccatgaatgaatgctacagtttcagagatgctttgtttttcccctgattgattgtcagtgggcagtagcctctaataaagggaacagttttaagtttccttttcttctcagcttctctgttaaatggttaatgatctggaagcaagtacttggaggtccttagggagctcctatttaaaggaacactgtgaagagaagttgccttctacagtaaaaaagtggggatgattagtcctccatttacatgtttagtaaatctgaatatttagacttccacggataccccctgccaacccccgccaaatagatgagctgaaagtacaggatagtactctacatgcatctgactgagaaagacttttactatctcaccttagggtcctaagagaagacagctggatggttgcatggcggtagaggtgtcaggaaaagctcccttataattattttcattcctatgtttctactcaatactatttaaactgaaatggggcttcatctgctcctttgtttattcagcaaatacttttgagcattttttatgatccagctactgtgctaggtgatggggttacaataagatacagtcccagccttcaaaaacttatgtgctcaaacgttattctccaaatctttattctgtttctcatctatcattaatgggaatagacagctcattttttattgttcttggaggctagagagtacaggcaaatgcagatgatcaagcctttcttattgccccactcctagttgattccctctccctttcttttacttatgacatgcaacttccacaaaggcagtttatgttagttatctatggctgcataacaaattactgttgaacttagcagctaaagacaaaaacatttattatttcacagtttccatggaggaggaactcaggcatacccttgctgcgtcctgtaactcagaatctctcagaaggttatcattgaggtgtcccctaaggctgcagtcatcctaagggtcgactggcaaaaggtctgcttccaagctttctcccggttgttggcaggatttagttcctcactggctattggccagatccctccctcattgcctcaccgtgtggacctttccatagagcggcccatggcatggcagcttgctttactagagagagcaagtgggaagagccagagagttataaacaagacagaagctatagtctttggtaagctaaacttggaagttatgtcccatcacttttgttgtattctattcaaaaaaagctacttactaggtctagcccacactcaggtggagaaggttatacttgggcacaaatactaggaggtagggattgttgtgagccattatagaagttgtctaccatgggcagaaggacatttcaattctggaaggtatctgatatggagactcttaaggcacaatgagttacccgtgagctacctcttgtacattcatagctgtccaccctttttatattttctgtggtatcagcacagagattgggggcagggggtggaagcatggaataaggaattagatgccaaaactaagaattttattttttacaaagcgttatcacatattaaatctggaaaggacattagagggccttatgcaaatgaataaactggcctagagatcttctatgcagcccccccagggtctgttctactgcagaccctggatctcctataacagaactataacagaacactggatctccacagaaagccacaaaggcccagagatgtgttcgcacagatgtcatcatccctcttctagtccctgcaggagcctcatgggagatcacgtgaccagtatttcacagctctttcccccagcacagaaatatctgccgtgttgagaggcctgtccatctcctagtccctgctagagcctcatggacaatcacgtgaacagtatttcccagctccttctcccagcacaggaacaccctgccatgttgagaggctcactcaagagcctcatgatctgcctgctacctagcaatagctttgttacataggttgattctgccttgtgcctagaaaataaatcatgtttaggattaataatagtttatataattaatatatgtgccatgcttgagccaacacattccatcacttatcttcaggctggctgcctcctgggagccactaggtctcgagctgcaggctgagcatgctgggtaacaatgctataagtctgcttactggacccagtcctacagcctatgaatattcttttctgtatttgaatagcaatagctggagatgcacaagtcttgataaaataattttacatttgttatattcactttttttcttgcctgtcaaaaatgtcagcttttactctctggcttgcaatctaaatggacccaattttaccttagctactttgatatgatattagctgcttagggcaattgcaagaaataccatacaagggttaatctccctcacccttccattcctttgatatgctgttggaaatttcaaagtgctcaaacacggagatgaggaggcagagggtaaatggatacagaatggctgggaaagggagtagcagtggttggctgctcttaagatctctctcccatggcctggtgccatgagtctgtgtccagtgtgatttttggcaatttctacattctatgtgtatttgtgaagtactgtttttgcatcagatgatatctaaggataaattttgtgttagaggagtgtagttacttgggaggaaagcagtgccatattattttatattaaacatcactggcagaaatatgaggatgggtaaatgtctactgataatttaatagattttacctgcctaaatgacattatttgcaatctgtttatttagttagtagcaaatcctggcacattagcataatacctaagggcaaaatattggattgactgtttgtttgcccttaggttatttttaaaaagctacttgtataaattaaaaaataaagcgaggcttggttgctaagaggatggtgggatttgtagactgcacaggagactaatgcaaatcaaagagaccaggaaggaaaggccaggagaacaacagacaacaggtgaatatccagaaaccagcagattctaacaggcaagaggtagaggctcaaggggagacagatgattgattggcttcagagaggtctggtaggaatctaggttgtcagctgggatcgtgatcttcagaacagaccagtgtggggcaagcccaaagcaataacttggggtcaggcatgaggtcagggcaaggcagtgggagaattgtaagctttgaggtatgtgtaggttaggggcttggtcaggaccaccatcagcaggatcaggattagggctcatgggtcttgaacttctttcattcttcctgaccagaggcagggctagtcccagggcctaggacaaggctaagcctgaaggtggacattatgtgacaaccaacaaaaggaggaacatcatactagagtcaccgtatgtcctagtttctctaggacaggcccactttacatgtgttgttccagcatgataatcagtggttctcccctttcacttgaaagtgactgacttgcgtgataagttacatagttaccctgattattttccagaatgtgtttcataaaaatctttttagaagaatgtcatccagagaccacaaaagtagagttctctagtcacataagtatggcaaatccagaatgaaaggaagtttaatggaggagtctttactgcaggatttctcactgcctttatatgctaaattataataggaattgctaagaggggaatagagttcttagtttcccatccttggttgatctatttgtacactttggtactcctgagactacgttatgtggaacacactttgggaaaccctggttagttgaatatggggtcagaaagggaaactggtcattgctcctgctgtaataagggtgcttgcaaagacagcagtcaccagttaaataaataattctggaaacaacaactgcagactctgacaaaatcttcaatttgctgattattgactgacattagcagaggtatatgtgactagccctagctgagtaactttctgaaggatgacttgttctctagctcattggcaaaaccacttactacttagggcatgggaagaaagagaattttctttgttaagtctttaactccatgatgttcttaaaggagagatgaatgaggagataatggtgtgtatgctgtgtctctgtgtatggggaaggggcctcaggaactatgtatttttcaccagcattccaggtaattctgataaaggtagccctcaaaccatttatggagaaacatttcctgggagttctgatgagaaactcatggtgataaaaacccattcatagtggtcatttctttaatcatatgagtcctttgatatgatggccagtgatctgatatttgcgaagttcccactatgtgccacaccctatctatgtgctttcagtgcttaacgtatactgtgtgaaatagtcctcatagaaatttagcaatggccccattttacagaagatgtctaaagatagaccttcaagtgggcccgacttactaggccattccatccgggcccgacaagagggtcacagctcttagacccacccctcagcaactccctaggacaaggacacaatgaggcaaatctctgagcctttgccctaaggttacacaaagctcatttagagccttaacaagcattaagaccattccattacaaacaggaccatatgctgacacattttatctctctgcctggtggaatgggtcaatatcaaacaagctaatccagggagaatgatgcattgatttcctaggccttaccaagtgtgcaggctgaagtcaacctacctaggaaggttttttttttaagatgaggtggaagagagaatacagcaagaaacaaggagaaagatttgctttgcttttgttatggagttacaaatccagacaagtgacataagcagcttcttgtttttagctgggccaaagaatgtttttcttttttaatcttattgaagagccaggatctttgtaattccatcaaggatttcaaactcaaatgcttacaggggcttggagcatgaggagatttagaactgcctgctgggtgggatctatggtgacctaaagaagacctgcctcttctaaaggggactcctgataataatgtattgtatgtttcaaaataaccaagagcaaatttcaaatgtcttactctaaaaatgctagatgagcaagatgataaagatgataattagcctgatttaatcatttcgcattgtatacgtgtcaaaagatcacataatattccataaatgtatacaatcatttatctatcaaaaataataacaaaaaataaaaaagcagactgtgctttttagcattcagagaatagattgcctatggaaaatatggctgttttctcagaaatttcaactttttaaacaaaagttgaaaatctatattttttgaaagtttttctgatttttaaaaacagacttcttgagatataattgatatacaaagagctgtacatatctaatttgatgaatttggacatatgcaaacatcgatgatgccttcaccataatcaaggtaatagacatattcaacacctcccaaagtgtcctgtgctcctttcttttttgtgggtaagacgcttaacctgtgatctaccctcaagaaactttgaagtgctcaataccatattattaactatgggcacaatgttgtatagcagatctctaaaatttattcattgagcctatatccattgaacaattccccatttctccctcccctccagtccctggaactaacattacactctctgcttctatgagtttgactattacagatatgtcatataaatggaaccctgtagtatttgtcctgtgactggcttatttcccttagcgtaatgtcctccagtttcattcgtgttgcaaatgataggatttccttcttttaaaaaactaaataatagtcatgcttggatgaaactttgggttgtttccatatgttattgcgaacagtgctgcaataaacatgggggtgcagatatctctttgagttcctggtatcaattgtttagatatatgtccagaagtgggattgctggatcatatggtagttttatttttaatcttttgagtagccttcatactgtttttcatagctcatactacattcctaccaacagtatacagggggtccaatttctctacatccttactaatagttgttatcagtttttttggataataaccaccctgacaggtgtgaggtaatatctcatatctcattgtagttttttttttttttttttttttttttttttaggagatgggggtctcactatgttgtacaggctggagggcaatggctattcacaggcacaatcatagcatgctacagccctaaattcctgggctcaagtgattctcttgcctcagtctcccaagtggctaggagtacaggtgcataccatcacacctggttctcactgtaattttaatgtttatttccctgataattaacaatgttgatcatcttgtatataattgtaggccatttttgtgtgtttttggagaaatatctgttcacctcctttgcccatttcttaatcaggcttttttcttgttattgagttgtaggcattccttatatattttgggaattatccctaatgttgcaattaatttgagtgtttaaaacattccataggccaaataagacatacagacttctggtcagtgacctctttcacagctacatgtgggtgacgctatgtcactcaaataacgggacactcgtttactgggtgtccatggtgttgcagacatttcataagctacctcatgaagtcctcaaaacgaatccatgggttgaaataatcatgcccatcttacagataaaagtgaggcccagagaaactaaatggtttttccaagttcacacagcctacatgtggttagtgcaggtctgaattctgattggtttgaccagaaagagctgcagatttggggaagttttgttttctctcctctggggaaaaagagtcccactcagggttattccattactacagatggtcactgccccggggccagggccatgccacttttctccaaaggttagtcccaccggtatgtgatgcagttggtggactggctctcctttgattagcatgagcgacgagttagtaattgatcatccacctttctaaggttgccaagcttagatttactatattttgtaaaatcacccttccacgtccttaaagtccacgtgcatagtctatctagattctgatatttcatgtgtgaaattaatcctctcggactgtaatgaaaatgtggctgttagcctctaattaagatgtgtgtatattgattgcagtggtcaagtctgtccactgatatattaaaataaataagcatccattttatattggaaattttgtgacacttcttgagacaccttgagtttctctgagttgttacaaaaccagagcaaagagtcaaagctgtaatttctgcctatcactggcttttgaatagattatgaactcttagaggattgggtttgtatctatatagttctctttatacagagatgaaggctttcacagcagtatctataattgggtgtttaataaatgctttttgatgagggtaatggtatggaaataaagctcttgagatccagagtttgcttggatttcttgcctcattagggaggaaaaggtgaatggggatgcatgggtaaatacgaatgtcaatctcaggtaggaaaccatatgctcttctagcatgaaatgctgaaaagagagaaaccagaagggtgtgactaagacagaaattctgctgattgacactaataccggtatttaccaatcttctgtaacgaggtagactccatttagaatctggtgatgtatcgcatacaagttagattgcttgacaagtcacaccaaggtttactcaaagtcactgccattatggtatataatcacaggctcaccagtgtcccacaagggtgaaggcagaggttaatggttttctttttatttgcattattacttgatctctggctttcctggtgagatgggtttttataagctcttcccatctcactttttgaagtgtttttaagctattttaaggctgttttataggtgccttttcttatgtttgttttgtatgctagaaagtaagtaaagaggatccaggatatgagctattgatactaccaggcacactgaagtaagtattaagtcttttattgagctttctaaatggcaaagtatatttcttttttatttaaaatgttaaaaaaaaaagtggtcaattctaactaactgccctaaatgtatcaaaaggcccttagaagttttcttctttgccaccatggtgaatccttcaagcaaattgattttaagcttgtacaacaatgtgaatgcaatgacactaaagtgtacacttaaaatggtacattttatgtatgtatattttaccacaataaaaaaatagattttaagcaactaatcaactacgaggttgtcagactgattcatagagcatgagcaatattttgtattcagtactataatgtagagaatattactctgttatagtcaagtgtaaaaaatatcatattttattttccttatgttaaatttgggccaggcatggtggctcatgcttgtaattccagcactttgggaggccgaggagggcagatcacttgaggtcagaagtttgagaccaacctggccaacacggtgaaaccttgtctctactaaaaatacaaaaattatttggcatagtgacacatgcttgtaatcctagctacttggaaggctgaggcaggaggattgcttgaacccgggaggcagaggttacagtgagccaagatcgtgctactgcactccagcctgggcaacagagcgagaccccatctcaaaaacaaacaaacaaaaaattaaatttggctctgagttctcatctactggaaaggtgtgtgagaatcaattgtgttatatttaaggaaacccatttcttaggggtctttgaaaatctaaatgagacttacatgagatcaggaaaatgggagaggagagctgcattcttcccatggggaactttgtaatcatttttctctttgccacacaatggaactctgcgatttggcccttcaccgcctgttaggtttatatgcttggaagtcagggagaggctcctgtaattgacctctctattgaccacagacttggccagaggagcaccttctgctcttctccaggctgcagtgttgttttcacctccagagggacctgcagcaatccttttcacctttggcattgcttcaaaggggacatgggtctctattagtcacagaaactcagcaagatcttatctcacttcagaaagctcatatcctctgagtggactcttctacctgcttgaaccccagcatgcagccagcccagattctcagacaaacctttggatgaagaaagtgaaactctgagtgacaaataactttggcttgtctgccctaagaaacacaaattgttagtgctcttgaaagtaaaggttctgagactcagaacaggatggcctaagatcttttctatataggggaggaaaaaaatgtttttctgttttctgaatgtccaaggcagccagaacatgacaaaattttatatatatatatatatattttggcaatgcctagatgagtattagtaacatactagttgcaagggtagctttagagacagagaacttgggtttgaatcaggttgaagcaggttaagttccccatgcctcaattttccccatctgtaaaatagaaataacagtaatttttttatcatgaatttactataaaaataaattaaataaaaattaatatgtgtaaagtactttagtctggcatgtagaaagtacttaatgaggaagctataataataataataataacaattagttaacattaccaaactggttattcagagtttaatcctctggaactctatgcttagctctaatctcaaggagtccagggaagcagactaatcctcactattaaattttgtattgattctcggatgttttcaaagaatcctacatccacatatctcaaaggagtgctattgatttgatcattttatgaaattcttacccttttgctttcagaattctagctagatgacaaaaaggaaataactcacacatgtaaattaatcaaactattttggaactcaaacattgcttgtggaagacttgcagattgagccaagccctgttctttattaactctggataatttgctttctttgtttgatccctggcctttaagtgaatgtcaatctcttgcttttttcctgaagacctataaggcttgctgactaaatttcatggaaattctttgagattcttagctagaagaggctgtaaaggccaagtgctataggtactaacgtctcattgctaacactgatattttaccttgatagtaacttccaacttgacataaaagcttgtaagcaccagatctttgcctctccccatggttgtatgtgtttgaattctttggagaaaattttatgacttgcatggcttagggtttcataaattataaaaatgttttatctctggtttgaatagagtagtaaagcatatccctgatttctcacttcttccataacccagtgccttcttatttctaatgcctcctagtctgatgtcactgagaagatgtttatggccttgcttgccagagaactaaaaaagaaaacaacaacaacagcagcagcaacaacaacaacaacaaaaaacatctaacaacggagccaatgcttactcatgccagtcccaggattccatatatggggacattgggcgtgttttaagccatatgctcataacctttgtgtcatgattcagttggtgtgtcttgatcagtttcctcatctgtcatctcttggaaagcatgtaaagattaatcacagatatctgcttgtattacctagattaatgctagatgattagcagatgaaccttaacatctcagtggcttaacaaaaaaaggtgttaatctcccacttctatatgaagcccaggtgggagtaaggctgtactccacaaagtcattcagagaaccaggctgttgaaggctctgccatttctagtaaatgacctccaaggtggttctcagcacaaacatctattcacagatggagaaagagattttgcatatatatttttctaattttcatttttgcaaaatgtcataataagcaggtaagatggagcctcagttggagttgtggttagtcatggtgaaacaagagttaaaaggtaaaatcgacagatttcctatcagctatttatccatcattactaagaattacggagtgttaggcttagaaaaggtctaggaattgactcattttcctacttccaggagatctggttctagaacccaggacttccagctcccaggcaaattgaagcgcttcttcttccacatgggacccacttctatgagagcatcagtctgttagggttaagtccaagctctaccacttaagagctgaacaagttatattaactgcaaagggataattttagcaacttcctcattaggaggttgtattaaatgcacaatgcgtgacacacagagacttattgtcattattaatatcccaaattttttaaatggtcacaataattccccttgcaacttctgtcatatgaataagcccaggatcgcttgatggatgatgatgaaggattcatggccaagtcatccacaccacctcagccgactttgagtcagtcaccagacatgtaagtcatgtaagtaagaccatcctagagcatacagccccaggcaagccagcctagatcagaagaaccagccagcctactcacagaactgtgagaatgaccaatgtttgttactttaagccactaagtttggtggtggtttattatccaacaaaggctgatacagaaaggatcacaattgaggagtttatgtgagctcaatctgaaagtttatatgagctagatttgcccattatttcactaaattcatcacatggccccacctaactccaaaagagactggaaaatgtaaaaaacccagacagaaagggaagtaggctccaggacagctggccaatatctgccacactgatttaccttgattttgtaaaaacaaaacaaaatcaaaacccttaggtggcaatcagagtgtaacaactttccaggcaagttctttgggacaggccactagacagtcacttttagtttatttgtttctcacaggaagatagagaaaaggaaatgcgacagatgtgatgccttcctgagaggctgtctggtaaatcaattcctgccaaagttctcctacaaccctaagagataaaaaaggaacctgcaggcgaaaaccacaaggtaggaagagtttgaagctgtgatctcttagaataagagcttttcatttattctttctgagaaggaagtctagggcatctgtcattgagagtgctattgatataattttgctttctgccccgtaggatctgaagcagtcctgccccaggcttagagaagtaagggcaagctagcccaattctgtttgctccagcacatctcatcccagagcatttgttgtaaggccctcttctttttgatcccatgtctacatttggatctctggtctgggaggagaaatctcagaggctatgaatctgatgaggaaggcaacttggcagtgcagaaagcaccctgctttgcagtcagactttccagcttccaattctacctctgccagattaattagctctgtgtgatcttgcacaacttctctaagccttaattgtgagaattaatattgtatttattaggagtatggcacacgataggtacttattagatgttagctatcatcatcatcttcatcataatttgattttgcttttcttattccctttgatcttgcctcctagtctaacaggagaaacattagaagttggtggagacggcctagaaaaggaagggtagattagagagcaggagatagtgaaaaattacagttatttcacaattgaaatcctatcccatgtttgcattgttaattatagttttcgaaagactgtcatctaggcaatctcatttcgcatgaccattctatgagacacaggaacatgcagtctattttggcagataaaaaataaatacatgaggagttaagtaaaaactgtgttactgagactgcagtaacttttataaatcaatgtgcaaaaaaaattcaagtattttggaatgagatttgttggattgaaatattttatggtggtctgtaacatcagctcgtgagctcatagaccaaaccccatcccaaatacctggtgttcaggattatcaatataaaaattgatttaagatccccataattcatttactcctatttcctgacatgcagaaagcttactgccactgggttatttcatcagtttttccccatctctccataactagtctacctctgtatgcttggcttctataacattgcttactggtctttcttaaggcatgttgtgttctgggtcagttctctttaatctgtggccaaactcttgctcagatctaggaatgtgtcatctatgtgcatctttgttctaagctgaacatttcttagcactatacctgagtttctgctgccacctttcatattcttttatgatttgcaaagctagcaggaacccaaagtgactttcataaccaagtgtccagggtctccaggagttcaggttctctctagtaaacagttccaagaccgcaatgaaagagatgtcacagagttgtatatagtataacattaactaatatttgaatgataaattattgccataggaaactagagaaagaaaaagacactttgggatggagaggttagggaagattctgtggaagatgtgagatctgagctgtgttctatggggtagctaggtcgaggtaaaaaatgccatagccaagcgatcagaggcataaatatgcaaggagtcttgggtggaatcacaaagtttagcagatgagtacatgaaggtagaccctttgtgccaggaagtaattttgacagaatgttggagataattttgcctgtaatggtttctgactgacagtttattcattcattcaatcattgagttcaacaaattcaatttattaagaacatactatatttcagtaactcttctacatcccagagatacagcaatggacaggaaaggttctttccctcatgctgattacatcttaagtatggagacaaacaattaaaaacaagcagatacacacagtaatatcgtatagtcatagaactatgaaatgttaaagcaaggaaacacaatagtgactataagggtcaaacaccattgtagagaggaaaatcagggaggaccacttgggttgggtgatatttaagctgagatttgaatgaagaatggaagccattcttgtgaaagatctgggtgattggcattcctggcagagggaacagctaatgcaaagctctaaggtggtaacgagcttggtagagtcaaggagcagctgtcattgctctgtagtgcacttggaaaatatgctcaggtctggtcctactattggcacattaagccagaatctctgagatgaggtctaagccacagtgcttattaacacctctccaggtgattctaacagttagccaaggttgaaaaccgctgtattaaaggaaagccaaaagatgaagggcttttttaagcagacagagaacactcaccaggggaatcaatggaggagggaagtgaagaatgtaactgtgcaggaagagtatgctagggatagagggatgctcatcttcgacctggtaatcaatggaatccagactgacctattacaagagtggggtccctatgctctttacatagtctcccttgtcagtttcctgaaatttattgtgccaactatggtgggagttaaagcgttaaggtttggcttatttgttttgggcagatcacagagatccaggactcagagctagggaatagacagctgaccccaagctggaaaaactttcccagatactccctcctgcctaggaagtggcctatgaaaaagcagtttaaataatggcagcctaaaatatagttctatatgcaacatttttttttctatgaaaactaccttttgccttatacaacctgttaaaaagtgggagatttcactaataggagggcaggagttgagcacagatccaatagaggaaaaatactgtcttcaggcagataggggatgtgccactggggccgagatgacgagtttcgtgaaaaacagagttcaaaagaggaggctcttgagtgtaaagataatttgaggggaaaagaaaaagatagaatgtgactggaaggaacggaataggaaaagcagcatgatatagatggaaatctcctcatttctttgacgtccttaacaagaacatcaagtgaggcagaatagtcaagaacttggactctagaatccaaattggatgagcgccttaagcactttaatccacagtttcctcatctttcaaatggaaacaacagtgcctaggattcgttgctgtgaggactaatgacaaattgcatgtaaaaagcttggcacagtacctggcacttagtccaggccccactccatggtattcatcaccagtgtcaaaattgccataataattaacattgcctcaatcacaaaattcatgtcatgttcaccaacagccaatggcttccagataaaagtgagaaggccaatatagagctggggttaaacatgtcaagaattcaaagctatagtgcccctgggtattcaaaaagcgtaaagatttgactaaattcacagccaaatggcatttaccccaggtctaccccataccagtcactggcttctctctaatagttgttatcccttttaattctatagaatagaaaagaaggaattggggctaggctgagcagcagaggagagattggctgtggagagtatagatgacacatgaggccaggtgatctctgagaaaagtttctcccatctgttgcttagattgcccatcttggaactcaggaaatctgagatggctttaaagaaaatgatggcattgagaagtagtgagattgcagggggctttcaattttctgcttgggtgttggtggagagcaccgaggtcaacatccatgcttgcagtataaaattctaggtctgtgtccctgaaaagaatgttggtgtgagctaatgtgaaagatttggggagaatttgtgtaaaaagtaacaacaaacaccaaatgcctagttgagttctctgatgggtaaggtagaatatttgagagatttttttgagaatatttcccactgaaacttgggaaataactatagttaatgaattttgaagaaaagagttagcaaaagagaaagtaaatctgatcattaacattatatacaataaactgaactgggaaccaggagacctgtgtgctagactggattacattgagtaagcaatttgaattatctaggtctcagtttcttcagtctgaaaaagaagggcatgagattatattatgttgaatccatcttttgtttaaatttttgttaaattctatggagtacagagaagttgatggcttcaggcacaagtgagaaagtattttaatcttcttacatttttaggccatgtccaaatcatttgttttttcactttattttatttgaatataatttaggttttctttctcatggggtgaatgaaaataaacactttagaaatgtataaatcagtgtgcatttattggagtatggccaataactttagataatgaaaaggatgattgagctatttaatatgttgatttaagtaatgctgggtgatgagtggtagtgacaaggctcttctcttactaggatatcacatgaacaggttctgtcctaattctgcccttgcctagtacatatgggtgactagaatttggtgagagggggctgtctgctgagctaccccaactgtggttacagcacagttacagagatggatttttaagtacacttgttttccctgtcatttgtcatgaaacagactccctatgctcattatcaaaaagcccatatgctatcttcagttcacattttgctcacctctttctcttcattgcattagtcaagttcagaaactagactgtcagctgccagacaggctgctgtttctctcagagataggtgaaaaccatttaggaattcattatcaaagtgtacagcccaagaaggtgtttttgccttcaattcaattattccaaagaagcacacgataaagaaaagtactcaggacaattagatggactatctagacgtcaaaaatcaaatttttacctttgcaaatgcaggttcatattctgttcttaagtcatcagagggaaacatatgatgttcactgtcagtttagattgtcagaaaaagcttgttcaaaatctgtaaagttgtcactcctcatgtattttcactcaagaaaccagggatccaacttcctgtgcctaaactctctgcctagacaaatggatcttttgggaggttaagtatgtcttagaagaatatctgagctggagttgcaaatagaggaatcatcttttgttaagttgttagaacctagataacatagaagattactctatggggtttgaaaaaactaagacatgatgccctctcatgagacctttacagtctatttggggagttaaggcatatatgcccagaactttattttcagtggttcttggcaattttaaagttccggtagtatagtacaagtacccaaatgtgatgcccacaatgagggctgtggtaagtcagaaaagaggctgggttttggtttcttaggaaatggtaatttacatggagtctcacccacctggaaggattgcagtctttatgtttagcatcactttttgtcatttaaatttctctctaggtggggatctaatccagtccggagttacaggagctagaggtgatcagaaagtgtgcctaatttgacttttgctccatatgtgacataaaatagaaaaaaagtgaggtccccaaagaaaaggtagcttgagaaccaatgagagtgtctctccatgaactgtcaaaacctctgggatccagcagaaacagggtttgatttaagctgttcctgggtacaaaatgcgagctcttacttggcatttatccttgacacatatgggagcaggctttaccagaggcaagaattcaatcaaaagtcaggctttttgaatttaggtctttctcttttcttctgctataaaatggtgagatcatagcccatgccctaattggttcacagatggatacatcctgaggcaggtgggggtaatcctcaagttttcctacaccaaagcataccccagaacaaagaactactcgttctggaggtgaagataaggcctgtgatgggttgtcccatttgatcactgtggatttcctctctgtgatatcttctgctcccctggaatctagtattgaggaaaaataaccttaatcaggaactgtcactcttcttcaaagagtaggacagtcaactggcctctagcctataaagaaatattcctttcagatagactctagtatataatatcattctgctattcatcaggaagtggctgaataatttattatacaacttgtctatagatcagagtagatgaataataaaatctttagtatgtaaaaaccttacaagaaagttgagacttatggtagcaaaggatccagaaggattgggtcattttgtagttattagtaaacatatgtctgtgataaagaccactttggcaaaccgaggtatctctctacccatcatcctgcttcaggagaacttgggctctgataagtatgtacgtaatgatcaaatcccccacatttaccaacctgctccagtcatcattgtggtagatgtgtgcacgagaaaaatgctcattttattccattccatggatacttacattctctgcgtgtttatttaggaagcattttattgaaatgattcctcattatgtgtaacttaataccatttattcattaatttatttactcagtacacattaattgagtacatacaatgtgcctggtgctgggaaagcaaaagaaaaaaccaccatacttatcctcaaagtcatctcagtctatttgtagaggtgaataataaatgactgtaatacatggtgaggaagaccaccattaagtcagaaattgctaaaggagttagcaactaactgtctaagatgattgggagcattcacagagaaggttatatttgttgaggaccttgaaggagtaggagttgcctaggtaaatcaaggaaataaagggaataaatatcaaaggacccacatgtatgaagacacagaagacatagctttagagaagtttagagatgtttgtagagcatgctggaacacaagaaatgcttttggaaagactctgtaaaatatttataccctaatactaggtatgcaacagtgaacatttaaagtttattgaattaagtcaaccaaagaagacccaagttgtgggattcaagaatagcaaggctctttcaaatgcctctgaaacagttgggggtggacctctccatggtgctgaaacatcccctgttcaagccttcctatctatctggattattggctcctttccatgttcctaaccctcattctgcatgcagtaattacttgattgaccatttcactcactggccctgccaggaccttgccttggatactacctgtccaatggtgagcttattattctttcctttaacctgcacagaccctggatgggcatttgatcaactgaaataattaatgggtagaaacagatattgtcagtgaagtcctttaacttctttctgcttgcttttctcccagatattttagcatttaattaatctggatgcaatttattagttgcttgggttggaatttctttagccttttagcccagatcacatatacttattacgtatttattggaattttcaggaaactgtagttcaaggtgaaactttgaagatagactcaaacaatgggcatgtctcacaatgatacagaggactcagataaagttggtggaatagagtggaaagaatactggatttgaaattaaaagttcaaatcagggtttcaccacttagaagctgggtaaagtcatttagtttattttgaagcctcagtatccttatttgtaaaatgtagacaggttattccctgtatactcacaaacttgtgctaagactcaaatattctcatgtttgtgaaattagtttgaaagtgatgcagttgggaacgattactggataggttggaaggttgtccaactggtgcccctcatgatgggaagagacagaacactgcgaattagcacagtgaaagttaggagctgtgaagaccctagggggcagaggaggtacaggcattaatattatggtgctgagaagttaatatctttctttttaaaaaatagctcggcatagaagctgtcagtagggctttctccccggtcagatttatgacttctgaatgacattgttttactttgccatttggaggataaacaaagctggagagaacaaaagttttattttcctatcagtgacaaatacatagcaatcaatgtaattgaagttcaagtggaataatttatgggggatccattgcatgctcctttgtgtactctgtctgtctgtctctctctcttcctctatccccactctaattcctttcaccgtcatttatttctgcctctttctggtattcagtcctgtatatattaaaagcataagccaattagaaaataattgctgttactctgcttggcccatctttcttgatgtttaggttagtttggcattttattctctccaaagaatgtatttattcaaaaaagacatctaccacatttaatgcgggccatttagatattaatcatcaaaggtaaacgatgaagaaaaattttagtctttaattcttttcttaaaagtcacatatacagagagctaattgacccatgctatgcagaagtgctctgcctgaagcccagggttaatttttacaatggccacttagccaattgaggatggttaagtgagcaatattttatagactcttgtattaattattttgggggatggatataagtttgtggatggggaaaacactctcagattattctaggggagatgaatgatatatctttacaaaaacatataaaaaccttaatttcagtgaatggtttataatgtaaaataccacaatgatatataactggataagagggcttctctgtgagtagagcttatctgtatatcctgatgaaatttaaaaaaaaccccatggaatatatgtttttgggggttaacaaaaggaaacttgggaaccaagaaaaaggaaggatgtaaattaacttattgttgtcctttattgtttgaaaaattcttatcataaaggatggtagcccactgatttttaatttcactgataagtgagcaggaaggaataggtaagagatgaagatgaatgatttaggtcatacttcaataaaatatttttactgtttatttcctgtatcacaggtttttcaaagtagagcatttcttatctggctggtatgatttaggcattattttatcactagaaaagccataacgatgaagggatggtatgttcaaagcagaggattaatatttactacatatctactatgagtaagttactatgcttttttacatatacttttttacatatcatttaatcaacagtcttgtgaattaggctattctgacagatgagaaaactgaaaatcaaagacactaagtagcttggtaagtgttacataaccatgatatgtcagagccattaaatcgaggtgtgcctaactctaaattccatactctttatattacactatgatgtctaataaataatttggttgaaagagtcatttttattcaagataggagagtagactcattgatttctgttagtcttttctatgaatctgttatcggaaatagttgactacaattaaaataattcctggcactataacactactagacatcttcatgtcatgtagccaacatctttttttcctttgcaccatataatctgttttctctatgggtaaaaatcacattttaatgatggggtggaacttcctttattccaaaactcatttgtagtcggggttgggcacatatctaggtctgataaatcagaatagcctattcttctgtccacagctatttatttttaatgttttcaagctgattttacctttctgctagagtcatcagggaagatactctctttccactggggttgttaaacaagtagaatgcaaggctagactactagcaggcatccttctcattaattagcgagagaagagcttgtctgaactatggagggaaaaatagagaatcaatatctaacggtattctttaagaccctgaatccagccacacttgaaccatttttctaaaggaatgtgaattcatagtgtttttcttttatcttgggtctatgttatttgattttaaaatatattaaaatctagcaatgttattttatatgtggctgatacattatatatccatagtcaaggagatagcactaatcacataccatgacaatagacacaagtctgatctaaactctgtatagatattggcactgcccttgttttccagattatctctggagtgctctgagggatcagttggttggccaacaaataccatttgtgcctcaggctctttgtaaaacctaggggaatgtctgaatttcccttgattgagacatctcccttccctgtcaagtcctgaaggagctgtaaactcaaggaataatgccaaaggagaaattagtgtctgccttattatcaattgtacttttgttcataactcgcaataatttggttgctgcatagggcttagcctcaaatctaagcagactttctctgcctcataaatcaaatcttaactctaggcagtggtaaaaccacagtgcccagtaatggttagtaaagaatacaagagagtgtaggccgggtgcggtggctcacgcctgtaatcccagcactttgggaggccaaggcgggcggatcacggggtcaggagattgagaccatcctggctaacacggtgaaaccccgtctctactacaaatacaaaaaaaaaaaaaaaaaaaaaaaattagctgggcgttgtggcaggtgcctatagtcccagctacttgggaggctgaggcaggagaatggtatgaacccaggaggcggagcttgcagtgagctgagatcgcgtcactgcactccagcctgggtgacagagcaagactctgtctcaaaaaaaaaaaaaaaaaaaaaaaaaaaaagaatacaagagagtgtgacccatagttcagactactcaagtctatgtgggtctgcttcctgaacagctggtaaacagtggagaaagccatactcaaatgaatttcctttcaatttcagtgcgtcctttcactacaaaacagcccaatcaatgtcctgggttctgttcactcagactgagaaaaagaagtaaatcatccatagattttggcattttgttattatcacaaagtatgctagacatacacctcataagtgattttgacaaaaagatgtgctgcaagcacagtgcttgaggggtggtcacgattatggatatcactgtactaatctcagaaatcttagtgtatgtttttttttgtctttactggatagtttcgtatttctacctgcatgtggagttctgtcagggccacattcttccgggatatataaacgtggagaaaagtccttacactgtggtacagtgatccgctggaggaaagtgctatatctgtgcattttgcaagaagtcattctatagcatgtgtatgtctattaacacaatcactgaaccagagccaaggttccaaagggactatctgagatcatctttctaacccagtgattctcgagctcaggtgcatggcagaatgcctggagggtttattaaaaacactgattcctaagctccacctaagaccgattgaatcaggttcttttagtgtagggtgcaggaatttttttttataacaacttccccaggcgatttttctgccagtctatagaatggcctttggggatctctttatcttttaccttcaagttaaaacacatcactctgaaacttcatgagccagatacgaatctaacctatattcaaagaggtttagaaaaagataccttcaacctctctcagcacaatttttttttctattaagctcccttttcaaaatacttgaactccacctggacctaggcaaaatgttttaaaatggcatcagagtgaatcaaatcacattaacctgagatggtgggcaaggatcatgaaaaaggacagagggaagcctgaatgtgagtttgcctgaagaggaaatgatgattccaataagtgccttttctttccgtttgcattctgtgcgtagctaatccgctcggcataatcctcttaacggcatgtgttccatcagtattttatctgatctacttctctgacaatcctatgtttgctagtttccttgtatttttgagaagctctagatgttacatggaaaattcaaccttgtttctctgttttcatacaaagtggggttcttggaattcttagaaaatggggaggaccctttgcacaggctgaagttgtgtgagaagtctggacagagtttccagctttcaaaatttagtaggggaaaactaaatagaggctttctcccttgtctcaaaactggattttaatttgcacactgctggtatgggtcaggggactgttgtgctgaatcagaggatgtaggatacagggaatcatgaaaataagcattggcccccatgcctaggtgatgagaacatttgtcagtagatgttaaggttcctttataagcttgactattgcttttatttgcataaccaaggaaattagaataagattggggcatccttcatttaccatagataaagacagggattctcttactgtagacccagccctatctgtgcactgcctcctatggggaataatctgagggctaaaatgcatgaccacttgccatggtactaaagtccctcagctggacttcatgccataatcacttcatcccattgggaattcagatccctctaaattaaaatacccctgagatgggtgtaaccttaatccctttatcagcttactctgtaattatcaattaatactttaggagagattaactggcaaaaaatggaaatcaagatggcatttctcctggttttgctcctcctcgttttgttctcctggttttgctcctcattagcagtgtgaccttaattttttaatttctctaggtcctgggttcttcatgtatgcagtgaaggaactaggtgatagaatctttgacctctcttctggttctgttttagtgacagaattcactaaattcacatttctggattcctgactgaaaggggattcataagagccttgcttacttcatggctttcctcattgtgtccatggaactcaggccacatgattgtgggtctagtgaaacaaagagagtgtggccagagaatgaaagccataggaaacctagatagccgcataattacttagttgaaagccttgaacagctgaattccagagatgagtttgcaaaagaggagtatcatatgggatgtcacacttcaacagcagaaaaataggctgatacgatcagaaaggatgccaggccattgtggacatctgccgtgcagaatgacatcaagtggctgtctgaacatagtctgaaatctctctctcttgactttgaagagacccctgggcctcaaacttcaaatctgcaaagatagcactatagccagcaggcctggctttctcatgtcaacatgatgcaaacgtttctgtggatacgggatttggagtcaggaaaactatattccagtgtgacatctagccaaaaacaaagaaaactaacaatgttattgttaactttgagctttcctctactttaagcactgggctaaatgtttcatgtactttctttcattcaaatggtgaccttaggttcttctgtgagtcttcatttctttttcagtaaaaatggagcatatctgctttatctgataatagtaactaacaattaactgaatgcttacttgtgcaccgtgcactagggtaagcactttcgtgcattattatctttgtacaataatcctaagaggtaggtagggatgatgactatttatagacaggaaagctgagttggactaagtgaaataaacagcgatgaataaagtctgtggaagaaaggggattcatattttctatgcttcctgatatccaagtcacccagaaatacaccaaagaagctttcagttttcacacctggctgtatgaatttattccatctcagtgagggccaaatggaagactatttgtacagggctgtgtggattaagggagtgaagtggcaatgagaaacagaattcaagtaatctagagctggatagaaactacttatttaagagagcacttggattccagagtttgagtaaaggctttattgactaacttcctaaagtcaccaagaatatcaataaactaaatttacccctttatttatccttacacctttgtattagtccattctcacactgctacaaataaatacctgagactgagtaatttataaagaaaggaggtttaattggctcatggtactgcaggctgtacaggaagcacagcagcatcttctctgcttctggggaggccttaagaaacttgtaatcatggcagaacgaaagggggaagcaggcacatcttacatggctggagcaggaggaagagatgaagtgggaaggtgatacacacttttaaacaaccagatcttgtaagagctcacttgctacacagtaccaaggaggatggtgttaaaccattcatgagaactccactcccatgatccaaccacctcccaccaggacccacctccagcactggggattacaattgagcttgagatttgggtggggacacagatccaaaccatgtcagccttcttttctgtgttatttttatgtccagccttactgaactttctaagctccaattttttatgatctgaaaaatggggctagtaatagctttaactggctagtggtggtgagtgggaggcaaataggagaattaaataatatagcagacattaaaatattttgtcaatgataaactaatatggatagctattaggcctaatagtgactgtgttgattgctgatttattatttgtcactgatgacaggacaatatctctcttattgagaagaaatgccttccttattttcttcttaaaaagattatcatttgcttattttcttcctcctctgtgaagtaaaactttatcaagaagaattaaacatttaaaaaagatgtgcagtaattggtagggaaggataacgagaagaaaagcagacaactgtctgctgcttagcatatccatgagtgtgttaatttaattagaactgccctgtataaatattaaactcaattcacttttgttatgatcctttgcttttcaaagtattcccagttacagattatctttttcaaattcttctgtgagtttgagggagttaatggaagtaaaacaacccaaattggaatgaactgagagaggttttcatcttatcacactttgcttctttctgttattttcctttgcctagttcctggcccagcggcaaaggaggtgattgattttcagtggttttgcctttcaagatgttggcaatgcaacaacttcccttcagtggaattcccattttgtgtagtattttggggtggaggattgaattgctttacatctccacactcctgattaaatgtgaacccccacctgacgtttccaggtcagtagccaggatgtgggatgtagtgcgggatggttgttttatttgattttccccacaactgtgtgagggcaggatatcattgtccccattttacagttaagagtagagtcagtaaatcacagagccaagcatgtataatttctaacagaaattatgggtttagtacctagattgagattttgatagattcaggataaaggtagtgaaaaaattgcccatggaattggtttgaactgaattcatgagaattatagacttccataggcagaagggatcacttttagagtcttttttcagaatgaggtgagtgaggcagagtcgtgcaagtacagatttggggtcctatctttatttaaatttttgatactttgtttagcatggatatttccattcatttttgtgttttaaatgttgcattaaaaattctgtatctagattaccaattcttttggtacccccttaaattttctgcctgatgcaagtgaggcacttccctcaccctattcccagccctgtatagcaggcacaatgctaggttgtttaccagtcatagccccttatttttcacatgaagaaactggggcctaagatcacaaagccagcaccaataacacatggctcttgactcacagtatcgttctcttcttgctagtggagctaaaataataggagagacaaacgtcaggagattgtaacctcataatagagcctgactaaatgtgccagggaaaaaagtgtagcgtccttaaactgtacaagtcagtttagcaccaaatctttcactcacccagcaagtagaaatagctgcaagttgcagcaggtggaatttagattcggttcaaagaagaattacttgacaatgtgggaagtgaggtgctacattgtttcctagataatggcataaaataagagtgggaaattcaaatcccctgagttgggtgtaaatggtggcaactgtgacaaactggagagagagatcatagtagaaactaagttctatacttaacttgattactagagaagcaatgtcttttctttctttctgggtctcggacacccttttgatttcaggtcaaaatcattttcttgaagtaacgtgaaccccaatatggcatcatcctcttctacctatccatagaacctccttgattctacttctttgttttgtctttgcagctttagtcaacagaggctgttcccacagttcctcatccttccctcagttatctatttctgtagctctgggtcctgaattacagcattttctaaccctttgatttggctctcttctgctctgaaaagcattggctctttcacagttactgtacagtatccccactgtggcattttctgactcccatgctgggccatctcatcccccatcaacaaatcaccttgctaccacatggccttttggtaactgacttttatgtagaataacatacatgtagaatgtgtgagagaacaatgcaggcaggagcctggctttgctctgcactgaatatttagcactagcatagttctctgctgtacaaataggaagtcaataatacttgttgaattaataaatatttatacagtgcaatttaattaattccaagtttggcatcttctaaaattcacataggaattttcaatgtggccaaaagccccacatttcatagcaaaatcatgacttggctaatcagagagataaaagaaagaaagaaagaaaaagctctgccctttgcatgtggcctgataaacaattatgccctccagacaccagggctgtgaattccgcctttttaaacaggcccagagtcagcttatttggagattttcagcaccgtggacagaggcaccaggttactttttatctgtcactccctgaacagcaggatgaagaactactcagtttgggacagggctctcagccactgtggtgaaaatcaccccctttagcagaaggaaatttacttagaccctttttatttcccctttcccttggaaaaattgcattttcagttgtcaaggcacttaggcttctacaagttatttttcaggtgcctggaggatggaaaagggttgccctggaaattgatatcttcttctgagtttggcttaacaggggaaccaccagtgcccttgcggatggctgaggtgtcttttatgctaggtatggctctcttccagataaccaagtgtagacaggagtaggcccagttgttcatggagcattggttttaggacttgacctaaaagctgggtcatactattgccagggcaagaattacaaaagcaggtaaactctgccaagatttttctagtggaacatacacattcatggggatgaatccttcccaaactttcaggttttactgtatttggctgtaaaattcaaaagccagattgactaattctcagtgcctgttaaattcttttaggagcaaagtgatacattgtccccacccctgcctttcctaagaactcattttttcccctactcattagctgtattcaaatgcagagctttgctgatgaacagcaaagtggcttcttgactattgggtctctcactttgtcttctcctggactctgtaagtagccctactttcatttattttctaatctttgatgcctttccttcattttcttgaagcacctttacttttcatagtctgtctctttctttttgccccttttatggccattacacacaaatctgagctggccctcttctcatggcaatagacatcctgggctactttcatgaggaagcttaggacaggagctgatggagattagccaaaatgtcagagttagcctaccctttgacctgggcctggaggtgaggttttcttcttacacttactttggaatgagaaatgagagagtgaagttttcttcctacacttacttcatgtcaatcttctcagtgtctaattgctatgatcagaaattcagagttatcccaggctgggtatttgcataccacaatgagaattgctacaactaatgttgcttgatggaagggcaggagctgaaattttacctgagccaccaattttctcaaaaccttggcctgagagagaattcaagttttacccagaagtatctacattttgttttttacaaaagggctcatgatagagctcagttaccttctgctatccatctgtgccaatctgaactgaatcagagtatcatttccttttttttgcatgtgctggtgtctcctgtgttggccttttagagtctgacacggtatttgggaccctccatgagattggaaggagttccattaagtgatagataaagatgtagccagtagaggccaaaggtactcaaatactttttatttaaccttcttactttttgtccttagggaaactgtagacactttgagactgtttattttatgcttcttttctaggaggtaaagcttttgggggaaggttttatgctttcagaattttcagttaacatttctgctttgtgatggtctcccaatcccatctccttcaatgacagctccaaaatatcaccagttttttatttttcttattcaaccctaagttttattggagaaccttattcctgcttcatggagaaaactggctaggcgtggtggctcatgcctgtaatcccagcactttgagaggccgaggtaggtggatcacctgaggttggaagttcaagactagcctgaccaacatggagaaaccccatctttactaaaaatacaaaaaaaaaaaaaaaatagccaagtgcgcgcgtggtggcacatgcctgtaatcccagctactcgggaggctgaggcaggagaatcacttgaacccaggaggcggaagttctggtgagccaagatcgcgccattgcactccagcctgggcaataagagcgaaactccatctcaaaagaaaaaaaaaaagaaaagaaaagaaaagaaaaagaaaattgatgatattttgtgtgtgtgtgtgtgtgtgtgtgtgtgtgtgtgtgtgtgtgttttagttctccagcccccttagaaagattctttcttccacaccaattctcatttccttttcttcaggtttagagatgacttctctcattcaagaccagttccttctctcctatctttcaggagatttctctataattcattctctctctccacactcaccccaccccactacatgatcttcaacctctccctctctcttctctacttgtcttcattctgtcagcttagaatcatctttcctgtgttcccacctagcaaatatcctttctttgacgccacatctctttagctcccatctttgtttatcttcgctttcttcttcttttttttttccttcgtatccaaatcatcattcattacacaactcattgaaatctgaattatctttcttttcatccaatgaatcatgcctaggtcaatgatttatttttccaccaaacttgctattcttcgagtatttaccatttctgcatgtgacaccactatctatctcagctagctgtctcagaaacgtcacatcttccacacccatcaagctctaattactttcttcctcaacagctctcaatttcctgtcctctctatttctgctaccactgcctatattctgagctttgttgtttcttactatgccactacatcagtctcccaactgatatctctctctctctccctccagccttttttttttttttttttgagatggagtcttgctctgtcgcccagggtggagtgcagtggtgcgatcttggctcactgcaacttctgcctccaggtgattctcctgcctcagcctcccaagtagctgggactacagccaccacgcccggctaatttttgtatttttagtagagacagggtttcgccacattggtcaggctggtctcaaactcctgacctcaggtgatccgcccgcctcagcctcccaacctccagctctcttctagttgtttatcctcctgtatcactagtgtacaccctcactcatattcactgtgtaaaatgcaaagctgacctgattaaaatctgtgttaccttcctatttcctgtggggtaatagtccaatcttctgtataaggctgtccacgatccatctcctgccatttttcctgctttttgttccaaccatcatttaccttgctgttcaccctccacaacacccacagttgctagtggttccctgtatttgatacgctgtttctcatgtttgcggtttgtgggagccttcccctttgccaatattggcatttgcctattttcttagttaactcgtggtcatctgttgaaaatcagctcgatatcatctctccaggaagccctccccgcatttctgcactcactttctccatccgttaccaaggttgaagcaccttcctttctgttggtataaagtaccatgcatatggccactatggccattgcactcatggtactgagttacctgtttttgtattttttttcctcaatgtgcctccatactcagtacatcatttttttctatagtactgggcaaggttcttgacacacatgagctgcttaattaagtttaatgtatttatgacaaatttagagcaggtttgaagaaattcaggcttttccccattaagtaatggtgcaccccattaagtaatggtgcactttgggagaaatgggctgaaaaagttttaacgatagcttttgcagcctatttgccccaattgtgtaaatactaatttaaaaccaaatgacttctagaaagtctgtagtcagtcttcaccattgggagataatgaggcaacatggattttgctgcctctctcttaaataacatgaatctactgtggagacttttaagcctatgatgatattttatatcaaaactgagataaataaaaaatgttcactgacaataatgactatagataaatgctgtcagttgtaaggaagtgtcaatcacagacagacgtcagtggatctgtgagggccacactgaatttttgcatgtgtaaactgtataaaataagattttaaagaatgtcataatcatattcagaaagtggaatgagtgtgcatctgaatggctgcccaatctataacgaatattctatctacagggcaataagcagaaaaggtgatgcagagcagccagccagatactatcatcctcatttctttaacatgtatttctagatccttttttgctcagaacattgttatggcattcctcagaacgcttttagtctctctctttctcttttatacttaaaattctaaaccagattctggtgtagagttctgagattatcactgtgccacagtgccattcaacattcctgggattacatttttctttacaaaaggtagcactttggtattcccctaggaccctcagattctccttttttcttttcattgctgcttaccagaaacaggtgctcctcaacctgtatttgtgcagtattttttgcaataggcaattatatgtacttttagtgataatagttgtttgtacattaacaatagtttcacttttaaaattggtgtattttccccttccgcatatgtgtatgtacacaaaggaatacaaacaaggacagacctgattgttcctttgttataagtaaagaccatctaattataataaagcacaattaataattgtgtgtaatgagcaaattagagcaataatacaagaaaatgagaggcaattccttgaaatgtttctgtcttatcttttaattgaaaaaaaaaaaaaagccttccatttccctcaggtagagtgaaactgacaactgagctgccctgcttctgccaaatatgaagatatctaagactctgcttctctgtttactgggcaaagtcctggagggagagtggggaggggaaaggaagaagtctgttgaacttggggcttagtttcactctggattatgtggcaaattgattttgataacaggcacctccccattcatacctatgttattcttaggattatgcagtaaaatagtttaatagtaaaaggatagaactttggtgttagaaagacctaatttctggtcctgactttgccactttactaatttgtggttttaagaagctacttaagtattccaagatgtagttataggtcacatggtttttgtgacacttaattggatagtgcttacttcaaggcctagcatgtagccagggctccatcaatattctctatgagagaaagaggaggaggaaaagactaaaaagtccgaaggatgatatgatgtagttgaaagaggatgcacttagacacttaaatcctgtattcgtttcttactgtctgtattgtgttgggtaaagcaacttgaactttcaaactcaccattttccaaatctattaaaaaatggataatcatgcttaatatagaacagttctgagaattaggtaagaaaatgtctatgtaagtgcctagtgccacatcttgccattagtaagaaccaagaaatgctatttgtggtgggatgccattgatgttgggtagagcttagctatgatttatgatactcccaagagactttttttttaatcgtgtgaagccatgtgttctattctgctcaacgttctcatcagactcatgattcctaattcttaaagcaaaaaatggggtctgagagtgtttcgtggcatgacagttgtggtcagaacccctcccatattcccttattctcaccaagtcaatgcaacttcgatcaggcatgcatttttctgcctgggggcttgctctttgctaatggatctgctttgtatcctgtgctatagaccagaagtgcagagaaattaatgtcctctttcctcagtgttcatcaaacaatggctggtgttgttttctactggctcctagaccttcctcagtgagctaaaattccattttccctagatagtagctggctcttgccccgtctgtaggtcacatccccgcatcacgttcctaataatctacctgcacttcactcttggtctgaaggtttgcttctgaggaaacccaaactaaggcatggggctactctagtaagccagcccagtgatgtttatggtgaattatcataagtagatctcgataccaggatttgtattatattgtacagaactggttataatagaactagctctagctggtctgaggcttaatatgtagattgaaataaacatgcctgagacctacagattatttttcttttttttttttattatactttaagttctagggtacatgtgcacaacgtgcagatttgatacataggtatacatgtgccatgttggtttgctgcacccatcaactcatcatttacattaggtatttctcttaatgctatccctcccccagccccccacccatgacaggccccagtgtgtgatgttccccggcctgtgtccaagtgaactcaatgttccattctcacctatgagtgagaacatgcagtgtttggttttctgtccttgtgacagtttgctgagaatgatggtttccagcttcatccatgttcctgcaaaggacatgaactcatccttttttatggctgcatagtattccatggtgtatatgtgccacattttcttaatccagtctatcattgatggacatttgggttggttccaagtctttgctattgtgagtagtaccaccataaacatacatgtgcatatgtctttatagtagcatgatttataatcctttgggtatatacccagttatgggattgctgggtccaatcataattctagttctagatccttgaggaattgccacactgtcttccacaatggttgaactaatttacactcccaccaacagtgtaaaagcattcctatttctccacatcctctccagcatcttttgtttcctgactttttaatgattgccattctaactggtgtgagatgctatctcattgtggttttgatttgcatttctctgatgactggtgatgatgagcatttttacatgtgtctattaattggctgcatagatgtcttcttttgagaagtgtctgttcatatctttgcccactttttggtggggttgtttgatttttcttgtgaatttgtttgagttctttgtagattctggatattaaccctttgtcagatgggtaggttgcaaaaattttctcccattctgtaggttgcttgttcactctgatagtagtttcttttgccatgcagaaactgtttggtttaattagatcccatttgcctattttggcttttgttgccattgctttttgtgttttagtcatgaagtccttgcccatgcctatgtactgaatggtattgcctagattttcttctagggtttttatggttttggatctaacatttaagtctttaatccatcttgaattaatttttgtataaggtataaggaagggatccagtttcagctttctacatatggctagccagttttcccagcaccatttattaaatagggaatcctttccccatttcttgtttttgtcaggtttgtcaaagatcagatggttgtagatgtgtagtgttatttctgaggcctctgttctgtttcattggtctgtatatctgttttggtaacagtaccatgctgttttggttactatagccttgtactatagtttgaagtcaggtagcatgatgcttccagctttgttctttttgcttaggattgacttggcaatgcgggctcttttttggttccatatgaactttaaagtagtttttttccaattctgtgaagaaagggtcattggtagcttaatggggatggcattgaatctataaattactttgggcagtatggccattttcacgatattgattcttcctatccatgagcatggaatgtacttccatttgtttgtatcctcttttatttcattgagcagtggtttgtagttctccttgaagaggtacttcacatcccttgtaagttggattcctaggtactttattctctttgtagcaattgtgaatgggagttcactcatgatttggctctcagtttgtctgttaatggtgtataggaatgcttgtgatttttgcacattgattttgtatcctgagactttgctgaagttgcttatcagcttaaggagattttgggctgagacgatggggttttctaaatatgcaatcatgtcatctgcaaatggagacaatttgacttcctcattgtgtaattgaatacagtttatttctttctcctgcctgattgccctggccagaacttccaacactatgttgaatgggagtggtgagagagggcatccctgtcttgtgccagttttcaaagggaatgcttccagtttttgcccattcagtatgatattggctgtgggtttgtcataaatagctcttattattttgagataagttccatcaatacctagtttattgagagtttttagcatgaaaggctgttgaattttgtggaaggccttttctgcatctattgagataatcatgtggtttttattgttggtgctgtttatgtgatggattacgtttattgatttgtgtatcttgaaccagtcttgcatcccagggatgaagctgacttgatcatggtggataagctttttgatgtgctgctggattcagttcgaaagtattttattgaggatttttgcattgatgttcatcagggatattggtctgaaattctgtttttttgttgtgtctctgccaggctttggtatcacgattatgttggcctcataaaatgagttagggagggttccctctttttctattgattggaatagttttagaaggaatgctagcagctcctctttgtacctctggtagaatttggcagtgaatccatctggtcctggactttttttggttggtaggttattaattattgcctcaatttcagagcctgttattggtctattcagagattcaccttcttcctggtttagtcttgggagggtatatgtgtccaggaatttatccatttcttctagattttctagttcatttgcatagaggtgtttatagtattctctgatggtagtttgtatttctgtgggatcaatggtgatatccccttttttttattgcatctatttgattcttctctcttttcttctttattagtcttgctagtgatctatcaattttgttgatcttttcaaaaaaccagcccctggattcattaattttttgaagggttttttgtgtctctttctctttcagttcttccctgatcttacttatctcttgccttctgctaacttttgaatttgtttgctcttgtttctgtcgttcttttaattgtaatgttagggtgtcgattatagatccttcctgctttctcttgtgggcatttagtgtaaatttccctgtacacactgttttaaatgtgtcccagagattctggtatgttgtgtctttgttatcattggtttcaaagaacatctttatttctgccttcattttgttatttacccagtagtcattcaggagcaagttgttcagtttccatgtagttgagtggttttgagtgagtttcttaatcctgagttctaatttgattgcactgtggtctcagagacagtttgttgtgatttctgttcttttacatttgctgaggagtgctttactcccaattatgtggtcaattttggaataagcgcgatgtggtgctgagaagaatgtatattctgttgatgtggggtggagagttctgtagatgtctattagttctgcttgttgcagagctgagttcaagtcctggatatccttgttaatcttctgtcttattgatttgtctaatattggcagtggggttttaaagtctcccattattattgtgtgggagtctaagtctctttgtaggtctcgaaggacttgccttatgaatctgggtgctcctgcattgggtgcatatatatttaggatagttagctcttcttgttgaattgatccctttaccattatataatggccttctttttctcttttgatctttgttggtttaaagtctgttttatcagagactaggattgcaacccctgctttttttttttttttttgctttccatttgcttggtagatcttcctccattcctctattttgagcctatatgcatctttgcacatgagatgggtctcctgaatacagcacactgatggatcttgactctttatccaatttgccagtctgtgtcttttaattgggggcatttagcccatttacatttaagggtaatattgttatgtgtgaatttgattctgtcattatgatattcactggttattttgcccattaattgatgcagtttcttcataccatcaatggtctttacaatttggcatgtttttgcagtggctggtaccagttgtctctttccatgtttagtgcttccttcaggagctcttgtaagacaggtctggtggtgacaaaatctctcagtgtttggttgtctgtaaaggattttatttctccttcacttatgaagcttagtttggctggatatgaaattctgggttgaaaattcttttattttagaatgttgaatattggcctccactctcttctggcttgtaatgtttctgctgagagatctgctgttactctcatgggcttccctttgtgggtaactcggcttttctctctggctacccttaacacttttcccttcatttcaaccttggtgaatctgacaattatgtgtctggggttgctcttcttgaggagtatctttgtgatgttgtctatatttcctgaatttgaatgttggcctgccttgctaggttggggaagttctggataatatcctgaagagtgttttccaacatggttccattctccccatcactttcagggaaaccaatcagacgtagatttggtcttttcacatactcccatatttctttgaggctttgttcatttctttttactcttttttccctaaccttgtcttcttgctttatttcattaatttgatcttcaatcactgataccctttcttccacttgattgaatcagctattgaaacttgtgtatgcatcatgaagttctcgtgccatgattttcagctccatcaggtcatttaaggtcttctctcactgtttgttctagttagccattcatgtaatattttttcaaggttcttagcttccttgcgatgggttctaacatcctcctttagcttggagacgtttgttattaccgaccttctgaagcctacttctgtcaactcgtcaaagtcattctccatccagctttgttccgttgttggtgaggagctgtgatcctttggaggagaagaggcactctgatttttagaattttcagctttcctgctctggtttctccccacctttgtgctttcatcccacctttggtctttgatgttggtgacctacagatggggttttggtgtagatgacctttctgttgatgttgatgctattcttttctgtttgttagttttccttctaacagtctggtccctcagctgcaggtctattggagtttgctggaggtccactcaagaccatgtttgcctgggtatcaccagcagaggctgcagaacagcaaatattgcagaacagcaaatattgcagaacagcaaatactgcaggaaagcaaatattgctgcctgattcttcctctggaagcttcgttccagaggggcagctgcctatatgaggtgtctgtcatcccctactgggaggtgtctcccagttaggctacacgggggtcagggaccaacttgaggaggcagtctgtccattctcagagcccaaacactgtgctgagagaaccactgctctcttcagagctgtcagacagggacgtttaagtctgcacaagttgtctgctgccttttcttcagctgtgccctgcccatagctgatgtggagtgtagaggtggagtctagaggcagtaggccttcttgagctgtggtgggctctgcccagtttgagcttccaggccactttgtttacctactcaagcctcagcaatggcagatgcccctcccccagccaggctgccaccttgcagttcaatctcagactgttgcgctagcagtgagcaaggctctgtgggtgtgtgacccatcgagccaggcacaggagagaatctccttgtctgccagttgctaagaccttgggaaaagtgcagtatttgggcgggagtgtcccgttttttccaggtagtctgtcatggcttcccttggctaggaaagggaaatcccctgaccccttgcacttcctgggtgaggcgatgccccaccctacttcagcttgccctccatgggctacacccactgtctaaccagtcccagtaagatgaaccaggtacctcagttggaaatgcagaaatcacccatcttctgcatcgatcacactgggagctgcagactggagctgttactatttggccatcttggaatacccactccagatttcttttcttaaaataatacctttctaaatacctgttggagtgcttgagttggtaggggctatgggaatgtcatctgactgattttgtcagaggactttgtggatttgagacagggtgggtaggagaggatcatcacattgattccagaactaaacttagggcttgaggtcactttaggtggggtagaagtggggatatctggcatactatgagatttagagggccactgtagcctcataggtactcagactttatagtgttggtttaattagggattttcttaagctggctgccctgattcaaggtgatggttatctgagcaccaggtaaggcctgggaagggtagaggcaatatggctagatgtccatttcctataatctctaaatttgtatgaattgatgcattcatgatctgagatcataaatgaagtccataaagtccataaacctcctgatattttatgtaaaacttaatgcatatgtacacttttctagagaggaagtcttgagcttttggattttaacaggtgtcctcaacatattgaaaactgcttcagcttgatgtccaatttcagtgctaacaattgttgcagaagtgtttttgagcactaatcatatcaattgcaataatggtgctccttggggtctcaggtgagctgagacttggagccttgggatccagaactcacccttaaataagcatagcatctctcttggtgggggtctgtggaggtacagggaggttggagagagttggcattacccaatttagtgaggttaagataaacactgcagagtaatccatggctgacctcagtgatgagttatccattttgcaatctggccttttattacattgctgttgactttgttgttgttgttattgttacatgtttgtttttctttggatatcaatgcttttatgggaattatttctcatttcgttaatcctagcctagtttccttcaaaagggtcttgagtgcaggtagcctcttcagggtagagtaaaacaacaaaaaagtcaaagccggaatcaagggtgtgttttctatcatacagaatattatgatggaccactgaggctcagtgccactagggactctcttgggaggtgcatagaatgaatattaaaactctctgcctgaaagatggaataaggcagaatgtatttactgttcccatttccccttggccaaggattacttcatggggcattaactgtcttacatttccaggtttactcagatgccctgcaggttcccacaggcttcctgcatgctgatagcagaggagccctggggcacaccatgagagatacatgatacagctcaggcaaatgctatcaagttataccaaaggcacctctttgcagcagctggcatgcaaaagtgaacagagaggatatgagggcacaagaggtgtctcatacaccttctccattctagcatctctcctcactgagaccatggtaatcttaacttgtaggcatgcagtgttaataaatgaagccaaagtgctggatttgatccctatgtaggtcacttagctgcccacagtgaaaagtagcaccatggacatcaaagtgaacaaacccctgcctgagtacttatttccatggatcaaaaggatggggaaatgctgatggagagttgaactttataatcgggaaaagtccattcaaatgggctattttattcaattcccaaatagccctagactttatataacttacatggtggaattcatgcttttactaacaagtaagttaaggctcatagaggctgcgtgacttgaccagggtcccatagttaatagactgaaatgtattccttcttacttcaaacttgttcacatcatccagctctctggcaacacattactggaaaagaaaaatagttcagagaaggatgtgctcatgaggactgcatagagttgcaatcttcttgggagggtacacatgcatgacctgccaaatctgaaatattaggaacttttgcttgcaacttgttccatctacagcatgggtagaggtggcaacagagaggtgactggggagaggtttgcccaagagacagcagggagattctgggaataaacaggagttgggttctcaatttggcaactaagcattcttttgttattgcactttctcaggctgcagcagagcctgattagctttaaaattcatttccattggtttcttctttcatgatagttttagatgttgttttattggcattcctatagatgtaatttaaccttggtagtactgatgaactggttgttctcttgtaaattttagaaggaaggtggacagtctgggagaaccagaactgacaggagcaatagggtgcattgctaactggcaccctgtgctctgaggtcaaaaggaaacataggaaggtggtttctgagggcaagacctaggctcctctctcaattctcttttgatttcaaattttgtttcttaatttactttaaacacacacacaaacaactttacataaatgtgtacatatgatttcagtacattttcctaagtgtattcttttctttccatttttgtttgatgtctcccctcttctcctttttgtccatgttggtcccctaactctactccaagatagttcatattaataacctagtataaatcctggcacatttttctctatacacatataatttatacatatagaaatgtatacaagtttttcaggtcattgttttataaaatgggatattatatacttattttgcatcttgattttctttttagaagaacactattgtgcatcatagaataaatacaaaaaagtttaaaacatatttaggtactttaaataataatgaagcaaacatttgtagtatgtctatctacccactgcattaaagaaatagggaattaccagtgccttagaacctgctgtgtgccactttgcaatctctttttcctctttccctcaggaactctactttctggaatcagtcctgtgtttctctttctatattttgcttctgttgctcaacattactttataaaaattttttcatatcaaaaggcagtgctctaattcactctttttaatgggtgcataatattccagtctgatgatatgttatatatgtggtattctccttcctgtaaattataattttatttccatcttacttttttctaccatgcacaatgttgcaataaatatcattgtgtatttgcactggtgcttttatatctggtgcagtccaggaatggggttgataaatagaagaggatatgtattttaaatatgaacaaatactgtcatatggcttttcaaaacattgtaacacttcacatactcaagcaatgtatgagcacacccttttcacacatccctgatagtgatacgaattattgcttttttaaattgtgccagctgagaagtgtaaagtgatatttcattgttattttaatttgcatttctcggactgttagtgaatctgagcatttttgcatttgtttgtaggccatttagctgagcacttctgtaaatgggctattcatgacttcttgtttctacaatggagatatttgtctttttcttgtctttccatagtaatatttgtttaccttgtttagggtatattttgccatcaaatatgttactttttaatgtagttagatgtctgtttttaactttcacatcttctaatttccagtcttcgtagagaatgttttccccgtccccacctttaaaaagtgtgtttagtttttaagattctttttaaatctttgttttcattttttatatttaaatcttaatccatttagaaatttatttttgtgtttatagatgctagaggtccatgtttactttgttcctgatgataatgataataacaatagctaacacttactgctgctatgtggtaagcattgttatataggcactttccacatattgcatcgctgacttggccttgtccctcacaactctgagacataggttttcttaccatatccattttacacttgaggaaaatgaggcacaaaaaaattgagtaattagcccaaaggtcacagaggaggtcaagtggtgaatgtgggatttgaactctgggaatctggcactgaaatccactcttattatagttcctcttatttgttaggccaggactatttatgaaaaaagccactcttttcccactgaattacattacttttcttgtcatttattaaattctcacatataccagagtttatttctcgattgtctgtctgctccctgatcttttcatctattcctagcattttttgttgagttgatgatcatggtcgtataatgtctgatatctatgaagtccagtcttctgtcattgctctttttttttcatttatttttttttgagacggagtctctctctgtcgcccagcctggatgcagtggcgagatctcagctcactgcaagctccccgtcctgggttcatgccattctcctgcctcagcctcccaagcagctgggattacaggcgcccgctaccacattttttttgtatttttagtagagatgggtttttaccattttagccaggatggtctctatctcctgacctcgtgatccaccctcctcggcctcccaatttccaggcattcatacttttatgtataatttatgtttattttattcaattaaagtagccgatgggatcctaattgaagttgtattaaatcaatatgttaattttgggacaattgccatgttcatactaattactccataaatttaaaatatagtatgtttcctcttcattcagaaattaatttatatcttttatatatttatattttctttgtgttgtcttttaaatttttgggggagatgtatttataaatattttaaagcttttgctgatataaatagaaatatttttctcatttctattccttagtgattgttactagagttgagaaaaggtactgattttgtatattttatatataaatcagtaggaagagcactgtcaatctaatatttttaattaattaaacaagaaaaatacattcatgtcattaagggctgaaacagcttttgataaacttcagcaggcattattaatacagttcaggtaaaattgaaataaaagatgattgcttagatatataaagattatttactaaaaacagcaacagatttaacaaacatggagatcattttagttaaaattagaatgcatttagggatgtcccttgttatctatattaaacattgcatttgctatagcctccaaggccataaaacagaaaagtaaaatagttggtgtaaatatcagaagaggtaaaactatctctttttgctgatactataattccttatcaagaaatttaaacaactctagttaaaaacttacagaatgaataagatactttgataagctatctggatataagtatataatatcaatcacttctttattctatcaataattaaccatttttagttctcaaggttcaaatttcagagaaggtggctttgagctataggttggatcatttcccatgacttggacagggagataaaagcttcttaggacggccccactagactctaccaagtggaacaaaggtgattgctcaaatttgagctgaaaggggaaatggatgatagacagaagttttttaaaaaataaactccacatactgtatgtaactgcacttcagaagtcaggtgcctagcttttaagaggataaatctaaattctttgcctgcttcttctagaatccttcccaaacccttttccgttgccccctccctttttacctgttctacactgcatcccaactggttgttacattgtcccctgcacacgttttgcacattcctctgttgtttgcccatccattcccctcactagacgtattctattcctttttctttcatgtaattctgattcgccctgtagggctctctgcacgttcccatcaaatgcttgttccattacccaagaccaggtcccttctcccaaaccacaggggctctaggagcccactctaccaaagacctgaagaacctccagctgtcacagtctcttcactcctaggactgaaggacctgttctcttctccgcatctgttcctgcatccctgtgacatctgccccaacgaaatcagaagaggagaagggaccaggactctcacttcccagactatacattgttcagcttcctctttccccctttctgacatggaaatagcgagcgaagatttgagggccagttttttcatgttgttgttttgggatgttttttggtgtgctgtcatagattttattttttcatttagagaagccaggtccaacctaaacagtttcatactcttaccaagaggatgctttgtccttcactgtttcaagtttgtacaggattcaggaccatgttttgcacctagtaaatgagtcttcgtttatccaaactattttgagttctcacctttatgcctttgctgttgctatgtcatttctcctgaaggcccttctccttctctttgttcacttgattactcttagtttttacatttcagctcaggtgtcaactgctccaagaagcctttctcgagctcatgctccccttcaccaaactgccacaacaacctgtgtgaatcttgatcaccaagcttacagtgctgtttgagataattatctgctcaagtttctggtgttcccattagactgtcagtgcctcatcgatgtgctcagcctctagctgtgaatggtgcacaggtgaccccagtggatattttttgaataaaaaaataaatgtatggatgaactgagcaatgttttgttaccatggatgttggtcatatcatttcatgatttgctatctaattttgccatttctcctctaattccattaccctcccagctcttgtttctctacgtgagcatgttgtgtgaatgctgagtgaacttttagtttactatgcattcatagtgcattcattccagtattcatttcttccttgggtcctggcctactccttccttttctctcatctattcattctaatctcatttgaacatcaagctcctcccactgtcgatactttatcatcattactatcccttttagtaacttagtaaaaaagcacctctaggatctttcaacttactaaagacttttcctagaggaggagacaaatctgattctgcaaactttttttttttttttttttttgagacaggatctcactttgtcacccaggttggagtgcagtagtgcgatcacagcacactgcagcctcaacctccccaggctcaagtgatcctcccacctcagcctcctgagtagctggaacgacagtcatgtgccaccacgcctggctaaattttgtaatttttgtagcgacagggattcagcatatttcccaggctggaattcctggacttaagtgatccacgtgcttctgcctcccacagtgctgggatgatatgctgcaagccactatgcctggctggctctgcaaacttttacttctatgaccctttctttctcttggtttctccttgacacttctccccaatgaacccatggtgcaatatgggagttggtgccctaaaagtgactacctcctaaaatcactcacactcaattattagtaaagttcaaatgacaacttttttatgataattgtgttttaaaagaaaatctgagggatagtaaaaacaaaaaaaaaattcatgccagaatttcaggcaagcaccagttgagaatgtatttttgtgtgagcagggtgttatcagtaaggttcaacatgttctacataagggactggaagctctgcccgggatgtatgagggcaatcttgcctggcctaaaggttggactgtaggtagcacaggacttccgggtttggagatttagaggataagtctaggcttcacccaaataccaacaataagaacttgagtagttcctgggacctccctgagcctaagtataaaatgaggacagcaacacatatctatactgccatgctgttataagaaataaatgagataagaaatataaagccttaggagtcaatacagtgcaatggtggagcatgagtattgcagagtccgattggttgggttcaaactctggacctgacactaattaagggttaatgaccttgtgtaagcttttaatctctgtgtgcctcaatctctctatccatatgataagggatacaagacctttctcatacagtggtttaaagatgagagtaaataatatatgtgagaacacaaatagaagagcatgcatatgaatagcatttaatgctcagttaatgaggctcttatcaaagtgacagagggcctccatgtaatcagagaagggtccacttaaggctctattggcatttgctgaaggatcaagacttgctgtattcctatctatgaatagacctatggaattaaaacccagtacaagcattttttttttctacttatatctatgtatgctctttctctcttgccttcttgataattcagaagcagaactttgtcttattactgacttccagaagaaatttcacaactctcataaagtttgtgatttttgtagactatactgaacatttagtgactcccagggaggatcattttaatcagcatacaatagtttgctcttcctcttcccttccattttcttctttccctttctccccccttctctagttttttaatctcacctcctctccctgcccttttctatcctcctcccctctcatttcccttcctttatttcttctctcatttctactctttccccctttctccttccttctttcctgccctcctcccctccctcctcacctcctcccctttctccttttcccatccctccttccctccttccacttctctctcctctttcatctccctttctatcctccctcttctctcccttccccactctacttccccccattcctccctggagttctccctttttacttttcttcaagtgggcttatcaaagtattttttttaaataaaataaaggcaagtctttctgtaagaaaaaaagtcagaaaaacattttcttctcattataggaccaaaagtgcccttagagatcaagtagcccagtgatccccagactttgcttgttggtcgcgataccctgggcagcatttgaaagccaggccctgcctccagtggtggttctgaatcaaaagatcagtgtagaggcttggagtggcatttgtgtggggtgtgccagaatatatttattttaattcaagaagatttggatttcagtcctaagtctgtcacttgctaatggaaccatcttggctgtgtgctattaaaacttccagagcctcagtaacatttgtaagaatgtggaaaataatatcttcctcaaataacaagcagtgatcagcagattggctggcacatagtaggtgttaaaaattgtttcttttcttccttccttttgagtatggtacagaatcctggttatctctctcaacacacaggatggtgataaaggaaagcctgagtatttctgtgccttgtagcacatcttagaaagggagaagggctattcagcagcattgttcatgctcaggcccaggcccagctgcctctaactgtggtcatgagaagtctcagacactggcatgaagtcagcaaataaaaataaacaacatagccaagtatgatggtgcacgcctgtagccccagctactcaggaggctgaagcaggaggattgctggagcccaggagtttgaggctgcagtgacctgtgatcacaccagtgcactccagtatgggcaacagggaaaaatctctgtctccaataaataaataaataaataagtagtaattagaaataaataaacaacatttttgaggagaagggatgaagttgattaatgggtacaaatacaccgtttgatggaataagacctagtgttagatcagtaaggtgactatagcctataataatctattgtacccttcaaaatagctagaagagaataatttgaatgtttctagcattaagaaaatattaagataaacatttaagtgatggatatcctaagtatactgatttgacctttataaattatatcaatgtattaaattatcacatatatcttgaaactatgtacatctattatacatcaataaaaaataatttaaaaccccatttattgtgaattcactttcccaggactattttaattaatcatcataacaaccttatgaagtaaatgctatgattatctttaaccacattgacttggtaaaatgtctgtaggcagagcttttttatttttttgaattttggctactatttgcatgtctgtatcatttacgccgtcctttgtctgtgtttcttagatcccaaataagtactgaggggtcctatattcatttcaaccatactgtattgagtacctaatataaaaaatccagcctctagtttgaggagctgaaagaatgaaccctatgcagtcctgattgtctgggcttattttcacttgctctgtgaagcacctgagcccttgttggtgaaccctgctacagtccccactgagtttaagacccactcttttcaagggtccccatgttaggtttgcctccacaccttagcttccaaagctttgttcccccctgccaatggggcactctagccccatccacccatcccctctcagagttgtagaaaaggcttctatcagcaagaatccagagaggttattcatacatgggacacttgatagtggttcttattctttgaggaggaggaatacttctgatttaatggtaacgaagttctaattttggtaagtccggggatctgaggctagagctgctttgtcacaagtcttgtttgcatatgctgtgtatttctacccataccctcatccaacttatctaaatcttgctcctttttttccattcttgctgatttaattttatccctcaactcatggttccaaataatcccctgtgttagttgtgcctacagcaacttgtttaactctctctaccaggcaataaggtggaggggcaggggaaggataaatgcagcctacttgtgatttatcacagttggaaagaaaagggaaaagacatgcataacactttttaaaaaagaaccagagaggcagagagagaagagtgtgtggagggagatgaagggtgcactctgatgggaacagatggcccaaaaggtaagtgggtggcagagagtaaaaataaccagggagtgaccaagccttcattttctttgaaacactcacactttagggatatattgaaactgctaattttgttggcactttgacacctcctcctaattaatgagaaatttattaggaggatgactgaggtgagcaagctgcttacaaagagagaagggagagaatacattgaacctattcagcttggcggtcacgaccaagcgaggtgccattggatatgtggttacttgtgggtgagctcaagtagaagcctcgggctgggctcctctcctggggtggaacccttctgctgggctcctttcctcctggctccctgtactcactgctgctctctggtttaccagcatagaggcacaaccccaaaacaggcttcgtggggaccaaattggcttttggatctcaagtgtgtctctgagtcactccagtgaacacgttataggtcactctgtgcaggttagtggcccgaaaatctgcccttcaaaggaaaagaaaagtgaaattctcatgacttttacactttttgtcaaatcttctgcatagagaccttctgagttggctctacctagtctgtgattccaaatctcaagcaccacctgcaattgtccatatttttcacccacaggatgctcatgttaccaggaacttaaaagagtaaacgtggttgctgacattttagcgttcgtgggccagttttctgagatcaacactaggcaaggtactggggagtgtcttctaacacttttcagactttgaacagctaactccattttctgggagagcagggttacttgacaggtatctaaatcctctgtcctagccatccaccaagccacccatttgcccttccaaatcccttatgcagttcattatctgtgcaacatagaacagtcgagagcatgggctctggaggcccattgggagcttattcactcctctgctctgccattcatcagcttgagttgtcttaggcaagtcacataccatcctctgtgtctctatttctccctctgtaaaatgagatcactaatggcattcactaacggatggttgtgagagttaatgaggtaacagttataaagaggttagtactgtgcttggtataaactaagcacaaaataaatagcactatgacatttaacactataacatttaactttcaaaatgatttcatatgcaattttgtggcagtgtcttcatacattgggtagtacagagttttaaagattatcctttaataaatggaaaaattgagtcatgtaatggattagagactttcccaaggtttacaactacagaggaatagaattggctctagagctaagtcttctcattctagtttaattgtttgtttatttgtttctatgcaaacatgttcatactcttccttagcatgtttcatcctatctctactagtgcaacaagatgctgagaagagggaagaatgccacaaaactgcatacaccaaagatgtgtggctcaaaggatacaacttttgacttgaacagtcaccaggccttgtgatcttgaacaaatcattctgcctgtctaaacattaattaattcctcaacttttaaatggaatatgatgactatttccctttatatgtgtatcttagatgtaggcatggagctaaaatagaaactcaaaatgaagtaacagtaagggctggcagtggaatattattgatcccagaggaaaataaaaattttatttccaacgttgtgccaagatggtggcaagggtggggaaaccatgtgtcctagaagaagaaaacagaagaggttaagttacctctttattcttttgtttttcagattcaaaggttgtctttttaacaaaatgaataatgcaggtggtgattatggaaagatgttaaattttgatgatgttgaaatgtgagattggtatcctgtgtgtgaggagctcttgtctcctttttcaaaggcaaggttcctatgtgtgcactttcacagaccagccctgcccctgttgcctggaatctcccttctagcacaggctgctgctgaagaggtggttcagaccattttccaaggcaaatccaaagaaaataatggtttccattggttctccttattcttcagccttcccagcttcccccacccctactccagtcttcatgacatcactaattcatacatctattatgcaactcatgccaagaggctggttaaattggaaattgctctttgttaaataatactggtatagatggcatttccattttaatccaaagctcttgagattccaaaatccttcaaaactcaactaaatttcaaaaggtgtaaatcaagcactgcattttactgactctaaaggaaacgtttatgtgagagtagacctccctggagcttcttaaactagccaatgttaatcttggtgctgagacatattgatggtatgtcatatgtaataggttaccaaataataatgcatatactaaaattatgctaaagatttactaaaaatttaaattaaggcagatcaggcttatggctaaaataacatcatttccatgcacctgcattctgacatgctctctggagattctttgctatgggagtgtgccttgtgtataaatagcatttatgatgttggttgcactagaaaaaggaaagttatcaactttaagctccactgaattaacaaatacctgatctccatttttgtagaccatcaagaaatagcattgtgatcattgggcttctccctagcagttgatggtaaaaaaaaaatacatctaggagacctctcctctcctctcttctcctctcctctcccctcttctcctctcctctcccctccccctcccccttcccctcctcctcccctgcctgtcccctccttctcccctccccctcccctcccctccctcccttcccttctcccttcccttctctcttctcttccctctctcctcccctccccttccctctcctcccctctccgctccctcttctcttttctgagaccgggacttgctctgccacccaggctgcagtgcatgatcatggctgaatgtagccttaacttcccaggctcaagaaatcttcccacctcagcttcctgagtagctaggaccacaggtgaaaatgatcacacctggctatatttttttctatttttttttttttgtagagatgcagtctccccatgttgctcaggctggtctcgaactcctggctcaagcaatcttcctgccttggcctctcaaagtactgggatcacaggttcaagccactgtgcctggctgagatctctatctttaatattcctcttccctcctgcttaattgaatgaggaaggggcagtgtcatacaatggaaggagcatagtaactctaacattaataggttgtgtggccttgaacaattcactcaactgctctgaactttagtgtgtcatccataaaatggagctaacagtgactagtttgttttgagaatgagaaccaagatgcgtaaagttcctgacacaaagccaggtgcctagtggcctttagttcttatgacagctgcaggactacctttgtcactgtgcttttacgtctcctccagtgcctggtaagaagagtttatgtatatttcacctgtgtgagtacaaggcccaacttctaactgttaataagagacaactttgcctccctcacagctggtacttaaagcgtcaaagaatatctacactccagatacttgttaagataattcagtcagaatcgactgcaatctagcacctgccagaggcttgctgaaggcatctgttacttatttattgagcacatgattatataactcttgtttactgtacacccagcactgttctaggagtcttaagaatattaacttatttaattctcacaacaaacctgtgatataggtactatcatccccattttacagttgagagaactgaggcacagagagggtaagtaacttccccaagatgacagagctagtaagtggtagagcagcatttgaacctagatggtttggctccagagtttgggaccttcacaactatactatgtaagaaagactggctaatcgttatgttcaccagccattcttccagattcatccagttctttctctgagcttagtgaaattatcagaaaacaagagacccaaacatgtgacttcagcactcccttcccccttccaacagcttcatgaccatccttcagttcctgagtcacctttctagatggatattctgtgtcttcgacaaactcctggtaggaattgtcttccatgttatccaacagttctaacatgaaaacccatgtattaaagtatctaaacaaagtgtgtttctgcataggacctttccagctttatttgctatgaaatgaaaatgatgaagtctgttagttccctttctatgaatattttcattgctattactctggctaacttctgtgctcaggtgtagtctccagttctgcctagatagttgctgatatttactttctctacttcctttagggggcatcttttctgtttttatccctgatggttctgttttcttattgattaatctcatataatgcctctgaatctgttggatgcagggaaagtataaaccataatccaataagcagcttatgatgattttcttaccatgtaaaatgtttcaaggtgtgtggactaaagtagaaggagatgaaaaaaataatgataaattatatcatctattatggatagctaccatttgctcattgcttactttgtactggcactgtgctaagtgcattacctacattattgtttcttaatcctcatggacatggctaataaatgacagggctctaattcaaaaccaggtctttctgacatcaatgcctgtccttgtaaactacactgtatatgaatttggctcagacacatatctcacattttgccctagtgaaacaaagtgtattttctccttttgaccttgggtgaagagagttgaatacaagtctttccatttgtaacacactgtcatcagtagcacaaggcctccctggttttatttatttttcccttcatccctaattatatcttcaatggcctttccctagagatacccattacaatagcttttatatatatctttaaaaatgcatatacccttgtaagatatgtaacatgcttttcttgttatttatttaaaatttattttactggcagcatgctgtatatcttaatgcatttttttaccttttccattcaacactgtttataagatctttcatgttgctatgttttcatttagttggttttctgtaactgctgcatagcatttctctgtatgcatccaccacatctttgcatctgttcctctagtgctaaaactctgcttcaattccacaattaccaatagtgtggtgtgtggccctgagcaaaaattgcttggggatatattcccaaaagtggtgttcctgagttatagggcaaataatgcttaatcacaccaaatactttcagattgctttccagaagggctgtaccagttcagattaccaccagccatgcacaagaaaaatttctaaactgtctctattcttgacaatacttggcattatcacctttgtactcattgccatttgacacgtataaaattgtatttcataagtaaagttcttctgcaagtttggaaaaagttgatttggacttgaacatgccactaaggctgcttaaaatgtcttagatgggatgctgattgagtgaatgcagaggcagaggaggagcaggctctcatttgagccctccttgcaattggtttatgtgtctcttatgacaactaacattgttttgcaatatgcagtgattatttgtgtacttgtctgcagcgagcaccttttggattgtaaattgcatctttcttccttacctgtgtatgccctcaatgctttgcttgttgcaagactccagtaagtgttttctgaaataaattgtctgatctctcgaaggtcctgcctgacaataaggggccattggctatgaaagggtggtaggatctaggagtggaaagtcacagatgattattttctattctaatagggtgatcggtttatttttttcttttcttgactgttttcctccctactttaaccagaggtgcttgcattaggatagatgaactatatgaaactgctctggtaaaaccaaacttttgaacatactggatttttccccctaaattgacaactaaaaatcatgccatgctattgactcattgtcctcttcagtaatcttctggttgggattgggaagggaaatttccagaactacaaacacttctcttagggactcaggtcccaaccttgctgggcagagtgcatgatgtgtttcataatgcatgagtgtttatttaacaaacagcaacactttttaattaaactgttgttgaagatacagactgtataacctttctccaaggcctggatgctcactggcccttccaagatgctgacccctcgctagctgcaggcctctggggcagtacatgctgtgagagttattacaagccagctggattagagggccacctctcttgaatcattcagaagctgaagtgcaggctctgggatggagagtttctcaatatgccaaagctattggaatgcaggcaggtctggagacacttagctggaacctgggggaaaagagtgttcaagataacttcatagaggaaattccctaccgcttttggctttaaaggataatcattggttcttgctggtcttgtactactatttcctgagctactctgaaatagaattgcttttaggtttcaggtcttcatttatagagctatatccctaaaagattagatacgtctcagggatgtttttcaggatgctttttcgcatcatggtgattgtattagtcaggttagacttgattatgctgcagtaatacattacttcccaaattttagtgacttagaacagcatagctttacttcttattcatattacatgtttaacactgggtaacagtggggctatgcttatcttggacgttcagggacctatacgctcagaagcttggctgctttttgatgtgaccatctcgacatgagtctttagggttttctacagcagagaaagaacaagaaataaattgtctcttaaatgttcttaccattttcattggccaaagcaggtcacatgatcatgcttacctataactttgtagagaactgtaatttttctgtcttctcagagagaaaagaggactggaaatgacagagaatatgaataacatataccacagtttcattgggcatgagaaaatggtgatactttgatagatctcagaaaattacatacactcagcaccatatacatgcccttgaagagaagagaccatagactcttaaaaatgtaagtatctcagaggagattttggccagtgaatccaaattatacagcttggaagtctacaggtttatgccataggggacacagaggggaaaatgaggaactaagatgggaatcttgcccacacatctccttcaaacagggcagtataggaaagcatatacttccaaaatgatatgattttcagtcctactctacctcgaacactcttcctggaacatactccaatttgtcatcggctcctcttaaattcagcactcagtcatgaaaatgttctttcatacctggtctcatcagtgtagaggccagaagacctgttggttttccttgctttggatttgttattttggcaattaacgtttctgacaatcatactatacctttgactcattataagcctcatgtgggtttctctactccaaggaggcataggagtttaaaataggaaaacagtagtacgttgtgatggattgtatttttcaaagaaagtcacaataatatttcccatcccatgcactcttctgcaatgtatccttgacattctgtcatcaagattaagaggtagactctctctctaccctcttgaatgtggataggccctatgatggcttcgatcaataaaatatggtggtttaacgctgaggcaggtggggcacgatgtctcacgcctgtaatcccagcactttgggaggccgaggtgggtggatcatgaggtcaggagattgagaacatcctggccaacatgatgaaacccagtctttactaaaaatacaaaaattagtcaggtgtggtggcacacccctgtagtcccggctactcaggaggctgaggcagaggaatcgcttgaacccagaaggcggaggtttcagtgacccaagatcgcgccactgcactccagcctggtgacagagtgagacttatatctcaaaaaaaaaaaaaaaaaaaaaaaaagtgctgaggcagtgaggcagctctggaaatagcccttaactggcttggcagcttctgttttctgactcttagaagccagttgccatgtaagtaatgtgactaccaaaaaatgaccacactgtgagaagcccaagtgtggtggagaggccttggggaaagagataacccatgaggcaagaaagaggcccaggaggtcccaggcatgggaatgaagaaaccagcttgcacatcctgcccaggctacaatggactgtaaccacatgagaggttccaagattaaaccactcaattgaccccagccaactcatagcaccatgagaaataacattgttttaagccactatattttggaatagttttcttaaaaatataaagtgatagataaccataatagaaatttgtgctagaggaaaatccttaagactcttgaaagccattttgtctaacaaagagtgtaaataagatatggccttaacgatcctaagtaatttttctagttaagaaataactgtaatcagttgagtgtttttccactttatgtgacttcagttgaggctgcaatcatttggtgtctggatgagatgggacatccaaggtacctcattcacataaatagctggcagttgatgagataactcagccagagagaacctatgcatgatctctccatgtgaccaaggcttctcacaggatggcaactgggttccaagaagggctatctgaagaaaaactattcttagaaaaccaggcagaaaaaataaaatttcttatgacctagcttcaggagtcattcattgtcacttttgctatattttgttgatcaaaagcaaggcaaagggctctccaatattcatcgattaggggactacacaaagggaaatattaggagtcatggtttattggggggctatctttggagacaagctaccttgatggatagagaaatgataacggaaataggtttgatgaaaaacgtggttaatctgaattgcagtaggtctgatggttggttggcaagttgtccttattctggtgtatgggtgaagggaataagcagtgagttagctcttacctagatccatcccctagaaagtaactgtgtccagttatcaatgggcagggcttgctgggcgttaagcacaggtaacctctagtcttttactatgtttctgcgacagtggcataaaacagctttttaatgagacctactgagatgcactgacagatctcttcctttccttttgtgtctagcccatccaccttcatgtaaatgatttatcaagaaataagacctaggattttgagatgggtacataagagcaaaagagaactaggatgagatcattctcttttgcctgcccttcagcattctcaatgcaagcaggttggggttctaaaggaagagcagggatgactggaaccctatagcagtgagtctgaggaatgggatcatgggggacccagaaggaggaagcagaactggaagatgtttccattctgtgaaagtggcttttggctttgaggcagcaacagtaatatttcatgtcttccgtggtgtctcctacctttaaatgtcagtctctgcagctgccttatctcctgtagcacatttcaattaggtattccaaattatactcttttcttccaggacaaatatgccagaggtgatatttactgttacagcagcatttaaaatacttagggggaaaaaatcctagtgaatagcaatttctcccttataataataataaagcacaataataatggagagaggaggtgaattctggctttgatgccaataactggctgacttaaagtgaacatcttttgtctccgccctcttttgtccccctcctcctattcccgcctcagtgtgaaggttatagtgtttggctctgtcaagagcaacctcacacatcttcttcactggaggctcacaaatgctcctcagaatgtctatttaactatctctaggtaggactgggctctgactgggctcctacttcacccattacctgtttcttcctttgtcctgagaatgtttgcatgaagccagaatctctgtttgtttagaaatttaccaggcaccactgcttactcctcacctatgggacattgtaggtcctgatggaacaccccggcctcctctctaggaggtatatgggttagaaacttatgtattgtacctttccttcttggaatcaagtccttggcctggtaatgaaggtccttcgatctggtctgcattttccagctccatctcctactaatctttatatccttatctactgtttccctaggctgttgtcttcacggccgccatggtaggttttgcctatcatcccaaaccttgtgcaggcctaccacagtacttgacatatggtgggggtctcagtcagtattctcccctatatttagaacccttccactagatcttgtcttcatatttttgattcctgctcagggatcagattatgttccatgtcctccactgagccttttctgacctcctcagcgcactcagtgccgttccctctctgaatttctaaagtgctcagcagcagcagcactcatttggcacttggtatatactatcttatgctattttgtatgaccatatgttgtctatacaactacattataagcacctgatagggataactgtgccctgtgtgtttttcctatccctttgattctaagatagttccttgaacattgaagatgctcagttaatattcatttattaagtagatagatcaaggagtaaatgaaagcaaggatcctaagaagcctgccttttggtgccaatctattcaatttggaattcacaaacttacctaaaacaaggcctttcaatttcctgtttcccctgtaaacagagctctaccaccaggatttctcagaagctctttctccacactgaaccctaaaactgaaggttcaggtagagagcttttccagtgtgagagaatttttaaagcatctggggtttggcacatccagtgctttgaaaatcaaggtgtcttgatcattgggtgaaggggattagaacagcaggctgtgttttcaagttcaagtccataagcagacaggaatagaatcccacaagagtttgttctgtctctgccatttactagttaatctctctatgcctcaatttccccatttgtaaaatggatttaataatggctgtctaccttataaggttgctatgaggtgccagtgtgataataaacgtaaaagtactttgaatattgcaaaacactgtatgaatgtcaggaattaggcaggcaacaactatttcttgggggtttgttctgcatgtagccctgcactatgtgtagatagaggcctctgtacattacagaagactggcagaggcattggggattcatcatggctggaattctggttctcagatagatgaaagctggaaaaagtattatagcctagcaatcacatctgaaaggttggcagcaacaattgagtcagagaagacgggaggtgaagtattggcaaaaatttgaccctggtcattctttgaacacttcagatttccacagattctatccctttaacatttctgaacgttatgattttgcttcctccccacactggcagctctgcctcaatgaaaccgtgttgcttttttggttgatcaattgtgcccaacttcctgatcatacttgtcctgagagcctgtgttaagctcatgccggctctcccaccccgcccccaacgccggccaaaaaaaagactctctaaaaacaggtgcccccgatgatctcacactgctgctggcattggcagcagcccagaagggccaaatggtgacttcaggtccagggaggctactgtcctcagctctgttttcatgtaaatgtcgctcctgctgaaaggaagtggatgcaaaaaaatatctgctatggaagcagaactaccccagactaaaatgttggtttttttttttttctctcccccttttcttttccttcaagttttccatgtggcatcagcagctgagtaagggaaagctaagaggtttaagtgtgctggggctgggtgggctagattaataacccaaagccttccaagctggcggtgctgggtgagacaggccaaccagaaagcgttaggttatggggagccctggccacagagccagaccctaccagggtggaaggtgaaggagcagcgagctctgcgtgcttgccccgagcccccaccttccttccttcctcctccctctggtttctttcctcccattttatcgagtccctctgagatggctgcgcaccagtggctccagcctctgaccgttgctgccctctgctgggaagaaagctttactcggtgtggaaagtgctaagctctaccagggaccagcttaatgcagaccaagtccacagtctgtggctagtgtgtgatttggcccagaggaaggaaggacaattcagaaaacccttgcaccacagtgtttccctagtggtttcaggtgggggcaggactttggaatctattagggaaggattgcttgaatcctcagagttctctgttcaagaggaacatccctgggagaggagcctcctggctcctctttacctgggtcagacatgatgtatggagactccaccatggatgacccttaaatatgatggatggctttagttacaggacacaattctttctcaagggaaggtgaccaaaagaagttgggtcttgaaggggctgcaggatgggcctggaagtctcttggctctaaaggaaccatcatagaatggggattctgagcaaccaggaagcagcagaaaaatatgcaaagccagatgggagtggggaatattgcccattaatgggcaagagtacatagaaaggtagataataaactggcttcaccacttctcaactttccccagagctggctgtgccagtaaactgtgctcagctggctttggatgagagaaggacaagagggtgcctatctccagcatggctgtggggtcgccctgctccatctctggatcttcagcctagagtgcagcccagccaaacaagagcgatgacctcactgaccacatgtaattctgcttgagggatttattttcttccatgagctcctgccaagactcttggttaaagctaatggggctcccccagccagtgagtgtctcctagttatatgtgtaaacaacgccaggcaggaaataggtttcctgttcttaatgggcttgttaaacctcttatcgagtggggtttaaatggctttattatgaataataataatagtaaataaacattattattattagtagtagaaaaattatgatgtcagccctgactaccccttctcattttaatcttgccaacgtggaggtctttggcctctaagtgcacaggaatatggtgagtgacactgggacttataactggagaagatggcagaattcatcttcgttgcctgcagctttccaatcctgagcccttttccactttcatcgtgtttccatctccatcattcctttcattcagggttttcatgatcttattctatcagagaagatagaactacacatccctctccttctcagttttatttagcattgaaagccatggacagaggttctgaggttaaattgaggtatcgggtagaggggattttggagagagcagtggatgctggtaggggagctcagttggaagtggggctcatgttctgatcttcagtgccgaatgtctgtgtccctccctcagatttacatgttgaaacgtaatcaccaatgtgatggtattaggaggggggccttttgggaggttagtaagtcatgagtgctttgggattagtgctcttataaaataggcccaagggagcttgttcaccccttccaccatggaaagacagaagaagaactagaagccaccatctatgaaccaggaggtagccctcacctgatgccaaatcttccagcaccttaatcttggacttccaagcccccagaattgtcagatacaaatttttgttgtttataagctacccagtttatggcattttgttgtagccacctgaacagattgagatatccagtttatagctggaactggaggtataccaggtatcccagactttggtaatttatgtatcaggttcactattttcaccataactccctacaacagtattgattttctttacaccgattatcttgtttgacttaagtagatttggcatcatcttacaagcaatatgtctttgaaatcctgggttcaatgtgttagccaggttttttactgactgcatattgaaatgaatatctaagagctaaatattttttcctaaagttcatcatgtggcaaatgtgtcacaccctccagggaaaacataccacaacatctggagacactgctatagggtagtggttcttaaactttagtgggcatgagaaacactggcagagcttctaccagaaacactggtagatagctgtgctcttccccagagaatctgattcagcaggtctgtggtgggaaatatgactttgcaggttttttttttttttttttttttttgagacagggtctcattctgtcacccaggctggagtgcagtggcgcggtcttggctcactgccagctctgcctcccaggttcacaccattcttctgcctcagcctcctgagtagctgggactacaggcgccagccaccacgcctggctaattttttgtatttttagtagagatggggtttcaccgtgttagccaggatggtctcgatctcctgatctcaggtgatcttcccgcctcggcctcccaaagtgctgggattgcaggcatgagccactgtgcccggccttttctttattttttgagacagagtctcattctgtcacccaggctggagtgcagcagcgtggtctcggctcactgcaagctccgcctcccgggttcacgccattctcctgcctcagccttctgagtagctgggactacaggtgcccactaccacgcccagctaattttttgtatttttagtagagacggggtttcaccatgttagcaagggtggtctcaatctcctgacctcgtgatccacccatctcggcctcccaaagtgctgggattacaggggtgagccaccgcgtccggccgccttttatttttttttgagatggagtctccctctgtcacccaggctggagtgcagtggcacaatctcagctcactgcaacctccaccttctgggttcaagcaattctgcttcagccttcaagtagctgagactacaggcacccgcccccacacccagctaatttttgtatttttagtagagatggggtttgaccatgctggccaggctggtctcaaactcctgatctcaagtgatctacccgcctcggcctcccaaagtgtccagaactcctagactcaagcgatcctcctgcctcagcctcctgagtagctgcgactacgggcttgcacccggaaactgcagttctaacagttgctcaagagatgttgatatccaggggccacactggcagtggcactggcctggagaataagggcctgttctccatttccacatgtgaaaatttcctcatttgaaaatggggataatgtgtgctgtataaaatgaaataattttttcttggtgccaatctgtctatgcaatggaatgtttgtgtctccccaaaattcacatgtggaagccctaactgccaatgtgatattaggagatagagcctttgggaggtaattagatcataagggtgaggtccttagaatgaaatccatgcccttagaaaaaggaccccagagagttccctcaccctctttctgccatgtcaggatacaatgagaagtaagaagtctgcagtacagaagagggctatcaccagaagctgaccatgctggcaccataatcttagacttccagaatgcagtactgtgagaaataaatttctattgtttataagccacccagtctatggtacttagttatagaagcccagatggagtaagccaacctgtttggagtgtttttgagctgtcatgcttttcaggttcagcttaaagctcagatgggaaatacaggaacttctgcaggttaattctggttctaagttcaagtcctaagaataagcccattatgcaattctgggtggccaagcagttctccagcagcccccaggaagtattctatctcacagaatcctggcaaaaggagacagtcttctcagtctggtcaagggctatgttgagtgtgagggaacagaggtgaatgtcccttgctgtgctcaccatgttctgagagacaggcagacaaagcgtaatttacaatttgattaagtgattgcattggtgactttttaaagccgcccagtagttgagccccctttctgcatttggaagtttacccgtatgagtctaaaagggagacagggccctcattccatgactgaggcccccaaagtctagtctcactttcctcagtctcagtgagccacagaagccaggctcagtgtctgggaggagaaatcctctctgatggtggcaggggtggggacagcagccccgctgggccctgtggggacagtcccagcagcagacagtcccagttgggcttatcctgtgatgttggcctcactgtcttggcagcctctggcatttctgttctctgttcatcttccacatatggttctcaggttcactcatcaaatcccttcccatttcacccaatcaataatgctgaactaataatggtttttagagcagggaagtggcacaatcacaacttattttaaagataactgaccactctctggagcatggattggaggatgagtgactcaaggtggggtgactagtgaggaggtgatgaaggagatgagaggaaagaggaagaaacactcacagagtaaacctggccatatctaatgactggaagcctgagtttctcttcaaactcagaagagaaaaatgaatttatggttttgggcgcagctttagttttgtctttggggatgagtatgtattttgttgggaaggtggatgccctgaagcagggttgggaaacaagattagaggtttttgaataagactgtgtttgaatacagcttggctatggtcttctccatttcaagtctgttcaacttaacaaatattgagcccttactaggtgtcagacattcttgggtatttagaatacagtatattttgattttggtgttgaaaaaggtgtggaggtatgcagggaaaaatctcacatgcttttacctacacacacacacattcacgcaacacaaagtgcacgcacatattggtcttgaaattccccaaggaccaaaatggacccatgtgatgagtctgtgttataacagggaatctaccgtaggttcttggctaccttttgtgaaccttctgtcttctttcctctcacttacaagtaatcccctgagtttttacctcctgaaccctgtgatttcaagggttcacaactaaatgcttcttatgctgagcaaatgtatacactgctaaaaccatatactcactccttgtggtgtgtttgttaggaagctgccacttctgtcttctccattctttggaaaaggctgtgagtaaacacagagcactggctatttacatacctagctcctgcttgctttttcaaagctctttgttcaagtgtcagtgctggtttgtaaaacatgaacagagttggggtaaaaaaagtaattacagttcaaatctggtgtttctactgacatgatactgagctgcctgactgctcttctttcttatcccttctctagttctgtcttttcagttgcaagttcactctgtctctgtctcccctctctctcccttgctctcactctcattctcttgcttgctcttctgtgtgtcagaaagctacacacatgaaaggtagctggcctcatagccactgggtagcccatccttgagagcctggccaccttcagtgtgtcgagatgccagggccctctatggctttttgcacagggaagttctagtgttttcagtttccagagcccacaatgagctgtcctccaaatccagatctaaaaccaaaccttctcttggatcagaccaatccagaagcactctatagtttcaggggtgtccaatcttttgacttccctgggccacagtggaagaagaagaattgtcttaggccacacatataatacactaacactgagatatagagtaagctcagttgttgacatagcaagtttgaaattacagcagaacttccagaaaacatcacaccagagttttctatccttccaactatattttacattttttgctttcagaggctatgcttcttcttctttgttcttctcttaattcagcccatgagcacatggtagattatgaatggatgctttaggaaccatgtagatggaggtttgtgaaaatttccacggaacatggcagttgagaattggtgactgatatggtctagctctgtgtccctacccaaatctcaccttgaattgtaataatccccatgtatcaagggtgagactaggtggagacaattaaaaaatgggattggtttctgccattctgttctcgtgatagtgagtgagttctcacaagatccgatggtataagggggtataagaggctaccccttttgcttggcactcattctctatcctactgccccgtgaagagatgccttctgccatgattgtaagtttcctgaggtctcaccagccatgcagaactgtgagccagttgaaccacttttctttataaattacccagtctcagttacttcctcatagcagcatgagaacagactcatgctggtaccacagagagtagagttctgctataaagatacccaaaaatgtgaaagtgactttggaactaggtaacaggcagaggttggaacatgttggagagctcagaagaaagaagacaggaagatgtgggaaagtttggaacttcctagagtcttgttgaatggctttgaccagaatgctaatagtgatataaacaatgaagtcctcagatggggatgaggaacttggtgggaactggaataaaagtaattcttgctatactttagcaaacagactaaatttgcatttcacccctgccctagacatctatggaactttgaacttgagagagatgatttaaggtatctggtggaagaaatttctaagcagcaaatcattcaagaggtgacttgggtgttcttaaaagcattcagttatatgtattcacaaagatatggtttggaattggaacttatatttaaaaggtaagcagagcataaaagtttgggaaatttgcagcctgacgatgcgatagaaaagaaaaacccattttctgaggaaaagttcaagtcagctgaagaaatttgcataagtaatgaggagccaaatgttaatcaccaagacagtggggaaaacgtatccaagatattcagagatcttcatggcagtccctcccattacaggactagaggccaaggaggaaaaaatggtttcatggattgggcccagggccttgctgctttgtgcagtctcagaacttggtgctctgcatcccagctgtggctaaaaggggccaatgtagagctcaggccattgcttcagagggtacaagccccaagccttggcagcttacatgtggtgttgggcctgtgggtgcacagaagtcaagaatttaggtttggtaacctccacctagattttagcagatgtatgggaatgcctggatatccaggcagaagtttgctgcaggggcgaagcccctatggcgaacctctgctagggcagtgcagaagggaaatgtggggtctgagctcccacacagagtccccactggggcactgcctagtgaagctgtgagtagaggactagcatcctccagacttcagaatggtagattctctaataggttacaccatacacttggaaaagctgcagggactcaatgccagccaatgaaagcagccgaaagaggggctgtatcctgcaaagccacaggggtggagctgcccaaggctatgtgagcccacctcttgcatcagcatgccctggatgttagacacagagtcaaaggagataattttggagctttaagatttaactgccccgctggattttggacttgcatgggacctgtagccccttcgttttggccagtttctcccatgtggaataggtgtattcacccaatgcctgtaaccccattgtatctaagaagtaactaacatgctttttattttacaggctcataggtggaagggatttgccttgtgtcagatgaaactttggacttcaaattttgagttaatgctggaatgagttaagactttggaggactgtgggaagggcatgactgttttttgaaatgtgaggattaagcataaaataatggcaaaccgcacaagaattattacaattcaaggtgagatttgggaggagccagggacagaatgatatggtttgcctctggggccccacccaaatctcaccttgaattataataattcccacatgtcaagggtgggaccaggtggagacaattgaatcatgagggtggtttctgccatgctgttttcatgatagtgagtgagttctcatgatatctgatggttttataaggggcttccctgtttgcttggcactcattctgtcccctgccgccctgtgaggaggtgacttttgccatgattgtaagtttcctgaggccttctcagccatgtggaactgtgagtcaattaaacctcttttctttgtacatttataaattacctagtctcaggtatttcctcatagtagcgcaagcacagactaatacaatggccaagaagtgatcataggatggtaatataataaacacatggaggggaaagtgagtgtagttgcaggttttcaggagaaaatctgaaaggggtgaccaaaaatgagtacctgaatgatgcagctttttgaaaaagtctatttgtaggtcattaacaaattgagattcaggaaatcattgtatggtttaaataggataaaatttttcactagaatgcttgatctctggggattcccagaagcccattcatgaaagtggttcattcatgcaacaaatattttaacaaatgccaagtatgttgtagaattattttaggtgctaggaaaacagcagtggataaaacaaaaattccttagagtttatattctaatggcgagtcataagtaatctacaaaataaataaatatacagtattctagatgatggtaagtgttttaaaggaaaaatgaaacaacaaatagtgatagtacaagcgggggtggtggtgataatttcaagtttaggtagggtaaagaagaagacatggatagacaggaagcccagatatagcatagtattccagggaccaaagcaagatgttcaggaaactagaggcctcaaattctcctactgcaatctgactttgtaccccaattaacagtgacagcatactgctttaaaataggaaataaagtggaaggaaagcaaatgcttgatagttgacctgacattcactgttgcaagattgggaacgtacaataaatgtcactgatggagaaatattcatgaagtaaaaatgtcagttttcaatttggcatgaggatggtttgacatgtattagtcatgcacagaatattatcataattaatgcattaataatacagctgtcctttttctcccaatcataagttaaaagggaggaaatagaggcaagtgaaagagcagctctcatcctgatcagaccttttctcttggcatttgtctcttcctctgcccagccatttctgtggcattggcttctgatcagtatcagtcttgatttatccatctcagttcttccttcacctttcatgaacaacaccagtggttttgtctgctgagggctttttccttaattttcagccatactttaaaaaatattttaaaagagagagatatatatagtaaaaatgagacataagcaaaatcaagaatataaaaatctcccataagctcactacccagagaaaactactattactattttggtgtttgtactgatctcggatagctggcgctgggatgactcaggggatttgattcttctccactgtttctcattctccagcaggctggccctagcctattctcatgtcattggcagaggcacgggcaagcttattctcacacctgctttttaagtctctatttgtgtcacattcactaacatcacaaagcaaatcatgtgattaagcccagtgtcaaggggcggaacattctgtcctacccatagttggaaggtactgcagggttatgtggcaaagggaagggtgaaaacttggggcaaaatttgcgacttcctatactgggtcaaaagacacccttgtttcaaggcttatgatagatgtttccaaattgctttctagaagggctgaaccaaccccactaatggtataagacttcctggctttccagttctctttagtcttgctgattctgggaatgatttatgaccttctgtctgggctgttttgatttgtatctccacctgtcttttaaggctgcacagtttttctttgtggtaattctttacttgcagaatacccccaaagctccctaagactctggtctacttaccttcttcatcctgatttcttctgcctgctttatctaacacttgtgctgaccaactcccagctatctgaatattcagtaatccatgtaggcctactccccaagtgttctaagttggtaggagttactacacatcttttaactttgctgcctacaccagcagtaatgtaattgttggtcctcattattcccagaatattggaatttttagggtcagaaaagagctcagaatccaatctcatttttatacaatattattccaaagatgtatgggtatttgtgtagatgaagataagggtatagatagaaatttgcatagaaaaaaggttgaaaggcattgccattgttaatatgctagtatacatctgtatatgggaattataggtgaattttttttttgcgatggagttttgctcttgttgcccaggttggagtgcaatggcacgatccctgctcactacaaccgccacctcccaggttcaagcgatcctcctgcctcagcctcccaaatagctgggattacaggcttgtagtaccacgcccagctaattttgtatttttagtagagatggggtttctccatgttggtcaggctggtctcgaactcctgacctcaggtgatccacccgcctcggcctcccataggtgaattttaaaaaatctttaatgttgcgtacagaaactgagggtcacagaagttaaataactcacctcatatcctaaagattaataatagtgaaactgactaatgcccagttctgctgattcctggtttaatgctctcttgagataataccacagtatgatctctgaggcctagctgtcttttgtttgattgtttgtatccaagctgtattggcagtttcttttggttttataagagtgctctgctgattgtgggttcacagggaaataaagaatgttttttaaatgattgagtcatctaagtcagctatgtaaatgtatatatatatatacacacatatatgtaatatctgtatgcataaattaccatgacttcaaaatttgacaaatggttcaggtaaatagtggattttatcttttaaatcacattaaggctcccaagtggatgcatcctgagttctggacacataatttatcataggcatcacatggattttatgtaattatattaattatttagtacatacaaaggtaagctctgcagaattagaatagaatcggataagtttttagggagatctaaattggtaagattgatcaaatttcttgctatgagtaattgaaggtgggtcactgtgatggagtgttcttcactggagctaagcttcactagagctattcggagtaattggggactggttaggagaccaatgcatcaacatctgtctataggaagtatggattcatctgctttgaaatgagtctttagtttgtttcctgcttgttctttatttctttttcacctgaatgctctttcaagaatattcaaaaacacaaaaacaaaaacttttcccctggagagtggggattagctcaagaatcaccatgatgatgagaagcagaaaacctggtttggagagtcctggacctggagaacaccaaaaagatgttagcatcttgagtatattgttctgatctaaagtcagatgttaaattttttactcacttagggctgtctgtgagactttgcggatcacagagagaatagacactgagaaatgaacgtgaactagtgggtacaaaggaaagggcacccgaggctgcttcatcaagctagaggagtgggaatctcagcccctgagaatgagcatctacaggctcttttttcctagtgcttctgtggtgtttgtttttcattgtgccacttggtttgcagaaaagaaaaaagaaaaaaaaaaaggctgccctggaagctgaggttttacaagtgctgagagaactgtcaacctattatagaattcagacagagactttcagctagagagggtttaggtattctgtgcctggctggactctagggactcacgcttgatcatactaggattcaagaacaacgcagttgtcactgttagcccatgatcccacacgtacccagacacattctctcacggcaagtacatctgcacctggatgccttctactagtatgacatacttaaaagtatcttggatatgccttaaagatcattgttggctgcttcttgatggcaaagtgctcagttagagccagtttaaacacatgtcaccagaactgaataaatagattttgataaaactgattcagtgaatatctcccttagggcgaagctcagccttctccacttcactggtgctatgaaaatcactagtcctcatttccaagctgtgtctgaattcagatttaactgctaaccattgtttaagaccgcagtgagatccacagggtagtctcaaggtgtgattaagacacttgggagtggtggtggttaaaaaaaaaaaaaaaatagagccaaagtgtaaggaggcaagctggaggcacgtggttatatgaggagaaaaattgcagtgaggccttctcatcaccctcttcagggtcaatgtgatggcttcgtagaatcaagtgcaagtctgtggctccattatctcaactggctagaagagagtgctactaaggcagaggtgggagcatgaaagttcacctaatagcttagttttgttaagtctcattgccacagtctgcaccttatcctgatgttctcactggaaaataactagcctagttcctgagaaggaattgtgaacagggcattgcctgtttgtcaaaaagttatttaaagtcactccagctcctcacttaacctctctatgcctgtttcctcttctcgaaaattacagtaataattattacagtaataatagaatagtacctatctcataggctttttgggaggattaaatgagttaataatctgaagatattgaaaaccacacctgtcatgtggtaagtggtcttcaaatgctaattgtttttatctttattaactgccatacccatgtttgattggcagctacatcttgtatgagtctttaatatttcatctgtaatttctgggttgctcctgccacagagaaggagcaagggagccattggtactactgatgaatattaggaggtggagacaccttgacaactgctgaaatgtactcatgcctgcctgcttgccctaactgcacttagtggcctggatttaggagctgccaatctcattacacaccagttttcatgactatcctcaacttactcctttcttaccactgctcagcacttatcctaagttgacaccaggctcattggtaatcatggactcacttctcccatctgaagtattcttgagttggctcccaagaagcattctctcttcatctccaactcaagggtgagctccttttcgtggaggaactaccctgtgtgtcctttccctccctctctccatcaccatcagcattcaattcagtattctgcacacacaggagtttagtctcaatttaaggtaggtcaggtttcattcacccttgagctccccttagcacccactacagactcattggagaggtgactattagaggtgcttgtggaaatgaatctcaaatagtgtccttctgcctgagtccttcattgaatccctcacttgtatacatgattcatactctggtagctttgatcattgtacaaaagaaaagtagtaactcttctttggggccaggccaggactgtggagcccaaagggcttttgtcatccctcctggaatggagttacctgatctggatattggaatgtttacatccttagtccttgaaaaggggaaaagttatgcttatcctcaattgtttaccatgacccttcctgtcacatcatactgttctacgaacacaagaatcatggctaacatttgtaaaccatctactatatgccaggtactctataatggaaggtattttacataaactttttatttaagtctgtgaattaggtataattcaatgcatttttaaagttaaagaaactgaggcttagagagctacttgaccaaaatcacaaggctactaattagtacaagccatttgatctaatactaacactaacttgttgtaactagcttgtcttgctcttaacttcttatctcagtccatttgtgctgctggaacaaaataccacagactgaataatttataaataatggaaacttatttctcacagtcctggagtctgggaagtccaagatccaggtgctggcacgtttcatgtctgctgagggctgctctctgcttccgggacgacagcttgttgctacttcctcctaaggggaggcatactgtgtcctcacatagctgaccttttatagaggttgctaatgccactcacgagggttctgccctcatggtttaactacttccccaaagccccacctcttaatacttatcacattggtgattaagtttcaacacatggattttaggcgacaatcagaccatagcatttcttctctacaggtttataaaaatacttttttgtcttgtatatattttcattatttttcctgcttgagtatacattttcatctctgaagacagggacacatttatggacattccttcctctgctctctaagactgcagtgattttatgtgcacatacatacattgaaaatgtatagttggctagatcctggaccccatataatagcttactggttactatacagcaggaggaactgaagagaaagaaagaatcaacagcaaaggtgcccatacctgttgcaatttgtattttgctcatgtcctagttcagcccatccaagggccaaccctgatagggcttaaatgttctcagcattagcttctcttcattaatatctgtttgtacctttctttgatgccgtatctatcctccataaggtacttattaattttcgcatcatcctgcttcatgttgttctgtccattatctgtaaggctcaaatatagaaagaaagtgcatccatatcagtgagagacagttcagagtgattgtgggtgagctcatggtttcctgcagctgcaggactagagagagctacttcatgatgttggagatctggagtttaggaagcctaggaggtattcaagcagcagtcagtcagcttgccttgcatttttaaaagcatgtctgcaattttatggtgtgttctcctctcccaccactgctgttttcctccattactgcttaggttgctaccctgagagagaagcagccatgctgattctttatcttttaccaaaagggcagcagcagcatctctttctaaattgttattatgaagagaatagctactgtggtttgaatatccccttcaaaactcatgtaaaatgtaattgccattgtgatggtattaagagatgggacccttaagaggtgattaggccacaagagctccattttcataaataaattaatatcattatttcaagagtgggttgttataaaaacaaacttgcccccgtctgtgtttcagtctcaccctcacttgcccttctgcctctgtcatgagatgacatagcatgaaggcccttgtaaaatgtcagcaccttgatattgaacttcccagcatctggaactatgagaaatcaatttgttttcgttgtaaattatccagcctatggtattccactatacaataacaaaatggactaagacaataacccatccacacgatacaatgcatgatgtagaaagtaaatacattgaaataaatacaatgcaaagaaggtctttgttatccaagacgctctgtcctgttctgcagagttaacaaccatcatatctctcatatgatacttcttactagaaaattcccaggcgtacacaggtgtgtgtgtttcacccctttttgcctttataaatggaattggctggaatgctgctgagatcccagctgctgaccctcctgtcaggtgccctgtggttctcattagggcctctgggatactaacattcacacaggcaatgtactttcccttcctgacgcctctggggcccacccgggaccgtcaaacagaccctgcaaagcttaggagatcaattccaacagaagtccagagccatggtgctcttggaaaaatcacaaaccaaaatatagaagtaagactttttcttcctaaattttaggaagaataagaaaatttagtggacttatttgtccactaaaatattaaatgtgaggagaggggaaggcaaaactatggatgattattttcttttttttatatttctgtaactttaaataaggatctatatttataatgaaaacatttatttataatgaaaaaaacctcaatctatcaaaaaaaaaacaaaccccaaaaagtattgccagttcccattgaagtggaatcttaggctctcaacttattaaatgtactaataaagtttttattggtaagcagatacaaaatcgctttataagaatccccagggaattactaagcattgttttgtaatagtaaaattggatcctaatgagcatagtggtagaagtcactgtctgcagaaattagaaatgaaatagagttgattctgggtatgtctgcattgaattagtagagtgtcttggaaagcttgctggactatgatgtgcacggtgggtaacaggatctcccagggtgttcaaagcagcatgattccatccccagcttgccctgcttgttgaaaatcactctctaggacagtattttctgtgctgtgggttttagcctctgtgggcctggaatattactgctggtgactgtggacccttccaaacataacatactgtctgccacaaataacacagttactatttattgagtgtttcttatgtgccagccaccgttctaagaactttcatgcatttacttatccagttcagtaatccggtaaagctaatagcatgttgattaccttatgattgaggaaactgaaacacaaagggctgaagaagattgtctagagtctctcttctattaggaggtggggtcatggttaaaaagagccacctcctaatcactaaaccatgtcacctctcagattagtggatgacatctcctgtatgtggaccatctgtctgtatgtgtgcctgcgattgttttccagatatttgtagagattgttgagattgaacaagcagaaattcatataagagccatactgagtttacatcagcttttggtcatcagtattttctgtcagtggatctaaaatgcgactcttttcttgtgatgatcctccaagtatttggctgttctaaaaaggctatggtcccaaaggctgaacgtcattgttctagaggaaggattttcctgtgatgatcctccaagtatttggctgttctaaaaaggctatggtcccaaaggctgaacatcattgtcctacaggaaggatttggtcatcaaacacacaccatccctagttctttcccaaacagctctcctccagctctgtcatgtctccaccaggatcaaatggcatggtctctcattctttgtgatgtagacagacactggtgagataaattgataagcactgctttgggagtcatctgttgaaatacaaaaataactttgtaacataacctccttctccttagaaacaattattggaggaatttatgaattttacatcttgtgtgagaggctgacagaacctccaatcagaaaggccgtgttctagcgtcaaatcatccatcatttgtgtaactttcagcaagtcactctacctctgtacctctgcattttcaatttgcaagagtggttgcagagttaaactagatgatggtattatatacttgtttttggtttgtctatttctttattttaaagaatgttcaatatctactccataacaggcatagcattagcttcaggatttccagcagtgagccaaacatacagagccctagttctcatggggttgatttcctatttgaggaaaagagacaaaaaggaaatatacaaatacatacattattaggtggtgataaatgctatggagaaaaataagaagaaataggggagataaggggggggggtgattaatttatgtagacattcaggaaaggcctcaatgttgaagtagtattcaagctcatacctgagaaaattagagcctgagccaaaaggctatcagggcagatggtcacaggcagccagtgcaaaggacctgaggtgggaatgtgcttggtgagttggaggcacaggaaggggcctgtgtggctagtacagagggaggaaggctgagagtagagatgatatctgagcttccaaggggccagagaatggaaggtttgggagtgagacggagccatggacaaattgaagcagagtgaatatgctctgatttatactgttaaaagttgatcactcctgcggagtgtggatagaaatttagggacaagggagggtggagggagactagttaggagactattgtcataatccaggtggcttggccatgaagttagtggcggaagaggtctcattctgggcatatcttgaagctatgcttgatggggttgttggtaattgggtctggggtatgagaggaagggaggggccagggtgacaccaagcatgtgattaaggcctgagcacctggactgatgagctgttgtttgctaagatgggtaaggctgagagagatgcagttttaggggaagggttggatattaggggttcagctttggacttgcatttccgtgtctaggagacactctagtagagatatgaaattggtgatggtatgagtaaggttggagtttagacaaaaatctaggctagaattatggatttgagaatcattagcatacacatgctatttagaggcttgagactggatggaagcgtagataaattgagtgtagctagtgggggccaaagcattgattctcttcccaaatgctagggagccctattacttggagcaggaattgtcagacagtgaccagattttcatgtctttttgtaaataaagtttaattggaaccattcatctgcatttctttatctattgtctgtggctgttgttgagctacaacaggagagctgagtagttgtgacaaagactcatggcctgccaaaggccaacaaaatctaccatctggctgtttagagacagggtttttgtttttgtttttgttttttttgacccttgatttagagatcaaggagataagaggcatccagcaaaggaagctgagaaggaatagccagagaggaaagaagagtgccaagagttctgcattgaaggaaagatggtgccagggtttgaacacacagcattagaatacgtgaggctgggcaagttacttccccataaggacggtagtagcacaggattggcataaaaattaaagtagatgatgcatgcaaaacacttacagctgtgcctggtatccagtaagtattcagtaaatgctcttacagcatctacttctatttgcttagtctgtagtcctcagccaaggctctgtactggagacaaatcaggatgtttgaggattagccccaccgcctgatcaggtaagcctatgatctatgctcagggacctgaggaagaaggaggaaggtgagccatgtcccccgaccctgaccgtgtacaccctgtcccccaagaggaccttgaagaagagcccttcagcatctgctttttacttcctatctttgacaaacagtctttatggaaagcttttgagcaaacggcaaatccatctttatgagattactaatgtcaacacattttgtgtatcaggattttataggctcctgcgggcctgtgcctgtgacaacattggctggcagtgctcgcctgaggaattatgcaacatgcccctgatgctggagaaggatcttgatatcccactgaggcccgggacattttctcccagaaacagtcttgaatgagaagcttgaagaggggagttagatttactggggcttctctaaagattctgtgtccaaagcttgaatagggaaagaaatactttgcatccatgtagcaggttctgcattcagcataccaggtttgctcctagttaaagagtcatggagcccatgggagtgtttgttctttgggaatgtcataaaagagaatttggcctctcccacttacatgttcttgcatttcttattggtccttctcttgcaattattgctactttccctggtcaacctctagagcagtggctttccaagtgccttctgtggacaggtagtatcagcatcatctagaaacttagagacgcaaatcctcggtgcacccccaacccatggaatcaaccgtttttaatgtgtgacctttggcagattagttacccctctgaaatctagtcttaccctatgaaatatgggaacgttaatagcacaggattattgtaaatattaaatgagatgattttaatgagtcttccaggcgattctgattatgctacagttccactcctaaagattcttctaaaagattcccatttttggacaattagaagttcctgctaagagaaattttcagattttatccctctacacattcgcaactatttttaatctgagctaatctgccaatcatctttccaaaatgaattaatactctcccattttcttaaaaattttgtaggatatcaaccattttaaactttttcttaaagactcagggcatcatcatgaatataattattgttatattagatgttgggcctttgtcatatttctatattttgtgttgtttaccagtttttttcagcttctttaaaaatagaatctttagtttgctaccttcttcttcattgtctggatatcagctatttttttaatagctatatccagtattatccccatcactttctaattttttacttttaacttgattttgcacaaggactgaaataaccaagatgattaataatgtactcaaagcaagaataaatcattaaacataatagtaaataaatgagaagaatttattgagaggaaataaatgagagggattttttttgaaagtataagcttctgtacctgagttttgcatcataaagtctggattcttgggtaccttactatttacttctgatcatgtcatagttgtcttgaataactgaatagctgatgttttgaataaatgaaaagtttttgtagcatactcaccactcaatcattctcctgaatgttccaccctcatcatgttatacctttctatcctttgcatatattgttgacatatacattttcctaggtgatacagtttgtaactgatatcatccaatcacaagtaaattactgctctgtggaataaaaggtaataactaaatgggacatgtctcctctttcactccctttttgctgttgttccacttctcctgggctcctgatgaagtctaggggagagtatacagggctgagatgtgaacaaccctaggatctaggcttggctctgccactaagtgactatgtagaactaggcaaatctcttggcctctctgggccatgagatgcaacactataaatcagtacgataatactcgcttctccttccttatagcagtagagcaagaatccaaataaatagtacaagtgagaactcaacacaatctacatctgtgaagcatcattcttaaggtatatccagggcatttggctccacgtagacctagaggttgctttctcagtcccttgtccgccccatatccagctgccttggctcacagagtttgagactgtgctgtattttctgtcatgcttcagagtgtatcaaatcaacacaaatataaaataaagccataaagagaaggctgatattcaccatagaaaatgttggagggaaagacaaaaacactcaacgacaacttcacaaacaacccttattatggctgtggaagacacaatagtatgtgtaatgtggtgtttgggctgtatttgctgcttgggaatctggtgcattctgagatggagggaatgccaagtgtttagacaacatgctgcttggcgcctgcaggttcctggaaaggactggggtctccagatctaggctgccagccaggagtctcaggcagagacatgcattctaccgtttaaggcctttctagacttcagcagtgagcagatacaggagccctcaagaagctctgcaaaagcctaccaccactgagatccaggacataatatgcattcctaagcaggctgctgcctttggctgagtctatctgggggccttctctctgcaggagaggatgctaacagctactgttcctgaaggactcataagaagacttctgtgcacttccagcctcccacatgaagcttctggaagggctaacccggttcatttcatctacttgctgcctatgccaatcctatcccctcttcaaagcccagtttaagtctgaccttccccatgaaatcaccaaagcctttagtcttcatgacccctcctgcctctggcggtctcttgcacttgttgcctgagattctcttaagctcttttcatctgctgccttgttagttaaatttactctgagtgtgttttatcttgtttcctcagctggattgtctgcatcttgggggaagggaaagttcttataaatcctggttctgctcttgggccaggacatgcctggggcagcaggtgtgtcttccccacctagactgaggaattgtgtctcaggggctgggctggattccgcaggagggaggccagggctgccaagagcaggagagccagagaaaagaatcaaatggccttaaatttgatttaagtttcaaattgcttgaacccaggaggcggaggttgtagtgagccaaatcgcaccattgcactccagcctgggcgacaagagtgaaactccgtttgaaacaaacaaacaaaaaaacaaacaaacaaacaaacaaaaacaagcctggcaactgctgccaagtgtctcatccaaagaaggaagggggatcgaaaccaaagaattgtgaagtcacaggatcaacagtcaggcaagtggctaaggactcaggctatgaagggtcctctgccacggttaggaggtttctttgttgttttgtggtgctctttgtggtgtagaaacaggtcatttctctacaaggattcatgcaggttggacagttccatcatggtctgctcccaagcatggggcctgtagaagtaatgacttttcttctggtcccagtccacaaagagatcgtgatcccattccccttacctgtacaatgcaggggtgagactcaatcctttcttgagtcccagtaaatgacttgagagattgtgagcagaccaatatcttctgtaaatgactggatattccagggaatactttcaaaaagcatcttggacataaaaacttttttttttcataagcagtggaggcttggggtcaaaagctagaccattcctaaaggaaagtttgatagtttcttctttgggagtgaaaaccctatgcatttaagaacagaaaggaaagcttgcataggtctgaaaatggaaaataggcctatttcctttaagaatagtaaatttcaggccagatgcactggctcatgcctgtaatcccaggactttcggaggctgaggtgggcagatcacttgagatcaggagttcaagaccatcctggccaacatggcaaaaccttctctctactaaaaaatacaaaaattagctgggtgtggtggcacgtggctgtaattccagctactcgggaagctgaggcacaagaagcagaggttgcagtaagccaagagcaggccactgcactccagccagggagacagaaggagactctgtctcaaaacaaacaaacaaacaaacaaaaaaccaaaaaagaatggtaaattccaattaacaacaggagatggaacaaatggtggacagtgactgtcatcagagaagtaaatgctatgtctgcaaaaaagaggtgagggcacagtgatgcgtagagacccctggctttaattatcccatgccttggtgttactggtcctctggagatctacttaacaggaagtagtgagctatgtccccacaaaagcatcccagaggccatttctgagcaggatggcctgtgggagtcgagtggtcagttgccatggttagcagagatttcctgctgagaagtcgcccctatgtgtgcacatggacagtgttgggtagagcaatgctccttcaactttagtgtgtttaccatcacctggggatcttgttgagctacacgttctgatttcataggcctggagtggaacccaagactgtgtttctaactagcttccaggtgctgtccatattgcggggctgtggaccacattttgagtagcgtggtgtagtggacactggaggaagaagtgtagacctgagctctagccccagctcagccctgtgtgtggccctgggcaagtcactgacactctaagactcacaattatgtcaatcatagtgataaagggaaatgaactagaaagactctccctggttctatgatgcgatgtttctgttacagtcccacagagaatttagacctctaccttgttcttccttagagtagactgttggccctagagatgtgcccagtggtcatgtaacatggagatatgcttgattaattcactgtacatgggttgtttgaccagcttctacccagtgcctataagagtagataccagactctatttttatgtcatttgaaagacaagggtagaagagacagcagttcagtgacagttgcgccatcgccattactctaatggttcagaaatagcttcccctcttcccctgtggaatgtttagattcatacttttaacctgtagcattttcctacccttcctgtgtaggaagcaggtgcattggaccaccctaaaacaatgcgtaggcctcagacttctgaactcatttctctgagatgagatgtccagtttgttcactacaacaatagttgccagacctattacggttatgtaataggtttctttttttaaacaggtcttgaaaatgtatgcattattctttaggtaataaatgaaatttaaaagactgaaaataaatcagctttgcaaagtgggggctgaagcttttctactaactgaaccatcttttcttttttattcttgttactttttaaggagatgatggcaagtgatttctttttaacccattttaagggcccagttcatcttgtacaattcttgtgcaaagtctctactgagactttggcctgatgcaaaagaagaggcccttagagaataatgctgggcatggagtgtgattcaagaagttattatcgtgtgttctctgacacagggtggctcttgctccccaagggtccaacagagaggggcccaggcatgcagaatattacatgcctgccctgtttccccatcagagaaatgttttccaacagccattgtggttgtagtaaggaaaaacatgtctttctgcctggatatatcaactgagggatgaacggtgagagaatataattgtctaaggatgacaacaggatcaatttccctttgacactgtaggccaccacctctttgtctccataaaatttcattagcacttgaatttatcagattggcttagctgttgtgcattctgctctgtgtgcaacgggcccattgttctactctactttaactggttttctgatggatgtgtttatgatacctcctgctgggtattgtgcgtgacaactggggactcgataactaaacaatatctgaacgcagaatccctctgtccagggaggggctgaggaagtcacaacagttaatctgtagtaggacccatgtcctcccatctgcaggggatgctctgttggcttgcaaagtggaaagatctgggaggctgaggtctgatgtcgtcgtcatcggcagagcgaccttgctcctcatttgtgcgcacaggcactgaatggagggagccttgaatcatctgattttgctcctcattagtatttctccactgtgttctctgaccacactttcctcctcggtgcatgcaaagctattagcaatgcacacacgcggcacatctgtggagccattattgctgctggatagctgtgtttgtgtaaaatattgaacaccctgtgaagatttataatggtttcccgccctgtcctctatccaccccctcttctctatttaaagacatattaacatctctagctctacctggaggaaaaactctttgaagtgagactgcacgaagataaaatgccttctctgaaagcgtccctctagaatgagcatggaggccttctgagaggccagggaaccacctgaggcacaggggcaggatgtctctgctggaaggcctcaggcccctctctccctgctttctgtccctactgggagtcagctctcccaagcacaggctaagcacccttgtgaccacagttatctggcccttgtgagagcttgctggtgactttcctgagactggagtcccgaggcttttaacaatgtggatgtgccttggccaaaagacatcctctgggttccttaatacttgtcttcactcttctgttttgtcagtggagatgccagtagctgtaatttagtcttgggtgggagagagccagaggtcgaggagggggtggggaaattgtcatcctaacccagcatagaggacctggtttaaagaggcttaacagaccactggtcttaccagcagatgcacctggggcttcgagagtgacttgggcttagcttcttcaaagggtgctgaaatctctcaccacccctgctcaaccctcttgctgcccccaccccaatggagaggggcccaggcatgcagaatattgtattccaacgatgctagattcatgtgcatgatatggaagggtctggagggaagaggctgctggtgcctatggccctgaggaccagctttctccttcccccatgtccccaggccaccccacccagagcatgccctcggcacgcaacaagcggcatgttccaggttgttccagggccagagagagtgacatgaggcaatgtctgtggcaagcgaaaaatgtgtgctgagccttgggaggcgccgattggctggcagtgaggtaatgcaatgcagtccaaatgtggaagcagcagtaccagcatcgagggcgtgcctcctcggcaagcctgagtctcctgccagccatctgaaggacaaggcgccgaggggtgctgcagacctcatgcaggtggctggctcacatggcagggtctgggtggtagagatcagatggcaggatctgagttgtcatgtctgttctctgtccctgaacacaccaaatgccactacaattctgatctctgttcttcaatggggatctcttagtggggagggcaaagaagcttgaaaatgagggtctggacctcagaaccacttacccaggtcatggtgagtgatggtcaatacaactactcttgaggattaggatggttttctcagtaaccgatggcttccctttaatgatataaaccttctcagggtctttcctaagcacagttctagattcatatttgggccagaagtccacactcaatctccccattccagtccatttcctatgactttgtgtcattggcaatgtccgctacgaaggatggaggaattcaagaggccactgtgggctatgctttcttctctttaataagactcctgttccaggagaaaactggcctctcaaaaaaagtcttctgaggaatagcagctaccaggaatcacagttggttccccatgaacatttcagatcaattacataaataataactacctattgtcttctagtgtcagtaccacaggagtaactccacatctttgagttaataaataaatttacttacttattcaataaatattctggactctttacggcagttctgacaatgttctaaatgtataggctatggtggtgagcagaacaaagtccttggtctcatgaagctaacattgtaaagggagatacagacaaaaagcaagagagctaagaagaaaatgaaagaggataatgaaatacagggtggctagtgattgaggcaactgtagttgggtggtcagggatgacctctgtaaagaggtaacattttagctgagacatcagtgaagccaatatggccatgagaagttctaggagaaaactccctgctggccccagaaattaattacaatatgaagctttagggaaggccacagggttgaatacctaagaagaaatatcccagtggttaaggacaacttctgctttgccactcagagagaagcagagcttgtcattgagctagtacagtcctgtgcactcgtgggagtaaggtcgcctcctttccccaggcacacagtaactctgctggattgctgactcctggcagtgtcttgtagcaaggtagactggggggtggcagatgcaaactctccctaaagaggtatcatcctcagttatttccattcacccaaaccctttctttcctccaaatcacactggctatatatctgaatgttttctttgacccagatcctattcttggcttctgtagacattgtcttgtttgatccctataaaaatctgcaagatggatgctataatttgcatttgactaaggaggaaactgaggctgtaagagataaggcaactctcccaagatggctcttttggggagacgtagaattgaggtccaaactcctaagaaagatggaactttggccatctccattgaggatgaataactcatcaaactattcctgggaaagggggtggcagaggagagagagatattgagacaggctacatatcataatatcatgggttaaaccaacagcaattttagaccccaaggggacaattcgcatagctgcagacgtttttccttgtcacactggggatgggtggggagcgctactgacatctagtgggtagagacctgggatgaggttctaaatgttctacgacgcacatgacagtgccacagcaaagaattatttggccccagatgtcaatagtgctgaggttgagaaaccttcgattaaagtcttacagtgctcactgctctctgcttcctctgtcttccttctatggctgccctcggggttacttacacactggatctctagatacaggactaaagtcataatggaaatttaagattccatttggatgctgatttttttcccaagctctcttcactatttattaaatggttagtgaagggaggtggaaagcttgatctccaggcaagtgagtcccttggacgtggggtggggagggtgaagctctggtgtggtactgcatcagcctagtgggaggtgcttgttaaccctctgtgctgtggcttccccatctgtaaaatggaggtgaaaatacctcctcctgccacctctcaggtttgctgtgagaagtcagtgatgtgtaagtgctttcataaaagtactatatacgtgtgttattactaattcttatatcatgaataaaatgaaatcatcattctgcccctgacaacaccaatttgctgaaccattagaattctgtacattacagtcttaaagagccatagagagaactgtaagggacctcaagaggtcatgcggtagaaaatggccagtgagacacttgggaatgattaaagtgaggtgggaagacacatggcatcttattcagttactcaactctcctttgttcacttccttgcatcatcattgcctttaggagtaatataataactgcattaataaagttgttatcctcctcccacccctgccagagctctgagggcacagtctaaacagaataattaattaatgaaaatgaagagaaaatagctcaagtgatggctataggagatcaaatagcaaagagaaagctgcaaaaacgttcgttgttatttgacactgagtagtgcaaagagggctgggagagtcccaggatccctgatcaacagagagagagtatcctgggggtttcctctttactttttctttttctgctctgaaaggttaggaaagatcctgagggcataatctgaccatctgatccaggccagcatactgctggagaagactgtgtcggggatgaggtggtctgagaagctggaataaatgcaggatcagctgataaggagggtgaggaaaaggtgagcttagtgtctgactttaaaaatatgtagatgagctccctaaataaaatacccctccacactgtactgatgactgaaattcctttaagagaaaatattttcgttctacaattaaagatagaatcctattttttccagggagaagtaatattgtcttaaatttatcctacattactacatgttgattacaaaaactgaagaatctattttctttgttttttttccagtttttatctccatccccatcttgcatcttacaaaggacccaatagaagcttcatggggtacaggaaagaatatagcaaggaccttggaggcctcaggcctcaatctggctctgccattcaatagtttgaccttggagagcaatcagaattctcagggccttagatcctctgcccgtgaagctgaggtattggactggatatctccaagggccctactaacaataagattatggactggggatggcttttcttctttccattttgttcaaggaagcctcctcttcgtcatttctcacctaccacccagctctgtattttcccatatttcaatgtcctttcatgaagacatataaacagtggccatgagtcaaggggatgcaagggtatctgtggttcaagaagatgcacgtgatgaccacggctagttgatccctcttggcatattgttgccatctcagaaagacaggaagggtgggttacagctgccagcaccatcaggattaaaagcaggaggactttaagactcaccctcgatgatgcagaactcaaaaggtctctgcttcacagctctgggccaccttgaagggcaagttgacaaaataaagcaaagcccagacagccttacagagtagtagattctgcattcctcattttcatggataattactgtagccttcaatttgaggaacatggcagtgatttgtgtgcagtttactcttctttcaggtgatggaaccagagccagaggcgtggatgtgactctgttgccctctagtggctagaatgcagtagcatacccagcaccccctcagacttggcttggtggtgccgctgacacgtgagcaagggttcctgggacactgactgccaagggggctcgggattctttcagcacaactcctgacctgagattctgcagagagagagagagagggagggagggaaagagcatcatccttcctatttctggaagtcagatctgtaacacagagggcctgtttcgtctagagtaaccctgtaccagctgcagcgctgggacgctcctgcctcttctgcggtcgcatgtccatgttttggggcagctaaggcacctggggtctgctctcgcagtcacacatttgctgtgtcacttctgcctcagttagatgttttctctagcaaacagatatcattatgtggttttccaattatcacttcccaaagggagctggttaatatggatgaggctttttaacatttggctttgaagacagggttatatgtagttgtagcagagggagccaatatctcggtaattggctaaggtttgcagaggagcaaggcagtctggggtatgtgccatctctgggacgcggggtctttgcagaatgtgttattgtggtgtagtctttaagtgagttctcagataaactggaaggtgggtctaggtggagattatttcaagaaggttagaactctggtctctggttacaataaaaaagctggattgctgaagatcatatgggcattgttgatgttgggctcaggcagagagttcttagtagggtcttcttaccctgacggttgccctttgtaacaggcaataatacaagaggattaatttatggagaggctgaagaggttagtggaatgagaagagatgcagcatgcagggacaaaactcagtttactatatcagcttcttttaccctttgggacaagaatccccaatttactgggcaaaacttccctccttctacttcctcttccaagagtttaactcatggaaaggaaatgaggggaaatagcacatttcatggcatcgaagagggcatctttgaaacctagcggctttccacctacagacatttagaatgcaacttatgctggcaaagctattgagggtttaaatgatatgctttatagcgtgttgcatttcttcctttgaaaatgaggagcttgaattacctttcttgcttcataatagaaatttagtcttatttctcagtctatagttaacacatagcaatctggtgccttcgagtgacaatttacctaaaagtcagcgttacatagatagttctacaaaatccaaacttacatgctttgtctgtacacttcttggtcttccaaccttcaggatcaccattgattccttttcctgtacccctccaacccctgacactgttaaactccatttcagtagtcattcacccagtcctgcagattttttgtccctacagcctaacattagttttcaaccagatcactctttttttacactattcaaaaatttctttagctttaaaagccctcatgagccaaagtgccagagatacttgtggtgttctaaagtatttgctgggacagggttaaatggatagggaaaaaaagaaataataggagggaaaagggtcccatgaaaagcttgctgcctggtggtggggaagatggagtaccaccagctatcattataggctgggccaggtgataggcagaataaagtgacttaagaaatttctggaagcacttcactgcactgcaagtcatgccactcttcctcagctcacagttggcagaagcaccactataaactgggttcagccacgtgtcccttagacacataagagagggagtgccaattgggaggacaggtgaccgaggggggcagagggacacattcatttattacccagttttgtcctggattgatgctggtcttgggtatccgacagtggaaccactctagtacctgacacacctactcttgacccagctttttcactcccaatttggttgttatacagcaccacaaatagggaaagatggctgggactttgaagagaacaggtggctcctatcagctggtgctaaaagagccccaccttatagatatgtatcttacactcatatgaccttccctactacaatactgtcataaagtcaaaaatgtgtgtctcttgtccctttgggctcccccagctccatttaataccgttcccaatgtttgtacctaattacagatttgaggagtcataaaaccacatctcccaagaggtagatctgctttattttggcttctgtgacacctgattgtcctctttcttcattcacctttaatgatttgcttccttttgttgcttatcaaggacttgtgctcctgaaggttctgtccttgactcccttgtcttcccccaacattatctttctggacaatctctaccaccttaatgttaatgagcctcaactccaaattggcagcccagatcaccctccagggctctggacatgtgtccccagctttctattagacatctctacctacttgtcccacaagaacctcaaacaacaaacatctaaacctgaatttatcctctgctccacaaaagtcacttctctatttctcattagaagtatagaaatggaagaatgaaaaacttccatccattctatcacttggtattaacctagaccttttccccttgctcaaccccatctctccttttgccttttaccacgaatctgtcaccagatcttacaattctacttctcaaatatctttccagacagactcttcctctccatgtctactttactgccctagttcagggtttcatcaccttgatctggcctttgatatctgcctccatgtgtccaggacctgcatgctaatccctgaaagaaaacctggatacagttttgcagctgaattttattttaatgaaatctgcattcttgtggataaccttccaacacactacttcagtaatatcactgactgtagcaataataataatatcagtgactataacaaaaacttttggcttaaaaaaaaatccatttgcaatgacttcactttccgaagttctcaactgatacccagagccattctttttggtcatatgccaattttgtgagtaaaatatagggtttctttatgaccatacatttcctatgatggcgagcttatgagggtggtccttcatgcaagtttctcatctttctatagcctgaaaagtactgattctttttttttttttgagatggaatctcactgtgttgcccaggctggagtgcagtggcatgatctcggctcactgcaagctccgtctcctgggttcacgccattctcctgcctcagcctcccaagtagctgggactacaggtacccgccaccacgcccggctaattttttgtatatttttagtagacacagggtttcaccatgttagccaggatggtctctatctcctgacctcgtgatccacccacctcggcctcccaaagtgctgggattacaggtgtgagccactgtgcctggccttgattctttgaaaatgaactctttttggcaccctcatcttctgccatcttggtccattttgcttatcagagtaaatacaactggtaaaaaggtttatgctatttattctccctccagtcttggttcataacatgctcagttaaatttctccctcattgagtgtctcctcaaagataaatattttaccttggaaagtctggtcatttctaaggttaggaaaatgctatcagtcactttggagttgattgcctatgtcaggttggcattcttggatgaactacaggtttaagatttgctgttctgcatgcatcactgtgaagtcatctgagatgggcgctgacctgtagctcacaaggagtttcaaggtcttctatcatcctcctttcaaacactcacagtgattaattctccagaaatcactactggtgctatcaccttcagaaaacaattttctttctgaatacatgtagggtatataggcttctctggtttggtttgcatttcacattagcctttttttttttttttttttttaaattccaaggaactctaccttcaaaagcaagcaaagcattctcctcccaggtggcccatgtactggattttggagtctgaattgttatttcctcactcctgccttcctctcttcttggctttctttctagggcacctgacgtccttccttattactgatggcagcagagactgaacccctgggagaggaaagtgaactgagtaattgttttgccttttcatgtctgatgtatcactctgggtcagtgtagctttagttgaaagagtaatgttgttacccaggagcagctgtagtgtctccagacaactccaagacctctccagtcccgcagaggtcagtttctggtctgggcataatggtcttttttccaggggttgaagcccagctagaagcaaattcctactctgatttctcaagactctgaacacccacaccggcccatgagggcagagagtggtggctggctttctaaaccagccttgtgtcttcagagtccttgatcagagataacttggggaaagctgtgtctcataaatccactttgctactgggtcagagagatgccttgagaatgaccttagctagggaagggatggaatattggtttccctttgtcccctgcccttcagttcatggcatagggttaagagagtgtcaggagcctgcaggcctgttctgtgcttagcgtggggagacatggcagcaagttggcaagctggggtcttcttattccaaattcaaccatttcttggcactttttttgtttctttttctgagaggtagtagacagtggagctaaataaaattttctcccaagaaaaaatggttagaagcagcgtgtcccctgcccaggcctgaaatctcttcattccctttccctttccccagggttcccaaaggtcttctgcattgcccacctgctgctctctttcctgccctgtttgttttgatggcattaaaaggcctgcctgcctactttacaaggaccctcatttctttacccatcatgttttgatatattttttcttgctttttcttgaggtttgcaatcaagagccctttaactgaaatcctgggctgcctgcagcagctgtggggttcccagccaactgccttgtcctctgagggataaattccctttgaccgtgccacttgtgaaaacacagagcaagtgtagagtattttacatataatttagaaagagagaggacttatcggtgggtggtaggaaaggacagaagatggattaatattttttctttatcacttggcatgttaaacttaattatatttcttgaaagacctctaaacagttataattagaaattatgataatagctgcggttgccttacacatgttcattttactgcttgcttctttgtgaatgtgggctgtgattaataaataaccaccaacatcattaggacaagacctctccttgcctgctgggacccctttgactttggatggacagtgtcaaggatcaggagcacctagactagccccatgagccatggccttcataggctagatggtcattggaaatgaagttgttggcaccgacagtcacagttatgaaaataagaatttggatctcagatttttctgctccctcttctcctgtgtattagtccgttcttatgctgctaataaagacatacccgagactgagtaatttataaaggaaagaggtttaatggactcacagttccacttggctagggaggcctcacaatcacgacggaagatgaaggaagagcaaagggatgtcttacacggaggcaggctagagagaattagagccaagtgaaagaggaaacccattataaaatcatcagatcttgtgagacttattcactaccacaagaacagtatgagggaaactgcctccataattcaattatctcctaccgggtttctctcacaacacttgggaattatgggagctacaattcaagatgagatttgggtggggacacagccaaaccatgtcatcctctcttggtcatttgttttttttttttttgatttacaagtatcgtttattcactcacttatttttgtgcagggatgacaagagagtcacaggaatatccctaaatacttacggtatcattgtaaagagaaataacccaagaagagagtgaaaaaagaacctcctaaccaagggctgcagttgagtactaactactctgtggtgagaaataggaaatttagtattaagttaaagcaaaatcctttttaacatttctgaggtctattctcatgttgattataaatgggaaaagtgagaattagcttacttctaacctagctgcctgtttggccctgcaaaggattttagagatccccttcattctgtttattttatggaagaggaatttgagtctggaggagttaagacattgactgggcaaagaggcccaaccactcatgttcagacctccctgtgagatgccatataagaatatcaagagaaaaccttttaccctctaggctgttcaaccttagaaattcataagagcccccttagtagtcaattatgaatgataacaataaagatccatgttcaaagtattgaaagcactgtttcaataactttcttacagcatgggtgtatgacagaccagagactaaatacggagtcctaattctcaagacagtctcaaaggatattcaagatcaaatttagaaaatatattgtcagaagcctgttccccagagtcacattcaaagatttttctcagagaaattttcctaaaggcatgattctaaagagatctagtacaaggcaaaggatttcgattttttttcccctactacttcctcatctccaccccacaagttgacctggagtcatctttggtccttttgagttttaagtcatcatcttccctcaggctcaagaggaagcctgctgtattttgatgagacaactcacctttgatgtcacagttttcactcttcaagaacaaggagtcattagtatcttgacatctaactgtataagttaaagcacttcctggaagctcaaagggaaacactgaactcttaacacacagattctgctggaagtaaatgactctgccctataaaaggaggagaaagaaattctatttgagtaatgccgttgaaatattaaaagaaattcagagggaaaaatatccaagtgaataatatatattggatctctggcctctaatttgacattcaggtcagatcaaaactaaccctgtgagattctggaatttaatgtcatataaaaatgctactgggcaaggaactttattacacatgatcataaaaatatatgggaggcgccatctctgggtatttttctatcaaatctttactcattttacagtctttacaaacagaagccagaagtgctatatttgaacatctacatttgttgggatttctttaaaaaaaataaaacaaaaagaagaatcacattttatacgtgttaaatggtgtagtagtaaaccatgtttaaaaaagcttcagttttcattggtgtacaaagctgctacatgtaaatattggaaccactttttaaaagaggattgctgcagtcagattttttaaaataataaaataatcacaaagttcaacatatggtgtcttcatgtgattataagtgtgcgagtgtgtatacatgtttttaattccttaggattagcagaatgacaaaatgtgtgaagaaggatagatgatggttatttcaagcagcacaagaatttgaggaggaggtggagactaagaagagagaggaaaaaaagatcaagcaggacaagggacatgggtacaagactagaagaaaagctggatttctttaaactagaaaaatcaaagacatctgttccccttatggcaataaccacatttttctagaaatttacacattaacatctaaaaatggatttgtgctaaaaatacaagctatgctcaatgcatgactcttgaatgactttcccctatgattcctctgtagtcatatggcaaggccatgccctcatctgacattttttttagtcaggaaataccaacttcagttttctttgatcatgtgatttccttggcctggaaactcttctctgtctttccccctaaccaactcttactcattcttctagactaactcagctctttaatcactgagaaaaccttccctgcctatctttgtcccttccttagttttactgaatttgcctgccctgtactctgatagcacattgtatttaaataaacacttacggtctctcccgctaggctgtgaacttcttaagtgaaaagccatgttttattgaaatctatatttctggaacctaacacagtgtcctagatgctcgataaatatgttttggactaaaatatgctgctagtttaatgctccagttcctgatgaagccagggctttctttcccaggagacagtcaactcagggggcatgtttggtttagtacctgccagcgtgttgttgacaaacaccatatactctctgttgcaaagccaaaacatgaccttttccacaaatggagtaagcgtttattggggaataaaaaagtatgatgattgtttttaagtaacgtataaacctaagtgtctcaatagaaattgtgagaaatatttatttactgcgagagaaacattttccttaagctttcattgttttaggtagtcttcgttttcctgttccccatcctcctaggttgaattccctgattctggctggcatgctcataatttctatgatcacagccccattgtctgttggagctgagggcattgtaagtttttgtaagcagcctttgataagttttagaggtgtagagaaagagctctgtctcctccctgggagaatactcctttccctacacctcagaggaccaaatcatgtctttattaatatgaagcattcattccagtggcatattttattcattacaagaggatcagtagtttgagcaatcagagatgaattctaatatatggaatcctttcccgctgagcttccatgaaagcatttgatcctttttggcctgccccctttgagctggctcctttattaatcctaaaggaccaaggtgtaagaactcaggcaggacaactgtctctttaggcaaacccaggctttgatccgcttccctgacacagtgatctcacctcctttggctcagtcctctccttcgtcattggcccagctatgagtctggaagtccccacagtgccttctttgggtcaatactattatcgtgcacctgctatttgcctggtgctgtgctagagactcaggatacagatgtgtagagggaagagtgtttattcttgtgaccttatcatggagagctttcagatgagatttattcctaccaaatttattatttgagtgaaactgaacagttccattctgataagtaagggaagaaccaggcatactatgttgctattctccacgatctgtgttaaggtttctgtggatgtgtgtgtgtgtctacttaaagaaatggcagtctatccctcttacatcctcagatattcacagagcccctcagtgacattttttggcctaggctttttaacattctagagtagaagagttgactggtaggaacatttctaagtgctcttttgcaccataaagcaagaggagtgtagctgttaggggaacttgagaagttggttagtgtgtaagtgatgtgagaaaattctaagttttccagtttaaaaatggagacaggagggaaatggccctttgttaagaaaataatgttaaggtattaagaaaacaatattaaggtataaagaaaaccagagacatgaaacagaagttggactctgagagtcttggcggagatggtggtagttttagcctgcataggtctgggataggagtcacttgctgtccactggcatcagaggacacaacggagtctttgatgtgggtctgaaatgttacaacttcccacccccacttaaggatgcttggatggagaataagagatgtcagttgtgttctgaaaaccctaacctagatataccttcagccaaaagagagacatgctaccatggttatcatccaaagccactctgtagaatatagcccaaacatcactgtgtattaaaacatttctctttactgttttcacataaatagattaatttatacagatttgtatttatttacatatttgtgtatatgctgcactaaatcctcactagtgggacattgtttaggaatcctggtacagggtgtagtaccaacaaggaaaaccttcttattaagctcagtgtcacttgatccattatatttaatgccaggaagggtatatatacagatttagaaattaccttatttctttgtcgactgagatgggtaatctactcaataaccatttaatgacaatgcacaatgttccaggatgcagaattgaatagcctagcctgggtcgctcccctctgagaagattacagtgtaatatgataattattaccatagtgctacccctggggcagaggacactcagagaaggggtatctgatttagacatggggatcactacagctgcctggaggagaggaagcttaaactgtgttgggaagtgtgagtaggacacagattggtaaggtgggggtggagaggtattccagaaaaagggctgggcatagggaggcttgtagcaatctacaatatttgggaagctatgggtgggttaatactacgggcattaagtatgctttgggagggagtgaatggggataggattcagggcacagctgggccaggtcacgaagtaaataagatcagaaagactttgaatagctcagtcaggatggagattcatcttgaaactaatagctggagaccttgattgacttgagaaggaagagaatcatgtgatcctatttacacgtggaaagatcatgctagctgtcatttggaggaggaagtagttaagggcagggtagagataggcagatatcatgagataacctccatgaaaaaaaaaagggtgaggtggcacaggtgaaagtaaacttaggaaagtaaagccaggattctaatgaaagatgttattaattaaacttactgtttaggaggatgatggagaaacccaggtcctggcaaaaacggtcacactactttaaagtttgggactaagaaggaaatgaataggatatcatgaaagtaggctctgtgattttcttagtttgtagggagatggtagaacttagtggttaagcacttgagctttgagctctgaaagatgtgagtggattcctggcctgatctcatactagctgcatgaccttggttgaccttcagcattctcatctgttgaatggggtaataataatatatgactccaggagttcttgtgagaatttaatcagaaagtacatgttaaatactttttggcacctagtaagtgttcaataaattaccactttgcttatttttataattggtaattaaaagccagcaaaagtatgcttgtagtggaaaaggcactacaggcacaagtactaatggggcttgggctgccaggaaaataccctgtgatctccttctgatacctggcacacaattttcagggatcttggaaaacgtttacctcatatgcaagtccatgcatggtaccagcaaacagggatccttgaagaagtgaattcacagctgtctttaccttctactatgtaacagaatgtgagatagagagaaggagagggaggagagagggagggagagagagagagagagaggagagagagaaagaaagtgacaaattagattatggaatggaaagttacatttgggaaggtgaagagttttgtcaagtatcttagcctttcttagcctcattttaaaatgatgttggactaagtccagctgcaaactgacagcccatgcaactagcacgtggaaatattttaaaaagctgagccaacgtttaaaaattggaaatttgtcaattgaggtagcttcttccataataagttcatttttattatttattcaaagctaaataattttattcaaaaatagatttctggattctgttgaaaaatcctaagatctggccaaccaggctcctgctcttccaagggcgtaagcattgctgccccttttgggcaaagaatcaggtttctaggtcctcaaggctcatcacttggggtgtgtgctggtctctcatgccaggtccccttctcttatttgcaaactgtctctgtttgatattaaaatttgtaatggggaaacactcactggtttctaaaaccctatgtagatttaagtagttgatgattctgtgaaaaaaccaaataccttctagagaaaacatacaggttgggcagagcccaggtattgatgtccttgatgaaactggtttttgtattctgaatgttggagattgagagatccaaagccattctctaaggttgacaccaaggtgcaggtgaaaccatggggggcaggtgtggggagaaagggaaggagttgaaggaagaaatctacaattactcggaactccacatccactcagctgctgtagaatatgagttgagaggaaatgcagaggagaatctgctgcataggaccactggaatatagattgtgttttggaaatgactgatttatcaggtggaagcagagaatgataagccagctccatgctgttctctcctttgtcatgttcccctgcccctggcccttggccttcctctcacttccctccctgacaccccaactccatgcagcatttgctccccctccacccaactcctccttgctttcctggcaggttcaccaagaaacaaccgggcctccatggcaacgtgaagacagctgaaaaatggcagctaaatgcagctgcccctcatttaatatcgactctggcactgacagaacagataatgggcaataacacaccattatgttgtgggaaaatgaaatgcttcagcagaaggctgtcatgctggggggatttatttgttactgtaccagcaccagtttctatttacttcccttccgttctttttgttccctcatttccatgccagtttctccctcctcctggtttctctcccattcctcccttctatagcttctcttttttgtacttcctttccctcctcttttttttttttccttctctctgaatcacttatggatataccagaaagcatacatatataatgcaattatttgcatgatgacttacaagttccaaagcacattcaaatacattgctttttcatttggagggtgaggcaaccctatgaagacaggtagggcctagacactgatgtttattttgcagatttttaaaggggctcagagaagttgaacccaagatcaggcaagtaagtgtcagcagctgcattgcaagtcagattttctagcccctagacaggactctttcctttctacgacatgaaaaacttcagagtcaccaatttctacccactttactagcaccctatcttcttactgaataatctgcaggtgcagagaaagtcttctaggctttgagacttcagaaggtctttagatctttacttatattgccagtcacttacagattcttccagacaagtgcctttgaattgttgataagattggtttatttttgttttcatttttactctttaaacccaagacgtctatctgctcattacctcctattgcatcattatataatcatgaaatcttggtatgcagaagggcgtggtgtgctctttgacttgaaagtgggggcattttggtggccaacagctttctgttttgcaaaagaccgtggtacattgaggtccagaggacatcactgatggacttggcatgaggaaaacccttctctaagttgttgctgtagtttaaacttgctttcttacatcctgttggttggattgtcatagcaccctcatcttctgttgaaatatcatttagtagactctaaattctggaaagatctgagatcaagtttcttagttctttgggtcttgaaaggattacaaatggagtgagaatggctattgcaaacatgttttcatttctagttatggctggtgagggaagaactaaatgtcaaaaaatatatgtgtacatctgtagaaggtacagtatgagtaatgaatatagtggttttcaatcatatgaaagaatgatttatattgataaagagatcaatgtttgtacttcccagcaaatattttttaacctgggatctctgagccccttgaaaacatgtgcaaaattttgtatggataaggcaatgcagtgcagtgtttcaacccactgatgttgaacatactgaccaggattttggctctgccacttgccagatttgtagctttagaaaaattacttacactcttcagggcttagatttttgaactagtctggtactcagttgagatttgctattctgtattgtttcttttctgtctgtaatgctttgttctcattcctgcatactgaaactcttcctgcaggtttttctctctggcagccatccccagttttagctgtggaaactcaagtaggcctctaacaaaatgttctgtggtggtgagaaagctaaggaaaaccagctgctaaaattacagcaagtctctggttgctgttgcttggtttctttccctgtatagttatttcccgtgcatggttcctcaaagtgaaatgaaccttagtgtcatatcacataatcatggaatgttagaactggcaggaaccagagatgattccatttctgtggtctgccagttcaaatccttgctgtgtagaaagcaagtccttgaccaaaggcctgccttgccaatcagcctccttgctattaatatattgtccctctgactcctttaacttgtttaattgcgctaagttcttaagtggatttactgccattccttatccagatctgaggctgtatgatataaagataactagtgtttgtttagtatttatgccattttagtagttatattttattcttaaaaagtaaaagtgactggttcaggaaataagtactctcaggattgagacatatttttacatgtttcattattttgataaattttaaaattagattttgtattaagaagactgttcagaaattatccccattatctcatttttattcattattcaaagaaatgtaagaaaataataagccctttatctagctattggaattttggaacttccgaggcaactgtgaatctcaagttagccagagaaaagggggcacagagtctttaagcaagaggagaaaactgtctcacaaccatagtttttttttttttttttttttttttcccttggaaaggaatagagctagccagaggacttagggtctagtttccataccaggtgggagggttagagacagcaagtgaaattggtggagaactttggaagttgtcaaatcttcattgagtgagaaaaataaagccgggacagaagtaccccaaggaagaccacagaaggaaatcctaacagaacatacatagctcaggagaccagaatcttttaggtcaaaagcaacaacctcaagagaacttaagaaaaccaagtgcattcttaaaccagaaaagtacactcagaaatcacggagaactcaagcaaaggactttcaggcaccaacctctcttacaagctctattatagcaccagtgaaataattgatattcatgaagatcatacaattttagactctttgggttggttgtagcttagagattatctagttcagggctgctcaaggtgtttcctgcacatcagtgccgtccaagagctgtttgttactaatccataaggatataaatatggaaactgagagtaagcatttaagcacttttgtagtaattccatgtgtgggaacacacaggtgagggagagtggactggtctcattcaagagggtgtcaaacagttcagcattttaaaacttacttggtgagtcatatgtggcatgagctggtagttcttcacagtagggcatgtattgatctgaaaggatggaaaaatctaaaaaacaaaataaaacaaaattggctgtttactaaaaagatcttgtgaagccccaatctagtgaaaaagcctacttttacatatgaaaagatagatgatttatccaagaaaatataaaaagatgatggcagaacccagaatatgggattaataacattttattaattaagcaaattatgcccaacatactctgcttcttaaaataggcaaagcatgcaacacattgtagaattaaaaaaaaaaaaagacaaacatttgagacctgtgggctcttaaaggttgaatcattcctccatggacttcacatttcaaataagattttgctatatatacacatacaactgtatcaccccacagaaaacatattttgcacttgaagtttgttgatctcttggggcattattttgtttctgggaattcttaaagaatataaggctatgctggatggcaattttctgggtcaattgtgcccaaggcactccctacagcaaattaggtaatgaaacaactcttgtgggcccttatgatgcaatttagggcactatagtggtaatagactagctgggggctcagcagctagtggaactctagggacctcaaagcatgactaagccttcttcagtgcccagttttctgccgtgggatggtgttaggcccgggaagaacagagcctaaatgcacccctctacccacttccaccgggatcttgacgaaggtagggatgctcctcgtatttccatggttagattaggctaattgtcccttacaagttgaggttttgaaacaactggaagtggatagaatcacaatggtcatattaccatgataataacaatatcttacatgtataccattgaacttttatctcattaggtcctcactatagtctcactataggccaagcagctacttttagctgctttgtaataagtaagccaaataaaggctcaaagattgaacagatttattgattttacccctcagttaaaactaagatccagggccgggcgcggtggctcacgcctataatcccagcactttgggaggccgaggtgggtggatcacgagttcaggagatcgaaaccatcctagctaacacggtgaaaccccatctctactgaaaatacaaaaaaaaaaaaaaaaattagtctgttgtggtggcgggtgcctgtagtcccagctacttgggaggctgaggcaggagaatggcgtgaacccgggaggtggagcttgcagtgagctgagatcgcaccactgcacttcagcctgggcgacagtgtgagactccatctcaaaaacaacaacaacaacaataaccaaaaaaactaagatccaggatgggtacagtggctcaggcctgtgatcccagcactttgggaggccaaagtgggaggattgcttgaggccaggagtttaggaccagcctggacaacatggtgagacacagtctctacccccaaaaaaaacaaaacaattagttggatgtgggcatagtggcatatgcctgtagtcctaactactcaggagactgaggtgggagactaaggcaggaggatcactggagaccaggagtttaaggctgaagtaagctatgattaaatcactatactccagcctgggtgacaaagcaagatcatctccaaacaaaacaaaacaaatcaacaaaaccctcagattcatccccatgtctccatctctactgtcactatccaagtccgtgccgccatcactcatcacctgcataactgcagaagcctaccaatagtctccctgactcactcagctcctccagtggattatttacatagcagccagagtgatctttttaaagtataaatcataccctgtctctctaagcttaaaaccctttaatggtttccatttttcttaggataaagtccaaacttcttggcaaggtttgcaaagcccagcaggtagcacttggccacctctgcaacttcctcttacactgctctcttgttactcttggtgcatttgccccattagccttcaaattcatcaagctcttttctgctctccctcccctcccaaaggctaactcgtactcatttgcaggtttccgtttaaaccctgcttcttcaagagcttccttaattcttcatctaaattagctccttctactttctctttcctcttattccaccctgatcttgtctccacggagtttttagcacgattcaaagttacgtccatctgtaggcttttctttgtttgagggccgtctccctcactacaatgcaagattgatgaggacaagccctatgcagctttgttcaccagtgaatattcacacatagctctctgcttcagagttctcttgctataaatatgtgataaataaaaaatgagggaatgataggcccaagagggcacagatgggcaagggtgatgtgagataatgcactctgcttctgaaataattcctaattacctttggttttgttcttaaaacacaactggagttcttagaagaaatatgcaatctggcatatagtaagggctcaataaatgtttgaatacatgaattaatatgtaatgaaagaatgaatgccatcgttacaaattagctgagttctccatgtgtttgtaatattaggatattactgtccccaagttgcattatcgacttcctggctttcagtgggcccagtgtccccacatgcctgctcaccccccactgcactaacctaaataatctctgattattttctttttctcttgctactaccaaattctgttctgagtgaggaagcagcttggttaaaaaacaaaagccctgatatgtatatatattttttttcctgaagaataccatcaggatgaaggctatgattaatacacataattgctacaaatggcagctaactgcagaaaaccacctcccagctgttggaggaaggaaattgctgacagccactccccattgggtggctaccaaaagagaggagctcacaggagcaggagagaatacacatctccatcccacgtgacccatagagatgacccatagggctctgtcttacatgtgagctttgccataaaatggtagtgttaagagtttttagggctggggtttacagccaggctttccatggctggggctggttttataggacatgctgtcctgcagaatgaacatttagaatccctgtggcccagttggtattactgcaaaacccaggttgaatcccttcaggaggagacagatgattcttggctggtcagatttcttctctcatcctttccttgttcatttgccctattctaatgggatggggaatgcacaaacaaggaagaagctctgggttgcttcttggagtctgctttgtgacctgagctcgacccttcactttcctgggcctcagtctcttcagtctataatgtgaggtgttagactagaagatcactgtttccttaattttaagcatctgtgttacaaaacatacgtacaaagtatgtgtacatatcatattaaaatgtatataaagttatatctatatctgtctatctatcatctattctctagtttctattagcttggtgcaaaagtaattgcggtttttgccattgaaagtaatggcaaaaaccgcaattacttttgcaccaactttgtatcaattatcacctatttatctttcaacgattattcatcatctatccatccacctatctatctatttatcaatcaatcattcttatgtatctccatacccccatcttctctgtctactgttttacagttagcacccgaaaagttatttgtacttgtgttagtgttaacatgtgtctggcttaactagtcccttgttcaggtgcaggaatttatcaacatataaatcagaagacaaaaaacttcaagcctaacacacttaatgcacataagcttctccaggccaccacttacagagttgtgctatacctttttttttttttttgatgtggcaaaaacaaaacaactcagcagctaaacagatgaaaagccaagctgtgggctaaggtatgtatttgatgaagctctctcttctctagatctttagtgggaagagttttgccacttgacacatatttaccccgcaaacctacactggcaatgctaaggcagtgagcacagaacacaggcctgaagtgtgctggaagttagctgaagggcaatgtcagcgcaccagctttgaaattacatgcagcgcagtcaccgtccctctggaaaactgtgcattctgtgaatgctgactctggaagtgcacacgctgagcatcagggctggaaaacagctgagagagaatgttctcccaggagaacaaaccttagcgagcttcctccatgtgttctgtacatctgcatcatctcatttcatcttcaaacaatccatgaagtaatgcagtcttctttatatggtaggaaaactgaggatcagaaaaattaactgattttattcaaggataccctgttagttgcagccactggtggtaacattttttagtgctttggtgccaaaaaagaaaaaaagaaatttttgtgctccaaataaaagaggacttctgtagaaattaaaataaggcattattagaactttaggaattttgcttctttctttgtcctctgattattcctgtgactttatgtatgaccccttaatgcaatggctgtgttctaccagttgatttggacatgtacatagttgaccttcaaacccattactgttgcatccgagactatccccttgaggagttccatcagggagggaggagcatcgtctagaagtcagaagtctttgcctgctgttagtattctccacagagctcctcctctccctcagttgagggtcacaggatgttagagaaatcaaaagccactggacatcagggaaagattgaggagcctgttacctgtcaccttttcatttagacggccttgcttctaaaattatattctgaattttccatttattcttgctgctatagactgaatgtttttccccctcccacacccactgttcatatgttgaagccctaatccccaatgtgatggtatttgaggtaggtagggaggtaattaggtttagatgaggacatggggatagagcccccttatgggataagaaaatgattataagaagagtgctcgatatggttaagctttgtgtcccacccgaatctcatcttgaattgagattcccataatccccataatccccatgtgtcaagggagagaccaggtggaggtaattgaatcatgggggttgctccctcatactgctcttgtgatagtgagtgagttctaatgagatctgatggttttataaggggctcttgccctctttgcttggcatttctccttcctggcgccttgcaaagagggtgccttgcttcctctttgccttccaccatgattgtaaatttcctgaggtttcccaagccatgctgaaatgtgagtcaattaaacctctttcctttataaattacccagcctcaggtagttctttacagcagtagaaaaatggactaatataatgcccttagaacaagaggaagagacaagagtcttccctttttctcggccatgtgaggacacaggaagaagatggccatctacaaatcagaaagagggcactcaccaggcaccgaatctgccagcactttgatcttggacttcctagcctccagaactgtgcaaaataaatgttggctgcttaagtcacccagtctatggtattttgttacagcagcccaaactggctaagatactgtcttgtaggtgaaacagggctaggagttattttacaggcataaagttacctgtttttacactcttgagaatcaattagtgggttggtatactaatggtagggtctaaaaaaagaagaaaaacaccaaatgcatttgaagcgattccaactttgggacactttttattatttcagacaaatgcagatagaatgtttactgaggtgtctccctggccctttatgtaatatttggatagcgcaatccttagctgcatgcagataatgtgttaggcagctagaaaaataacctgcttgtactgtttctgatttattccccctcctccctcacgtctttgttcacagtaaacacatcactgcagagtagctagcaaatgaatgcctttttatcagaggtacatgcccagttggtggctacgaccacatagaacagcagatatggccaaagggggaatcactgacaaaacaggcagaccctcacccagagtggatggtgtttcttggcatctgagaatcagaatatagaggaagatgaaagcactgtcgtgtttacggtgctggaaattatattgaaactcaagtaaaataatgatgctgctgctgctgatgatgatttgttgagtgtttactataggctctgatctggcatgctttccatgtataatttcatttatactttactacaacctcaggtgagagctacagttattatattattatacctattttataggtgaggaaaccgagacatagagagtttaaataacttgcccagtgtcacataggttaagaaccaggatcaagataagagctttcctcaactacccaggaaggaccaaacaagttaagagtctccagaatttgagaggaggaattatgattctggaagttccaatctttctctccagcttcagaaggatcaaccaatattttaaaggaatgtttaatccttgtggtatgagctgttggggtaagaaagaatatgggctggggtgaagattgaatatgagccaagttcagtctcattacaggactaggaagacagagaaataccaagatctagagcattgagggatattttgatgaagctctgttggctcttgcatggtccacatgaatgcaaagcattcattttttttctagatgagaggcacaaagaaataagacagcatttttcttttttcagtaaaatccctttagttttgactgcactaattctgtattttcctaatttagtcatgttaagctaaaatttacctttataccatgtaggttgagaggaggatttataaaacaaaaagagaaagtggtcagcctattctatcggatcaaatcagtaaattactaccaatcttcactacttcaggacaattattttattcaaataacaaatacactaattacaaatgaatgtccatttttaaatcacttgcaagagtcccacacacatttaacagagtggttttcttttctttaccttatgttcttggagataataaatcaacatttccctcagaaagcatttgttaattttttattcaatcataccaatcttttgcccaattaggaggcattagtgtaattttttcccattaaattgtacataagtactgtcgtccttgtttgaataattaactttcacctagatgccctatgtgtttcggttgatgtatttgctcacttgcatctgcggtttgctgtagctttgaaactactgacactttcaagcaagatggactaatgtctctgaaatgaagctggacatttggatttgtgacagtgagcttgacacttattaccttactaataggtagtaagcatataccaaaatgatttacatagagggtattagtacctattagtaccttactacctattagtaaggtaatatgtgtcaaagatttacatagagggtatatgcttactacctgttagtgctaagacattggttctgtcagatgaggattttctgattggcaactaaggaagttatgttcataatttaaagtgaaggggtgggatgggatagagctggatcaatgccccatggtactacagagtgagtgataacttggagaatattgtccccctgctccccacccagctgccagtttgactagcctttcaaatagcattcacttgtcctcaattctcacccaagacaaaacacccatgacttggaacaataaagcaaacatatttccaaaatggccatggcagaacagtgaaaaggtactttggtatatctcatgccacatttcacagatcttctgttctgtgatggtttatggaagtgaagtactttattatgtaaaattcatcctgttttttgtttgtttgtttgtttgttttgttttgtgatactacagatccatttcactatagccaaaggacatgcgtttggggtctggggatccatcagaggattcttctctcttcttctggtcccacaaagcaatcgtgagctttagaaaggaatcctaggaaaagtgaatagtcttccactgacatctgctctttcttatagcttacaatgaatactgcctcttaaagtgtcttcttaaagtggcacaaagagagcacctctgtgagtgcagggtgattgggcacgcagtaggagaagcactcagggttagcaagtgattttcctgacacaaaaccatttgttggcaagatctgtgggagaaacattctggattttgtatttcttgacctttccgtgctttcatttggtaaactttgcaaagcagaagctttatcttaaaagttgttgtggttttgtattaagctcttttgaagtaactgatatgacttattttgctttaagacttaaagtgcaatttttaataagctggtaccatttattaattacttactaatgatcccagcacagtgctttctgtatattatgtctcttcgtctctacaaaaaaccccaggacttataaattattatttttctctaatttgcggatggctaaactgaagcttaaagagattaagtaatttgctgaaaatcacatgacttctaaggaaggttgagattctttctgactccaaagcctgagcattatttcatcactgccttcctttatacattatgtatgttaattcaatgttttcctccctctcaggctacagaactcagatttcatgagagtttagagttctagtctccagagtttttcagtaacccttctctcttttcagtagaaagggagagttgttttaaaaatggataactacttaagaaaggcctttgacaatctctaacgtgtgaaaaattctttttggccactggcttctgatgactcaaattgtcagttgacttgtttgctaacatgttttagcttccatcactcccttccacagatggcatgaagaattggccatagtagataaccatgctacagtagatgccattcatttattgccattcatttatagcaaatagccattctatagcagatgccattcatttattttattttatttttattttttgagacagagcctcactcagttgcccaggctggagtgcagtggcgtgatctcggcttactgcaacctccgcctcccaggttcaagctattctcctgcctcagcctcccaagtagctggtatttataggcacacaccaccacgcctggctaatttttgtatgtttagtagagacggggtttcaccatgttggtcaggctggtctaaaactcctgacctcaggtgatccgcccaccttggcctcccaaaatgttgggattacagtcatgcgtgagccatggcacccgggctgatgccattcatttagagtagtcattctttcatagtagacagccattctgtagtagataccattttctatagtagcactaccccttaccatccgactagaagaagaataagtaagtgattagaaataaggctcctggttatagggtttgttacccaatgaacatgatgacttgattagcgtgccctttcagcccaatgtaggattttctatggactatgattgagagcagacacctacagatttgtttgctttacatatatagctgaatagtcaaaatgctatatccacctcaaatggagtcaggataagcattatgaaaagtcagaattggcagttgctaggtgatgtaatttgagggacttcatggagcataccctccaaaaaactcttactgatgcctgaaatttcacagttatgtcttgattacattggattgagcaacagcccctcctttaaaaaatgcaaattcttctcacacagggaggtagctattatgcccctgacacactgggtgcttattaagcactcgaagcagaacagaggatgtggatggatgaggagatggaaaaagttgtgcagtgaacagtttccctgagagctggcatggcaagaggggggcggtatgcccactgcacaggggcggggccaggtgctggatcctgcacagtgggaacatgctcccctctgccatcttttgttgggaagaggctcacacagcctttccagaagagaattgcaggaccaagcaaggtgaactgggaaagagaaggatctggaagtctaggatggcaagatagattggagagcaatacacagacaacctggggaagagacctcgcctgggtctgaggtgatggggtgggagccctggctctgcatctggctagctttgtaacccagtcccacgtctactgaccccttgacttcctgttcctttgtgtgtgtgtgtgtgtgtgtgtttgtttgtttgtttgtttgtttgttttgagaaggagtctcgctgtgtcacccaggctggagtgcagtggtgcgatcttggttcactgcaacctccgcctcccaggttcaagcgattctcttgcctcagcctcctgagtagctgggactacaggcgtgtgccaccatgcccggctaatttttgtatttttagtagagacggggtttcaccttattggtcaggctggtcttgaactcctgacctcaagatccacccgccttggcctcccaaagtgttgggattacaggcgtgagccaccgcacctggtccctgttccttatctttaaaatgagggcatttgactagggacatctccaagtttccttctagttatgaagaatacatttttttaaaattgtactggaatcttatgagaaacacgagggattattctttttgcttttaagatttatccatgatagagtataagataagccatgggacttgcttctctcccaactcaccatacccaaaagatattaatcttggtaagatcccacaaccaacactatgcttttgcaagagcatccaaagttgtgattttgggttttgttttgatttcttttgttggttttttaatttagcttgtgactaatagaaaaccagaaatactaatctcttacatcaaaggaaggttactggcaacctccttgtactctccagggaggcatggttctcttggacttagcctgggttgtctgcatctgggaaggacttggacaggaaagagctaggcataggagctgaaagggaaccttcttatcttcagactgggaggacacaggttatatcctccatcagaggtgtagaagaaatgatgctcaacaatcagtcacatcctcagaacttccccaggcttgcatccctggaaagctgaagtagtctttggggcttcagagaaggcatcaattgatggatctcagtccatgtgtgtgtgaggctcaaggttacctggcaaggcagtacagggcagtagtaaagagtgagtaaaggatttggggtcagcaaaacctggttttgatcctcgatgctacctctttcaatggacaggttaccaagcctcaactcccatgtctgtagaagagactgtcacaacacttgtctctgagttgtgacggctccacacaatagtccaggcaaggaggtaagcctggtgctcagcattgaccagccatctagaattggtcattgccattattattaaacagtgcagccctatggccagtgaaaaacaacttttaaggcagcaaggcacttgcagcatccaatctggggaaccactcagaaccccggaaaggtactccagcaacacctgacccttctcagattcacttccctttacatagcttgttacgtggtgagctttaactacagtgcgcagctctcatctcttcaagggtgggaggattgcactgcaaatatgtctaaaaaggcacctgtgtcaatatagtttgtgtcatattcaacagggagagcaaaatgaaatgcatctttcacagatctgtagaaaacaatcatcatgggtgcttcctaaactccatccagagagttaaaggcatcaatcgttattattttttcccttcaaaatacatataaagaatttaaaaatacatataatttttgacttcaggaatgtatgtttgtttacaagtaattttattgcaaaatatcaagaatgttctgacctctatgtgaatggatgtacatatatctccccaaagtggtctatgtcaatgtcagataaaaagtcattcatgtatttcagatgagatggaagaggaaagcaatttgccaagtagtgatgacataaaggaatgtgcttatagggtcttcagagggctatccctgcctggagggtttttgagggtaggtaggaggccaggtggttggctcctctgttattgaaaaaaggagattgtctttcagagagcactgaggcctagagcactcttatcacttggaatgcccgtcagggctcacagagagtggagaagcattttatatatcacaagccattgcatgccataacttctccttcttttcttgtcctctttattttcccctaccagcatggctctcagatttattaacagccctttcatgccttctacagccatcaggaagagaaataaagaggtctgggagaatccaatcttctttagcttgtcctttttcactctcttagcttttttgtttgtttgtttctctttccctcccttcctccctccctcccttctctctctctctctctctctctctctctctctctctctcatttttattagactgctctgcatcaggctagagtttctttttcaatttccctcttctttcactgtttttaattgtttcagtgcctttgtttttccctagacttgagcacagtgggaaaggtcagctgtcagaagaggggctgtacacagctgataaggccttcaggagactggattggagtcatttaggcagcattctctccctgaagtcatagaggctacactgttgcagtggaaagaaaaaaagagctcaatgagtagaaaaggcaacttacatgaaatgagcagcttggctatgtgagcactaagcagtgcattacttacccagagcccttttccagaggcaggtgctgcccagtgccagctccagtgactctgggacgttgatggaaatgtgaatctggatgaggcacacatgcaggaggcttggagtaaggactcaactgggaattaggaatctaacatcctggaaatcaaagttgtcccctgttaatatatctgcttcatggttattttacaactaatgaacttatataaaaatcagaaagcctaggttctggtcttgggtatattgctaattactttgggaaagcatgaaactatactagccttgtaaaaagaagtagaaaatgtgtggtttttaaagcacttttcatagataatatctagaattcatcttcctgatatcatttgcaaagtagaagtgaggagcataccccttcttggacatggctatgaaaaccagttaattcctttttatgtaagtaccttgaggtaaacccaaagtcaaagcccttggaactcatccaaatagcctatgcaaaaattcatgatggagtgctgcagagcttttaaagaaatggtggtcatcttctggaatgggaaaaagaatagttgatatggataataccatagcattgcagagttctttttttttttttttttaagagaccaaatcttacgctgtcactcaggctggagtgcagtagtgtgatcatgactcactgcagcctcgaactcctgggctcaaacaacactcctgcctcagcctcccaagtagctgggactatagacacatgccaccgtgcccagataatctttttattttttgtagagatagggtctctttgttgcccaggctggtctggaactcctggcttcaagtgatccttctgagtcaccaggatttcaggcataagccaatatggctcagcaaattcttcatgttttcaaaacaatttttttatacttcacaataacctgatttaaggatacttcctaccataatgtacctgaaaaatatgacatgctaaaatgtgacagaactcctgttttcactgtcaacctggcacatgacaagtgttctcaataaaggtttgctgaatgaatgaataaaattattgagtgagtgggtaacttaaagccttcaagtaacacacagttaactatgtttatttggctctccctggccaaccccagtaatggttgggtacaaagaggaattggggtagataatgttggccataaaggatatgtaatctggttatattggtagttctgctgtcttgccatagaaaagggagccaaagggttttaactagagctctgtcaccttgggagaaccctcgggaaagaaccactgtccaggctagcagccacagaagccctagaagatcacacagtgaattgcttagcttctgctctcactgcagtgccttttacccaaaacaaactcttgttttggtaggagaaacaagaaggttggagttatacccaattctagcttcattctaaattcccttgtcaattattattctaattggatgaccctggacccctaaatctcagctcccctccttgaaaactgtcaataataatacctaaataggttgttgtgaagattctatgaaacattaatacaaagccagagctaaagccctgatacacaataagcttcaaaaatggtagctggcatcatcactatcatcacccccatttcaagggctctgggagtttcctggtatgaaacagtgataatgatgcttactgtttaaggttatagaattgaggagactatttgtaaagggcctcttgcgatgacaggcacgtaatagagaaaaaataagtattggctcctttctctctcctttcttctatgatgtcttcttacttttctactttagccgaggtagtggtacatcattactctttcataaagtgacacaatgtcattgaggaatgctcaaaaggccccagcagatggatgctcatagctggttgaagcagagttaggagggtagcatggaggggaaggaggaatgagcagcactcgggaatgcaagacagatcttttctgccaaacctggatgcactggaggctgccatcctaaagcttttgtgaagtttctgcctgtttctggagttatccatgtaatccttgagagaacacttctgtttgcacaaatcattccatacaacgtaattagctacttataatacagaggacacttgtgatcccaaattcaaacaattgcaaaagcaaaagcagtttattcatggtggtgtacaatgataattgataatgagctagatgactgtgaggtgctatggaatctcaaagactcttctgaattctcaaagggagttcaccttattcataggatgactttaggttagcagaaaataatgactttaaaaagtattataccataacaatgaatacattacttatattgttcatgtaattactagttcttcaaaaaccaaaatgccaaatttacaatgattagaaattaatagctaacaaaaacatcacactaactcgatgccctttatttgccaatgattctagctaatggagagtttttacttgatgtgctttattttttaccttctgacatctgatccatgtagaatgaccagccttcctggttttctaggaaccagctattttagcactaaaagtcctagtgaacttctcatttctaggcaaattgggatggctggttattctacttgaagcacctggtggacctcttttcaggacagcaccatgtttagactaacatctgactgacaactcaaaacgaaaagaatctctggttccagattatttataacttttggatcttgttgatgaagaaaatttttatgaaaaaagaaaatagagttgactacttttctatttatttaaataataacattaacaaattttgtctatccttgccatcattttataagacaggaaattacaaaaccaaaaaagtagaaaggagtagaatgtaaattttacaagggttccagagtgatgtgtttatcactatgttcccagtgcctagcagtgtgtggtgtggcatagatcctacataaatatttgttgaataaatgcacagtgcataaatttagcttttactacaaatgtactacactcttcttatttttctttctttctttcttttttttttttttttgttgtttttgagacggagtctcattctgtcacccaggctggagtgcagtggcgcgatcttggctcacggcaagctccgcctcctgggttcacgccattctcctgcctcatcttccagagtagctgggactgcaggtgcctgccacaacacccagctactttttctgtatttttagtagagacggggtttcaccgtgttagccaggatggtctcgatctcctgacctcgtggtccgcccacctcggcctcccaaagtgctgggattacagacgtgagccgctgcacccggccatttttctaaatgtattatagattgatgaaaactttcccttagaccattgcttggggatcaatagttgaaatctaagtctgtggactgtagagttttttgatagtaagtttttattgtaaattattttaatggcattctgttgtttatcctagtctcatgttcattatagttggtgtggtcaacctcccatgagataatcattcagataagaccaagtttccgggcctgtaaatcagagaatcaggttcatttaacatcctcttagatctcaacttctatcagtagcaagatacatctttgcagatacctacatggagatttcactacatctggcagggatgagccaccggtcctcattttcttaattcctggacaaggtttttgtgtattctaaccaagtattcttgcttttctttgttctgattcattcatctacaaagtgtggtcagaaaccttgaccaactgctgatatatacaaatatcacaacttctctaagtctgggatctcctaccacagttgagatatccaaatcattcacagttttgtcataactcgtggattaaaaaaatcattgataaatcatatccggtatttctgaagaggtttagaattttggtttcatggatagcataggaaatgtaaattatccatcacaaatgtctttacaagttacaaaactaaaccaatttgagtgttcatttcagagaggcttaatactctcagttttgttgtttcttttaatcacaaatcaactaaccatttccctttctgcagctaccttgcacaatccctgagcatatttctgaccttagccctctggtgtcatagctctgattctagctgtttggctttggatggggttgttggggtgttgcagcatctgtaaatggttaaaggagcattagactcaatgtatcaggctcatgcctgtaatcccagcactttggaggctgaggcggcaggatcaggaggatcaggaggatcaggtcaggagatcaagaccatcctggctaatttggtgaaaccccgtctctgctaaaaaaaaaaaatacaaaaaattagccgggcgtggtggcggctgcctgtagtcccaccttctcaggcggctgaggcaggagaatggtgtgaacccaggaggcggagcttgcagtgagccgagatcgcgccactgcactccagcctgggcgacagagcgagactccgtctcaaaaaaaaaaaaaaaaaaagtggatttccttatttatgctctcataattaagataattttagcatttatatcgtgtagtgaatatacacaattcccatgatttttttcctattgttttatgatccgtatttatatcccaaagtatatggttaatacctctaagtttttgctgaaaatctagccttgttgagcagatacaggttcctttagcagctggtgaagggtgcttatactttaaaaaatcagataatgtatgtgaaagtggtttggaatatgtgacatgctatgcaaacgtgtatttttttttttaaagaaatgaatagctcgtctcccacaggcatattattgacaggggtctttgcaaaagatacacaaacctaaataggaagcagcatgatctaatggaaagcatatagtctttggaggttaacattggcttgtattttggatctgctttcaactggaaatattagaaggatttagtcccttctgagccttagttttatcatttgaaaaatgggctagtaaaactttatttcacagggcttttgtgagggataaataagaaatatacaaagtatcctaataaaaagttctcatttcagatgaaatatgagcatgtagatatgctatctctattaataattcatttgttctgtgttgttttgaactcttgtaactttaaatcactaaaacaggttaattcttgtcaaatgctatttacatcgtgtttgtttcattgaagcataatacaggttcaataaatgttaatttcctgttctttgtatgctatagcaaaaataaaaaatcttctgatgcttaaaaagactggtaatagtcggctgggcgtagtggctcacgcatgtaatcccagcactttgggaggccgagacgggcagatcatgaggtcaggagattgagaccatcctggctaacacggtgaaaccccatctctactaaaaatataaaaaaataaaaaattaaaaaaaaaattagcctggtgtggtggcgggtgcctgtagtcctagctactcgggaggctgaggcaggagaatggcatgaacccgggaggcagagcttgcagtgagccaagatcgcgccactgcactcagcctgggctacagagcgagactctgtcaaaaaaaaaaaaaaaaagagactggtaatagcctgagatgaagaaatgacaaaaatgaaataaatactttcttctagttttatgcaccatattagtactataattgaatatgcaatcactaaagattttcttctttatttaggtttcttgaatcaggtcaccgatttttaagtctgcatccattttagagaactctccctccccactccccttcaacatatcccatcctctttcacctatccattcagattctttcatttaattatttcagaccctgggaattagcagtcccttcttgaaagcattggaatggggcagttttaatttttattagtatcagctttctcctcctcactgccatatttacttctttgggaggaaaaggaagtgcatatgtagctataaaagaagacatagcccaggtttctaggatttgcacctccgcattggcaaattttcccagtctgtgtctccaaacagggttttaatcacctgggctcttgtccttggcattgaaagctttaagagtactgcagaaatggtaaattaaccacatttaacaaaatagaaagttttcattgtgtcataaaaagccctattgatcttgttcaggcattgactccaggtccttttaacaagccactctgtctagacttgcaggctagagcccacagtgctaacaaaggaggagctgggctgccctccctccccctgcaggggaaggctaagaggatgggcacagattcaggcttctcaatggggattttcttaaagaactagcatgattttattctgctgtggaaaggaaaagcattaggagacttgtggcagatgtacctgtcacttactccagactccagccttgtttgactctctgtgtctgctgtggaactaccccatcataacagattaacgtgtcttccatatccctcagcttccagcaacatttcctcctgttgcccttaggaaggtaggctgaactctgatgccaacgcacggagcagtgggtctccagaaagagcgtggaaagcaacgatggggcaggaggaggaattggcaactttagaatcactgtgaccaactcaacttcatttcaattcaattccacaggtctttacttaacaaattctgggtaaacaggagattttgaaaaggcaagaaaaattgctgctcacagcgtatggttaaaaagttgacatccataaatcaaataaccaaagaatcattcaagatttattgggcggttagacgttttattggcagcagagatttaacttttcaaaaaatgatgaagtatttcaaacataaaacatgtagaacctatagtagaggatattgcaaacattgctttacccatcactcagattgaacaaatcttaatgttttgccatttttgctttatatctttttgtaaagacttagtcatgttcgaataccttcctggttccatttattctcttcctcctccaaagtaaccactacctgaagttgatggggagattttctgtatacatatttcttattcttgttacatacaaatagagctgtagtatcaaataattagtgatcactatatagctatgtgtatgtatgtgtatatatatataaattagtgggggtcaattttatcagcccctcatcatttatattcattattctctatatattctgggctgaaggaaggacatgttaagtaaaattctttaataccttatacttccctgttcatcacccaagcaaaacttggtaccacctctagatcccactttcctgttttaggatcagaaagcatttggctcctaaaatatctgtaggaagtttcacataatatctgattgtcttgttttctctagatacttaaaggtggggagttttaccaaaaatataatctaattgcagatttattaaggcaggaagtagattacattgtcttctaagatttcttctgatactatggtgataattgttacagagaattctttacttgttttcatcttgggctaaagagatatttgatagaaataaacattttaaagttcatatggtaaaaaattcatacttattgctttgaaatatctaaatatctgtatgagttttcccaaattctgtaaaccttcatgacttctatattattttctaaacatgtatgtgtgaatatagtgagtatctaattttggtagcaattagtgttgatatgtgtgctactgtatataaaaaacatttcagatgctctactttgggctctagattcattgtggatatttttcattattattaattttgtttgtatgaaaattatacaaaaatatacagtgttactagggacacagacctctcctctccagctctgtgtccctcctaacatttttgtccttatgaagtccacagaatgtagtgtgacagcatggcatttgctattccagtataatcgccttagttattgagtacttttgatgattctttttggtcttggccaagggtgaaaggatatgtaagtttgtgagtatgtatatattgtacaattttttttgttcaaaaacttcaaaattctatgtgaaacttatttataggaagtcaattctggttaagttctccaccatcctaattacttatatactctgtgtaacttcaggaaatgtatttttaggaaacactgtaggctagagctggctttgacattattgatatattttcttgtcattgaactcatgtggctccagatgtgcctattatccctccagtcacagtgaaagcaacccaaggaccagtttgatatcctgaatttctcctgatacttttattttggtgcctatttcaatatttgttgagcgctgaggtgacaaccataacatttccctctgatttctgaactgattgtgtaatagacataagagtcaaatcataattgtgtcaaggatccaaatatcagttctattgctggtagagttagagcatgtggcttttactgcagtaaaattgggcttctttataatttttcctttgaattaaactcagctactcagcaacagttagaagagccagaaaactgcaggccttcttccataagggcagagtttactgtggtaaggattactgcatgggactgcctaaaggagaactcacaagccttgtagaaagaaatagagtaaaaggcaggtcacctgggaatagtgactatctaattacgaaatgtagaactagggtatcagacccttactacagcaccaagcagatgaatcactgcaggagaatgaataaaggagacatggtcaaagtgttactccaaaatgatctcttctggggaatggggaggaaatgttctcgtggagtcacgggggcaggaaaatggattcccctctgtaagacggagtgcactatttgtgttcaatgcttgtttgattgactgacccataattaaaatgagaaacgaatactgaaagaagcataattacagttttgcttatatggatctggtggttgacggaaagtaaaatatacagtacattacataaattattgtaagtgggaagacaggcatgtgcagtacaattggcccaggttgtgtatttctttttttattttttatttttttagcaatatccgtcctatcttagaaatgtctcctggatccctatattacataaattattataagtgggaagacaggcagtacaattgtgtgcagtacaattggcaaacaattggctcatgttctgtgtttttttttattttttattttttagcaatatccatcctatcttaggaatgtctcctggctccctcttcacctctctagccatttgtccacccactggacccctggtacaatacaagtataattgtgccactcattagctgaatttcttctctgctaattccccatccccagtgctcaagaatgtagagaaggccccagtctgcatcttgagcctatacatgtgtccattgctctagccaccttgcacttttcaccttctcctaaatactctgtgctcttctaatgaccacaccaatggatatgctgtttcttctaattagcatttcattcctccctttgtaggtaaactattcataactcaagacacattttaagtatgacctcctgtatggaaacttctcttatgcccagggtcagttattccctcttctgtgtgcctatatcacctaccaaacccttactacactggtaattatttgcttgtgcataccttctcaacaacaatgatagctaacacttctatggctgggaactgggccaagaactttattgtattcctgcctcacagcaactctatgaaatatgtactatggttattcccattttgtagattagggaaagaagggttagagaagttaagtaataagctagagttccatagatttagataagtttcagagctggctgccaaacccgcatctgtctgattgaaagcttttctcatcacagttcataatgtaagtccactgttcaaccaggcagagtgccctgttaacatgaatccgttgtcagggcctggcacatagcaggcattcaaaattttttagctttacaatttcttttttttgtaaaatgtcagctaatgatttatacttacaaggttgccatgtgacttaagtgcattcagcactgaacacattacctggtgcatagtaggcacctgtgaatctttactttttaagtgaataaacaaaaatgtaacttttattgtaatgcagttgacagcaattcagtctttaggataccattagctttctagtgatttcagtgaagcgtggttttccaggccattcttctgtggacggaggcagcttccctcaccaggatgctggctgtttattttccaagtgacaagttgatttactattttccttctcatcactttcaagaagcatctgcaggctagtgagtgacccaggcagtgtggaaaagtctatttatttctctgctgcatctttcctacggagagtctgaggataagggttggaaatggcctcaggaggtcagatttcctgtgtattttcttttgtagtgcaggattgctcagggcgacacaatttcccgtctgctggtacactctgcttttaaaatacctgtgtgatgggatgtgtcaggtaaagaattttgttgtttgtccttgggggatggctctgcagcttgatctctcttaatgctttctttggccctaaaatacattgtaagggaaatgagacagggagagccaagagtgcagttcacttgtgcaatcttttgccttttaacacaatcattctgttcctccctaaattctagcaggaaatgtcattaagtgtacaatagaattcactccactaaaagaatttctactttcccctcacttttgcaaatatgatcatctcacagctcagcagataacttggatgtctgctcacagcttcctaagaggctcttagaggtaggtgttcctgttcagtatattggattcttagcaggttggatagtaaggaaacagacttgtagaggaacgaactcatacttgccttgttcttttgccagcaaaatactcaaattgctgttttagctcaatatacctttcagcactgagggtatatgcagcccctccatcccccaggaatgagtagaactgtgcaatcgtggacttattccctagacgtttctttctgcagttgtgtactcttttgccttggagccattacttcttttgtcattactgaggcttctttgcctggaaagcactggccagaattgggtgatctgtgagttcacgacttgagaacctccaacctctgattgcagttgcactggtggagaaggcacaatatagcccctgctgggtttgtcttcacagagagtaaatgagttcacaggctggccacaagaccacaggccatctctttgcctagcaggcaaggcaatagtagcccacgtgtttttgtgcctcattagtttccaggtgggccaggccaggatgggcagccaggttatctttgcatgaatacagactaaagtactgcactgtgctgctgtacgagaccaatttgaaggacaaaggctgcatgctacaatgagaacaatttcgctgtgtctctgaggctcatcatcaggaagctggctcccactcctttctggagctcagcaggtgttcttcacaggaccactggctacagccacttcagaggggtcagcattttaacgggctcttctaagtatctaaaaattccatttctaaggctctctgttggaggtaaagagtgttatcttctcagattggcttttttcagcttgttgttgagaatttggaaagaaagtcaacctactcccctacttgcctgctttgtttcctgctgcctaccagggctcttgtctaccattgtcagtagttttacctttcaacaggttgaacctcatgcagctgcagaatatcagatatagggtgctaggcatctgctttgggaatctgagttcctggcaaagtagtggtatggtgtagtaggaaaagcaatggaatgaaaatcatagcgttacagttttggaaatggcactccgtagtaccttgtatgacccctgtaaactctatgtgtctctatttcctcacattggtgtaatcatagtaaaatgacctcacagaacattgagaggatacaaataatgattaagaaggcatttggaaatccatgacacgtccagatgcatgtaaatacctgcttgcaaatggccctagaatccttctttatcaatgtctgacatgttttcattttcagtcctttcttgactaattctttgtctttttctgccaaattttgcctttggtctttggctttccaatgattgcatttggatcttaagtatccacactttggtttcctcctgtgttctctggcttgctgtgcctctgcctctcttaggttgttctgctaggaacttctgcttacattcttgcccagtgaagtgtaaacctcactatatccaggaactatatcaacatctaggctgaaccagttccaggcaacccctgaaaaagtagttcaaatgtatttctaaaagattatgcaatctcttaaaaatacaggttgaatccttctatccttctcagtaaaattatgcaatggttccccataacttatagaagttcaaattttttgcccttaaagcccagtttgggtttttaagacaccaagccattaggaatggcaggcctaattaaacagttgcatgcattttccccacacttcttagattgcatagtaataaaatataacactgagtattttaatctgctttggaatttctcagagaaatagagtgattattatataaattataagttgggtgtcttttagggggaaagaagtgaagaacagaattaagtaaatgcttattaatactaagtatatatcagtattgaattaatcagccatttgaaagatcagtacttcatatatcttatacaaactgatttaaaatcttgagttatacatatctagattgcatctagtgtttaatcaattggacacttacaaataatggataaatgatttgttgtcatacagagttgagctttgcttttcatgcagtgagaataatacttttcatttttacacttatgcagttgattgtaaactttgggatgatataatttaaatggatctaaacagtccattagctatgtcagtgcctcctctcttgccaagctatagttttatgctaagctgttgtgtactgtattacataatcccctgcattcattttctccacctatttagcttgaataaatacaaggtgactgcattgtctcttcaacctacttctcagtaaaaacaccaagtataaaaaacagatttttgggtgctattttgttttttctaatggaggattcaaaggattgaataaggttagaaatgcatgtttgtcactatttggttttgccccttttagttacccttactgtcaacttagtatggttttcaaggtgataagagagtggttgagtctcagctactggaaggaaattaagatagattggaggtcttagaagaaaaatcatgtcagttgtgcaagtggacaaaacaatgatttcttcaaggtcctcatttttttctccttctcctttctagcccttgatttgctcttttaaagactgggttattgggaggcagagcttgcagtgagtcgaggtcgtgccactgcactccagcctgggggacagagcgagactctgtctcaagaaaaaaagaaaaggactgggttatgcattgctagtgcctcttaccccataacatgtaggggaaaattattccatcacttgaaaatgatatacatttgcttatgtaggatacgattcagagagaagctttcagttgtctattgtttgttgaccaatggaggagatatcccaacatggtaatgctgatcttggtagcctcctctgactcagggaagaggtaaactgagaaaattcttcactggatgaaaagatggggaaggttgtgaatggttacagcaatttctgttaaatatttgcaaaggaaggcacttggccacataaaatcttcttcggtatagttgcatggagattagcataaatatgcatgtgatttgcataggccttttcttcctcacgttggttttagttcttatttatttatggtgatattctcttctctacactgatgccattttttcccctgtggcctcccacataaaagaagtgtttttgctttaaatacagatctaagggctgaaagggaaacatttcttttggtgaatgagtgattcatgtaaggtgagaggaattggtttctggctcaatttattcaaagtttgggatggtttgtcagtcaatgcacagttccatggaatcatctgtggcctttgacaagacaagtaggagcatctggaatatccagagtgatgggcaaagggaagataatgaatatttagactaagaaaagaccagacatgccccaagcccagagtaccacaaactaactgtgatgtctcaggcaactcacttatttctagtcatcaatttcttccttaataaaataagggcattaaatcaggccatctctaaaatcccttatagctctaaaatttattattttgacagactccttgctctaattatataaaaaatattaagcaccatgtagcacattaaataatatctggtgccttgctgttctgtcaaacttttcccctttgaagggtactggatgattaatttaagcttctctttataggcactactttccttgctcatttttctcagttcagtgggcacacaaggtataacttaaatgtttatagaagacacccattaatataccacttgcggtgccaaggacatgcacagtagttggctttgtggacatccatgtctgtagaaaaagagcttagttgtgataacgccatttgatttgtcaccttctactctagatcagggtcacctccaggtctcctgagcagggccttgtccaattgcattttaacaaagacgattcttcagaaatgaggggagagatcatgacaatagacagaacatttggggagtggatagaactacttcaaacacgcagacagtgttgaatttctgctttattatttttggggggctatttctgctaaaatccagtatgagttatgggctaactacttatacatgtgcaagctaccctgtgagcatttataggtgaacaggtctcttttgcttataccaatgtgtgtgcaagcagacatatgcaggtagatacatatgactgggctgctctggaacacacaagagaaacttgatctcttctttaactccctggagtatgaagctgaggctgatgttttaatgatgtcataatgctaagattaatttaacaatatgtagtgggtagaagtcttttcacattataaaatatctcctttttacagctcttactttatgatgaaaaaatattcattttgcctaagaaatttacctggggctgtaatggttaacacagatctgagttgaagtggacttggctttggttaattagcctggagtgtagttccggcagggaaaatataattctctcaaccttattttgtagcctccaatctttagagggaaactgtatacctcaactattgttgccattttcttttagtaatgaggtgcttttgatagcttttgaccaactctggtatgaagtagaccattctaagtaaggctatctggcaagaagacaaatggaaggtcataacactgtgtgtcaaaattatagatcgaatcaacaaataattaaataaaatatatttcaccctcttaccttgacaaatatacctttaaaactagttggaaagccaggctcaaatttagagtttttggattccttggagttctgcattgggaaatagcagcacaaggggaaccagccaacccctagtcctcaacccatggtctactcccttctcttcccacctttggctttgtcctatatcatgaagggtctggtatgaatgcatgtggttgccccagcctaatggagaagccttatccacatctctgcaaatagtctcccacggctactcctcagaccttgcaatatgtatggtttgcctttagaaagatggatcaagggctgggtgcagtggctcacgcctgtaatcctaacactttgggaggccaaggcaggcagatcacaaagtcaagagattgagaccatcctggccaacatggtgaaaccctgtctctactaaaaatacaaaagttagtcgggcgtgttgtcacacacctgtagtcccagctacttgggaggctgaggcaggagaatcgcttgaacccgggaggcggaggttgcagtgagccgagatcacaccactgcactccagcctggtgacagagcaagactcagaaaaaaaaaaaaaaaaaaggaaataaaaagaagaagaagaaaaaagaaagatggatccagggaagaggcctgcacaagccctgaaaaacaggcttaaggctttttgggtgggcaattacagggtcccagtctatgaaatattgtcttgaaagagtatatgggctccagtagaatgcgatcttggccccatggaactctagttctgtggggaaggatagttctgtggggaagaagagaatgccgtcctggccctgtggaactctagttctgtggccataggatagtccaaccagggtcttcaaaacaggataccctagagcagagagtcttgagtttaacagtggtattgctgtcttatcaaaacatatcaaattaattctcttcccctctccttacctgctgtatcacctgctcaggtccaacctcctacttaacaactcagccatgttccagggggcttaggactgtattatagaaaccaaagttagctgagttattgacagatgaaaatcccagccagatctttcggggtaatttatttttagttattggtcaataaaagctacctggagctagagagtcctttgtcagaacagttaattatccattctaaaccagctcttctacaagcatttaaaagcaattcctgaagcaaaagcaactcgagcctcacttgatcattttgcatgaaacctccctttaggtttttcttgagaaaattcgaaggaaaggcagcaatctcttttgcaccatcttgttttgtcttctaccctcgtgtggacacgtcgtttctctgcagtcacccctgctgctagtttccctggtgtttcgatataggacttgcagaagaattgaagggagtgctgtgttggtatcagcacaagaacggggcagtgcccctgcggtgtgttctctttggtatttgcataggtctgactcttgccagacaagtgctgattgctttcctcttttcttttcctatagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtaatggctgaggggagagaattcctggaaggctcatcttaggtggctgggtagtaaatttgtgaagcaggtgatgggtgtgaggtggagaggggtggagattcagggatggagatgttaacgtctaactttctcccagtctttgcaatttcacgtggaaaattattaaaatatgtttctccacatacttcaattctctctctgtgcttgttatttaagaaaaaaaaaaacaactcagttgtatagataataaaagttgtaagtactttcattccttttattctgctttcctttgatcattttcttaattacatttgaatcttatcgtattattgttaaattcaattagggactgcattttgtttctgcagcttcgtagattttcctcattctttgaatatatgtttttctttttaattaagttagccattgccacgatgccataattttaattccttccagaaaaagtcttccttttcctcttttaatttactaccctttcccaactatttttttcttttatgttaacctctagctttggaattaattagccgggatctttctgaattcctctgtttctctgttcttgatgcggtggtcctactctattgcccctgtctctccctccgagactcttcagttgactgggaggcctggaaagtggaaggacccaaataaaaaagtcaactttggagcagcctttcctggttctgtccgtgcttgggaactcccatcgcttgccgattctaagcaggcacctccgtcaggtgacaacattctcagaaagccttagccaagtgaagttgttttcaatttcatgactaataataatgataacaataataatacctcatcagctcacatcagtaaaagaaaaccgtttcctataaaaatcaaagtctgtgctgagaccgccttttccaggttgccattttcacttggtttttctatttgcgaatctgttgttaaacccagttggatggcatccaggctttattaaccagaaaacactatactttctgaagtgcttatcaaaaagtgcttaccaaattttcttctgccacatgattgatttaatgtcttctaatgtcaatgtgaaagcgtaagaaatgataggtgtctgcctacgttttctgtttgataaaagtgtaactccttacgaatactaaacaaatggtataggctggcacacatttgaaacacatttccacacttaggtatgtcaaggaagccatcctgttgggagattacatttatctcaggtaaaaatgccaaatgacacaagacttagagtccccaagcatcttgacattcatgaatctgatatttttgaatcattgttctatgtttttcctccaaggccaaagaaccctattgctaatatcttctttcgtcattcctcatccatacttacccaggagagaacgtctcaactgtcaagagaacccaaatcaaatatccatttgctaacacataagggcttgttacatgagagctgcagagactagacctaaaagtgaaatacaaccttttgctagttttgattggcaggtacaaaataacacgctttaggcattaatcagtggaggagagacttttcatgtacttcagagcacaatcaggtcatgattctcaccaatttgtttctctacctctctcccaccacccttccttaccattctggaatgattccaattctcctgtgaaaggctcacttttgtttctactaaaaacacttttctaaaatagtatcaggcacacttaagtcctttaaatggagagaggataaaccaaactgtaattcaaatattgtttgtgctgttttaatcagagcagctagaggaaaactaccctggatgtttttcccgcccctgcccttcatgttctaaggcccaactctgctctgtgcccttgggcaagccatttgacctttctccaccacagtctccatttgcaaaatggtggttacaatcttccgcagccatgtgtggtggctaaatatgcaaagcaccttatgttccagaaggattatgagctcatccatggtctaggtatagacgtgctgtgacgtgcacatgatctacaggctgagctttctgtttcaaaggtgactgcatctgtctggcaccaaggatgcagctaagtgcaattctctgttctagacagggatacagaggccctacagtattgggggtatttcttggcagagggagtattaatcttctgtgagaaagtgaacctaaaattgaacctcattgaaattctgactaaattttgcatccaaatgcaatttattgaaagaggaaaatctctgaaaagcaaagttgattttgcaaatgcaattattttaatgtgaataatataagattattattttgtccattaaaataatatttataacatctatttgagttccctgggatacatttgaatggtgggatcttcctgtctatttcaattaaactataaagagctccataaatatttgacaacaaacttatagcagccttattcatatttttggtaagattgaatggcttttatgacaaaaattcattgagtaaagtttacctggggtttcccggagtacttattaccaaatggagcagaagtctcctcatttcttccttcatgatcatctattcatggttttgcctttaagccaggtcaggaccaaggccaggtattttattgtggcttacaattaaaggaaggaatgtggactacctgtatctattgcaaactataactgggattagggaccaaggtagtgaggaatttgtgtgtttgtatgtggtagtggggtggtaattggtccttgacattgcctgagtccaaggtcatggccataactttcattgctttacctctatgtgttaacttttgttaaatcacaaacacaaaactgaggttaccagtcttccagtcttccagagggtttttctaatcatgtttaacctgccagtcttccctgctatccatacaataaattacataaaagcttgaaaagcattgttcaagaggaattgggggagagagattccaaagcattctggccaagtaaacaaattaatgaccttattgagtaataaagaagattctaattttttttgatacattctattaattctaaactgaaggaaaactgtttctctctggttgcacacatccacaaaaatgaaataggctgtagatgtttaattatctatggaaacctagagtacactacataaggcagactttctatgctaggtttgatctgtaaatgctttaagttttttcctttttgggaggatttcatgatcatttatccacattgtagtcatagtcagatgtgaaaaaagtaaaccccaaaatatttgtatttcagttctttgtatctgtttttctacatgtggaatggtacctgttggggggtctttccttttggaagaggtggaatgggtttgtgttagagggtgggaagggagtgggcggtgtccattcagaaagcccttaggaagtaagtatggtgctaattctaacgggtgaggtgtggtctgagagagatttggaagaagcagggagctgcaatggcatgtagactgcagctccttttctggctgtgccccaggtggcatggttttccatagagtcctggtctcattgtcttccccccactctctttttctgtgtcgggtgccttttttttgagaaactaacacaagatcattcatgcaatgtgtcattttactaaccgactaatgtactaacaccctaacgactcatctttgtttttagtttttttaattaacaatcgttctgttcacaatttttaatttcctttcttcccccttctccgcaaagcactcaggcatcggacacgctatggtaaacaaactacattgtctggtagatatcattcttattgtctctttttttgggtttgccgtgtgttgccccccttttcctctccaacccccccttttatcctctttagactcatttcttcttttaagattttgttacattaaatgcaagcctttctttttcttaaaaaaaaaatggaaggggatgcacttgtcctaaaaatgatatttggttgaattttgtggggaaggtttccttttctctagttttcaattttttcccccaaaaaatgctttttttttttttttttaaatctctatttggctaaatttgttttcttttgttttcttattttacaacttccaagttacatactagggacaacagagatttatagtgagaacttccttctttctgtgccttcctctccctctcactcttcctcttttctttttttctcctttcccactccttagtcccttttctctttcccttttatatggccacggctgccacaggtgatctggggaggaaagtactccacttcctagactctttcttacccttcttttactttactcccctaccgtggccaaaaggatatccaccaattatgttctccatacaaactctgcatggcatgttcctgtctcgtgaattttcctacctgcatcagaatttgtttcctcattttcctcctcattactaacaacctaccaatcatcaacccaatttcagtttcttctcttttatttttccccactcttcattctcctttcatctttcatatatttgggggttgggtttggactttttcttttcttttcttttcttttatttagtaagggaggtggcaggcagagaaaagactaccttttagttttgaatgcttttttttcacttccatcttgttcttcggtttgttcaatgcatgtaagtgtgaagtggattttgattctttccctaatttctccccaccctttcccagttttgtttttcttctgccttctctcttggttccagataatttctgcatgggtgtatcggtgtatggtgtgtgcatgctttgaggccccatcgtttctctctgccctctgctcctttcatggatgttgggtaaaagggtgctatttcttttctgtgggcattattatttttattgttttggttattattcctcatcattcattttattgttgttcttagagttgcctttttggtttgggtcatttcttctcttggaggtggtgatgggagccaagggagggtagggattggtgtcctggggcagtccatggcatgtatcatccatgaccatatcagaatcaagacccttctccttccctccctgaatgcatgtttgtcagcgtggtgtgagccaaaaaatattaataacaataaagataaaagaaaagaaaaaagaaaagaaaagaaaaaaggaaaaataaaaccatcaacaaccaaagaccaacccctaacaaatttcatcatcaaatgtcttctttgctgtttttcactaccaccatgaataacaatcatgtaagaaataaacaatcattttagcaatgaactgagacaagtgatatcgtctgaggatggttccattttctagcctgactgtgtaaagattgcaatgggtagaacaaggtgcccagcttggaaattctaacaaagtcatccatgagtctgcagggaaatactgaaggcttgagacccagggaggcagaccagaaaatggaacttggctgcacataccaaaatcaaatcaaattagaaagtatatctcatgaaaatcttaatgaaagtgatgccacaagtaggggaagccactgggttatgataggatcgtaaggtcattgttgggattttttttgtccctatgtccctccaccaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggtaaagttcacccaattctatttaatgcaccatgtgattgtttcatttataaacaaatgacatgtctaaatcaatgactggatctgtcctcaaatctatgagatgatagattgcagcagaaacaaccttgaacttggaagtaggtgtcctacgttttcattcccgcttaagctggttgcatgacttggggtttgtcactttagtactgtattagtctgtttgcatgctgctgataaagacatacccaagactgggtaatttataaagaaaagaggtttaattgatttacagttccacatatctggggaggtctcacaatcatggcagaaggcaaggaggagcaagtcacatcttacatggtggcagggaagaaaaacttgtgcagaggaactcctctttaataaaaccatcagatcttatgagacttattcactatcatgagaacagcatgggaaagacctgaccccatgatttaattacctcccactggcttcctcccactggctccctcccacgacatgtgggaattgtgggagctacaattcaagatgaaatttgggtggggacacagccaaaccatgtcaagtaccctgtagttctatttcctcatctaacaaatggaagctcttatcccacagatggctgtgtttataaattaaatgcagtcacacaggtgaaaggccattgaaatcacaaggaactagatgagtgcaaagtttgattttgtgattttgacctggcaaataggaaagctctagctaaaagtggctcaatctgttgttgtgtaccctgtctaaaatataacatatgtattattttaccttcactaagcctggtgttcccaagggtctcatagttgagacggaagaaaattcttataatgtgacattaaggctcagaagactggttttttcctttgcttcttcttcttccctgagagctagtagctgtgaaaaaacagtgggactttgccactacttgtttattaccattgtagctgatgtattgagacctctttctgagagcaaaggagcttcagccaagtgtaagttcaacctctaaggtcaattgttgaggcaaaaagaatcagactaaatttggtagagctctttcagaacactgtggcatcaaagcagtgcactgcacattttaagctaagcttcattgccgaagatatctataccatctccctggggatgttacttgagaagcaaacagtgttccttcttgtagataacaatcccttgtgacatcttatgagtctcctcttggggcatatgttttattcttactatggttatttgaaatttgttgaacatcatttgtatatgagatggcactgtccatgcattcattcatgccactgccctgtgagccttgtccaggcaggaattgtgtctgttaggcatggcacatagtagatgcataataaggatttgtttgtctatttatctgataatcattgagtaccttttttgtgctgtaactaaatttggtggctctttttaagccatgatctccatgctccaaggctttgccttgtaggaagggagatgagatcagtgagtgaataagtatagcataggagtacatgtgttcagtggcacatactaaatgctctaattgagtagaggaaacataaattttaggtggaagtcagttttagagaaggagtgacatttgaggcagtccttgttgtaataaatcatgtgcgaattgagaggaaggggtagaaaagagagacataataaaggagagaaaatccaattgtagctttgtattgttctcagcctgtaggacaaaataagaggagcacccaaagagtgctattatctctctgcaggatgttacctaggcttctgctggcttcagagatttcatcgtcatttctgatggaattatggtaggcatagagcccttcctcactgggatttactcctatttggatagaataaaggtatagactatgcactgtctagtgaaccctgaaagactcttaaacactgttaaatcacactacattggaattgcactctcatcagaaaaagactgcaacattcttgttaccaaggacatggctcaggaatgaatgaggcattggttgctgtggagtgctcattcagttttgtagtgcaacagtcctgagcatggagtctctccaggacaggatttaggtcttgcctttaggattaattttctcctacacacaattatattgagctacctctccattatatacttagagacaatggagcaatttcccaaccatgaatcttctatctattaatcaggaaggatgccctgaaaattttgaaacaagtctcataaaaacacaaaggtgtctctgatgactttatccatgtggaaacaaaagaaaataaaatacacacacacacacacacacacacacacacacatttttgctgcccagatagagagcagaaagcttcaaaagtctgtcagaatcattctgaatagcttaaaaggtaaaggcagttctgaaaaacagtgtcaataatagaaataactataatcagtgatgtcaatatatccttatcttagctagcagcacaaatatgcatttaaattcagaccaagttagaaaaaggaaagttcaaaacactaacggaaatgataggcaaagctagaacttgataaactcctgccccgtctgttttccctgtacagcgtgatagtctttctaagggactcggaagtcttcttatttgtctgagtactttgaacagatcactttgagtctaacgtagtgctggcatattatttctttgcatttaataattacacttcacttttctgtgggcaggtctatggagatacttctcttgttcttggtatttgtttttgataaatcagtaaacagcaaaggctatgttaggattcagctacctgataaaccccactcacccacttaaaccatagaacagtctttaattatttcacaatctcttcttccccttccttttcctcttgctgccttaaaaaaatcttctcttgccatttgtggctttaagttgtcctaaatgaaacaaggtgattttatgtgtaattttcttcaaattagggacatggcaaagggcctatgcaatttctgctccagatcatcaatatttctttgtgtgtggcacaaaataggttttgtctttgggactgtagttacttcacacctaaaagctaagttctggctccgtgattgtgccaaagggactggatattacttgtgtgcgtacttcctaacttcataccagtgtaaaagccacaacaaagcgtccacattgtcgtcaaactatgatggttctctacacaccttagttatcaatatgcagtttgtgtccacttaactatcatgaagtcagcatcttgttccttttcatgttttcacattttagtgtgtctgtctcatgtttgttcttgttgtatccccagctcctagaatggttcttggcacttagtggctctcagtcaatatttgctgagtgaaatcacatgattgtacattaataaatatctttcctaaatgaatgcttttaggtactattgaccacttgactttcctgggatgactaaagaacatcttgacatggcagtggttgaatctttcaagaatcttctctgcctccccctgagctatcagatatgagaaaaagattatattaaaagcctcagcaaggctaagaggaatgattggaagttcctctatgaaaaatgggttagaaaaggctatgagggagacatcatagtataatgaaaagaatactgggcttcagatcagaaaatctgcttaagaatgctagctttatcactggctatataataagaccactgatcttactccagtctcagttttctaacccataacaaggagataataaaacttctgttgcattcttaagaaaaaaatgaaatgatgtacataaaagtgaaatcatacagcattgcaaaatacaatgtttttgcttataataattattaaggattatatattgcattgtataaaatagtttacaaatagaaatgtaagtgtaagtgaatatccattaacacatggaatctctatatttctcatattagcaaatcattgtcaggaaaaaaaaccccatcattctgaggtttgccctacataaattctatcataatgcaaaaatagggataactcatcccacctgccctcaatgatgactttgttttttgcctttggtcatttatttgacactatgttttcctttattaaaatgtgaattccatgagaacagaggtcctatttgcttacaaatatttccccagcacctagagtggaccctgacattaaaaaaaatgcactcaataagtatgtctggaataaataaataaatgaatatgataacctcatggagctctgaaatctggtggagtttagatgagcaatgtgtaagtccagacagctattaaaaagtatcataggctgagtggcttataaacaacagaaatttatttgtcactgttctggaggctggaagtctaagaacagtgtgccagcctggtcaggttctggtgagggccctcttctgggttgcaaattgctgttttcttattgtgttctcacatggaaaaaagaggataagagttctctagggtcccttttataagggcaccaatcccactcatgagggaccttcatgacctgaccttcatgacctcccagaggccccacctcctaaaactgtcacattgtgggttagaatttccataaatgaactttggagaacacaaacattcagtgcatagcaaacaatatatcccccaaacctataatatgccaaggactgtgctaaaatacaaatatgagtcaaacatgtttcctgctttagaggaactcacattagtggggagaggcagacacacgcataaatgcaataaatagcagttaatgcacaacatgaggcattcttagttacaatgtggctgctgaggagaaggacctaatacatcctggggttcagggagcatcccaaggtgaggtgcttgaagccaagtagaagtgagcatggaagcatggggaaagaggtgctccaggatgaggggcagggtgagcaaaggcatggaggtagagcatgttctggtgtctgggtgaagaacttacaaacagcttgctaatttcaaggcccaaattataagactgggagctttggactggtagctgcggttaggtagggaccatttcatagaggcctttatttcatgctatacccttggactttgttctctaggtaacgggggagccattgaaggaccttatgcagcagaacatggtcagattggcatcttacccatcaggccttcattctttgaggagtaatgttaattcatctaccactttcccctgatgtatgtttttgtcctaggaagttgaagatcagggatagaaatggtggtccctcggccgagtgcggtggcttacgcctgtaatcccagaactttgggaggccaaggtgggcggatcacgaggtcgggagattgataccgtcctggctgacacggtgaaaccccatctctactaaaaatacaaaatcaaaattagctgggcgtggtggcgggcacctgtagtcccagctacttgagaggctgaggcaggagaacggtgtgaacccgggaggggcagcttgcagtgagccgagatcgcaccactgcactccagcctgggcgacagagtgagactccgtctcaaaaaaaaaaaaaaaaaaaaaaaaaaaaagaaaaggtggtcccctgagcttcggcattagattggcgcctgcctctctgaattttaacattactgcagacaactgcttccttctgactcccatttcagtttccaaaaaccctccctgagaggacatgcatttctcttttcctctgtccttggcattactgagctgttcaatgacaaatgaaatacaggaaggccaagccaagactgagttacatgagtagggtccccatcaggctactcaagcccatcacagtttcctcccacgtgttggaccttctgtgtagtttgatttggttatttccacaccatcctcttttctcctcaatctgacactcctccattttcccaagtggagaagcgaaagtgccactgagacctctgggacagactggactctctcatctctcttttctcatggcatctctaatggggaggaaggaaaagcaggagaattgggagaatagaacacatatttaaaggaaaaaggattggatagaacatcattgtgcacattacattccacatccctttgtgattattagccatttaaaaccgaatggagttttgcagccagagatagtctctgaacagatgattaatggcttaatctgtaataactttacattttatagaaccctgataggcgtccacatctggtgagccaagctatttaaggctgtgttaattctgttaattgctatacgtttatttgaattgctggcacctgcgggctttgggataatgtgtttgttgttgctttttttcttctttaaaaaaaatactcattttattttaccctgtcttgcttgctgtctcttgttgctatctctcatgctatcacttaatttcttctctggattttcttttgggttgtcctctttcttccttactcattttcctccctcttccccatctccgttccgtttttctctaattcgtttgtttcccaagctgttgttttggtagccttcctgatttctcaggtggtgataatgtctctgtccataagcaggtgaatttaggtcatagctttgggcctaaatattcctttttcctgtcatgaagactactgtgcagcgtagggctagtaaaacccaagtgaggcttttagaatcaacatgagacatgagaagagggtgggcttcagcagcacaagcccagggtttgagtcttgcctagactcattccttgctagttgcatggcttttagcaagccgcatgactgttctgagcctcggtttcttcatctataaagacagagactaatactgatttcatgtatttttatgtagggagcaaatgggattagacaaatggaggtgttttataaaatacaaaacactatacaaaggttaatgaagttgttatttatgttattaattgaaacaaaatcaattagttcaggccaaagaaccacttactgctcttcaccatttctgcaattaaaaacctgcagaagttaggagagtccaatgtagtttaattaaaaaggcctgatactgggttcagttctaatgttaattagaaaattatacaacttctctggatatccttgtcttgatctgtaaaatgaggatagtaatccctgctaatccaaatgcacactactgtagagaccttcttgtaaatgtagcatagaacacacattattgctttgggtagcaaggtaaacatcttgctgtacatctttattccattaaggaagatgtacggaaaagcactctgtgggtttggagataagagcgtcttgacagaatgggagaaccaacacaaaaggtgaccagaagaaataagagttgagcaaggtggaaagaagtgaagatgcaaatcagaggaaatggaggaacgtggcagaagaagaaaacaaaaagcaattacggcatctcaggagctaactattggcttgtcatgggctgagtgatgtcctctgcaaattcatatgttgaagttctaacctttagtttgtgactgtttttgaagatagggctttttaagaagtaattgagatcaaatgaggtcatatggataggccctcaaacaatatgattggtgtcgttataagaaggagtgataaggacatggatatacaaaggaaagaccatgtgaagacagagggagaagatagccatctacaagctaagaacagaggcttcagaagaaaccaaccttgctgaaaccttgaacttggacttctagcctcctggagtgtgagaaaataagtttcggtaaagtcaaccagtctgtggtattttgttatggcagctctagtaaattatagagcttttttatgggttgaccataaaaaaaagatggccatttttggctgggcatggtagttcacgcccataattttagcactttaggaggctgaggtgggaggattgcttgagtccaggagttggagaccagcctggtaaacttaaggagactgtgtgtgtacaaaaaacataaaaaaatttagctgggcatggtggcacacgcctgtggtcccaggtattttggagggaggtgggaggatcacttggacccgggaggttgaggctgcagtgagccaagatggtgccactgcactctagtctgggcaacagagcgagactctgtctcagaaaacaaaactgccattttttgtgtgtgaggacaaaaaaaaaaaaaaaaaagtcaaatattggcaatgtcgggtgattcaatttcagaaagaaatgtttgtaaagaggataaattgaatcttctggaaaagagatgactttctggattacaaggaattgaagtgggcaggaaagagagagagaaagaaagagagaaattggcaatgtcagtcgattagagattcccattcccctggctgtggttgttttctttataggtggactcctaatgcagtttggacccataacatacagaggcacagaggaagaaggagcgaaaccctcagctactggggacagggatacatttgaggcttatttcagtaggaaccaggtgtgaacatttagccaagcgtggctgtaaaaaagtggtatgggcctaaggaagagtgaggagcactgaggtctcaaagatctttggtgtttcggtgctgtgacagacagagagtagttcttcagttagtgccacaataaaattactaaagaaggatttgctgcttacagttgatgggttgttgatgaagaagtagatttatatatatatatatatatatatttggcaactgggtattcattctgccttcatctgatacatgtttcttgatttttattcccctcattctcaatccaatgattcagtggcacctgctccactcccagctccgttagtgagcatgtgatccctaaatcaattagagactcctaattagagactcctattcacctggtcatggtttctttcttcataggtgagctcctaaaccaatttggatccataacatacaggctcagaagttttgtctatatgttgtagggaaacagctctctcctgctttgggctagaacttggagtggtgttaaactaagcttctggccactatcttgccaccatagtgaccaaaaaggaagccaggatagagaaaatcagagccaaaagatgggaagaaactaggccttagtgacatttttgaaggccctggtttaaacagttttcaaattagactaccccttaatttccacttatggttgaataatgtacctctgttgcctaaacctgttgtggctctattttctatcatttgcagcaggaagccctaggtgatgtagcagaattcctcatgttcctattttactcctgttttttgctaacaaaaagataggtccttggacagggaaagacagacaaaagtaggaaatgtaatactggaggatcttagaaatcagataatttgctctgtattaattcaaatttcctgcctcagatgaatgctatcccaggatacagagagaatttgtaaatacaatttttgaaacctagttggtggtttttgaggaacgctagtgaataaagaaggttcctaaagactagacaattgaaaaatgtagataatgcaaacaatgaacttatgagttgaactgaaatctggataacattttggagtgcaatattaacagaatgtatgagcccatagcagagaaaagagtgatcaatataactgccatcactaattaagagcactaagaaaaagctatatcatatcaaccaaattcacatactcattcagtagtattaccgatgattcagaaaagtactatggacctcatctagctaaatagcagcaaagtttttgaagacacattttgtgatattctcattaataagatgagcaatagggtttagatgcaagagctatcaagctattaaaataccaatgggccctgattaagtggatttttttggcctatatgaaagtttttgtaagatggcacaaagctctgtcttatattaaggacttgaagagacataagagaacatggcttgttaactttgtggatggcagggacagaaaatggtagaaattgtgcatctgtgttatctgaggttgaattaatagaggtctgacctgtgcaacaaaggaggtaacagttctgcagtataatttattggttaagaaagcaggctctggagttagagtttctggctgcaaagcctaactctactcccagtagctgtatgatgctggataacatacctaaccttctgttacttattaaatgggaacaataattatacctacttgatagggctgttgtattgagatcatgcatgtaaaatagctgacatgtagaaaatgttcagcaaatgttatttattttttttctgagacagtttttttttttttttctgagacagtgtcttgctctgtcgtccaggctggagtgcagtggtgcaatctcggctcactgcaccctccaccaattctcatgcctcagtctccgaagtagctgggattacaggcatgtgccaccacacccagctaatttttgtatttttagtagagaaggggtttcaccatgttggccaggctcatctcaaactccttcaagcgatccatccacctcggcctcccaaagtgctgggattacaggcataagccactgcgccaggcccagaataagcttttaacatgacaactaattgacagattagaatatctttagagctgagctgtaaaaaaaaaaatacccaaaaaactaaggcattcaagatcctaacaacgttaagaaggcttaactaatagaaccagggtcatttaacctgagaaagtgaagatgcctgtgcccaaggtttgagagtcgtcttcatacatgaaggactgtcctatggaagtggaagaaaatgtggcccatatatccttaagaagagaaactaagtctagtgagtggaagctgggtacttaacataaggaagaactttcagtaagagctgtccaaaactgccttcaaagtaatgagttctccaacactcaaggcatccaagtagagactgggcaaccattttgctgaggttatcgaggggattctggaatcatatgagtggttttgattttatagatagatctatagatagattgattttatatgatagatctatagttctacgatgaatgacctatctgcaaagaaagaataaggctaactgattagctcaggttcatcatgtggaagactttcctcattaatctccaaatcagttggctttacatgtcccacaaacatttattgggttgcccttgtggtaagagttgaggttcccagccactatcatcacctattactcacttacaagaatttatctttactcagtcctttacttgatcatctcgaaaaccgttacaaccacagcaattataatcatagcagcaacaataaagactagcaattattgaacacttaatgtgaacacatgtgaaatgtgtgtctacatggtgctatgtacttcagacttattccctacttatttcctaatttagttctcacaaaaaagcttatgagctggattctatgatcattactaacttgaatttaaagagagcgagtgtctttcccacttacatcattctaagtgttggagttgagatgtaaatactgtcaacatcctgattttgctgccctttctaccaattcagtcataagagttagtgacgaagaaaaggaagctcctctggaaaaggttggtgattctgtgtttaaacttactgtaaggaattgtctctcactaccgcttagagtctctacttcataggaaaggtcatttaatcaggcaaaaatgttctgttgggagactagatacaattacctatttctttcaccttgccattgattgttctgagaggaaggcagtttttgcttgatttcccactttgggcaaattgatattgctcaacctgctaacggaggaatgattttcattatggtacctgagagggaagatgctgctcttagtataaatgccaagcagtgcaatagtttcgtcttgagatgggcagcacattgtttctttttgttccagcctaatattttccatgaagttggagctatttgcctttaatgccttcaaaacacccaaataaggagcagctactatttagacttattatgaattttcagtctgattttgggaatcacttacttagctttgcatttttttttcttttttgctcgtcaagataaattcagtggaactcattgctttctaaaaatgtcacttatttacagcaaatgtaatctaccacaacattcctactgagacaaaatctcttgtgtctttgaaagcctcaaaggagattaaaaaaacactagtccttgtacacatatacctacagggataaagcaatcattgagctaattaattagcttatgttttcaaaaattgttttgcaaatgcagaaacgactattccattagtgttgcggtgcttttgtaaccttgtgttctgttcctcatgtggagagtgtgccacaaatagttcctgcatagatttcaagagagatacaaggacacatttttcacttctcaaatcagtgaagatgcagcttagggcagcaacactgcacaccaattatcaaccaataaaattctcctccttccctctcccttagcttttccctcaccacccaatatcagcagatgttctatctcatactttgtagggaaaatagaaattgttcaggtaatgcttgctaagcttctctctctccaccttaagacttaccttcaaagattctcattgctaccttcttcccctcatcttacagaatgaactttcccctcctctcttgcctcttttgagatttagcccctttaaagattccctctcttaatcttcgatctcccattctcctctgctccatcccttcagctagagacatactcaaaatcacttctttgatactgtctcctgctcaatttacacctaagctcattccccactttcaatgaaaaagttcttgggagaatggtacatatttctgatgtcccctacttcatggttactctttaaccctctacatttgcatgtcagactctgaactctaggatccttagcactttagtggaattgttttcttgttttaccctgcttaagttagaagtactttattatatgctcctatagctctcagttcaaaacttcaatgcattgcaattgttattatagtcctcatcacattgcactttaacatgcactgtgttcatatgtttcctcaatagactgagcttctaagagacaagaacaaagatttatgtagattgcatattccctctgaagttaaacataggtcctgacacatgaatagatgggaaatattcttcaataaattaataagtatttgtgaacatcagtgatagaattattgttccaaagttccaatttctgcttatattcattttgtcaacagcatgccactcatttacttattcatgaatgcagtaaatattcatggaatgcctactctgtcataaaatctgttcaaagagtgggagtgtgtggtgaatgacagcatgtataaagtctatgaccctatggaattcacattacggttgaaggagactaagaataaatgcaaaacagataattcagatactttcagataatgataagtggcatgaaggaaatgaaagagaataatgggtgtattagtccattctcacactgctaataaagatatacctgagactgggtaatttataaaggaaacaggtttcattgactcacaattcagcatggctgaggaggcctcaggaaacttaccatcgtggtggaaggggaagcaaacatgtccttcttaacatggcagcagcaaggagaagtgccaagcaaaggagggaaaaagccccttataaaaccatcagatcttgtgagaacttacttagtatcatgagaacagcataagggtaaccaccgtcatgattcaattacctcccaccgggttcctctcatgacacgtggggattatgggaactacaattcaaggtgagacttgggtggggacacagccaaactgaatcaatgagatagtgagttggtctccaggagcctgagtggtcagggcaggactctttgaggatgcaataattgagacctgagatgaaagtagcactcagttacacacacaaaaccttggggagaggccattccaatccaaggaagctactaggacaaaaaggacctaaagcaaggaaagcttggcacattcaagaaaagtccaggaggcgatggtggccatggctcagtgagagaggtggtgagaggaaagaaatatctagggctggatatgttgcttttctgaaaagatccaggctaggcaatgtcaatttatcaagcttatctctgcctcagagtcttcattttccttttatcccatatctaggttgattttctctttttctttatcctcgaaagtgaggtgtccctctatctttgtaagctcacatgttactgtgctcagtcagcatctccttctctccctttcaacttccgaattactcagttattctcattctttcttgcagtatatatctatatattttttcttttaaaaattgtggtaaaaaaacacatatcccaaaatctactcccttaacacaattttaagggcatgctacagtatttttgactatattcacacggttgtacacagatctctagaacttttctcttgcacctttgatatttgcctatttgtttcttcttctcagagttaaaaacaagtgttagtctatcctttcataaaacccctctcttgacctgcactttattaagctcaggaagataaaaaatgcctctttccaggagacggtagggaaaaagccaaaacaaaatggttataaggtttgaaaaaggaaagataagaaaagcagcattggatgacccataacttctagaagccagggtgggtgcagtgtgctaaatgtgagaagaatggggcgtggttatgtagaattcaataggtttagaacagctcatactgtcattacctattcactcgagttagaaacctcaaagtgagatgtgatctttctttctcattccccttcttcctttttgccctcatttaatcaaacacaaaattcccttggcaatgccctgtatatttctgactcatctctgtcctctgcttcctggtcctttcactactgcctctccctctgcccccatagtacttcgcctatcatggtgtcatgatgagtctttccacctctgttctctctgctttctttccatgctgcattctgccccgttttgctctttgtgccattctttggaaacatccagtgcccagcaaagcatgtcttcttcagcctcccactcaaggccttctgcagtttgtcttcaacttgggtgccacctcctcatagttcctccctaaatttaaccagagtagtcttttcctattactctaaatgtatgttttaagttctttcttctataacttgtttatttggttcttctagccaagaatttctccctttctcttttctgtctgatgcttaccctttcttctagaacctagctcatggtcacctgcttgactgatcactgggttaacagtggtcttttctcacttctgaattccaagcacacttaatataatatagggtgtttcagctcagatttaggaggtagacttccaggttgaaatttttgtttttctacttactacctatgtgccttggacaagttagttagtgtctctgaaactcagtttatttatctataaaactggtatcttaatagcacttacctcagagatttcttatgaggatcaaatgagatgatgcaataaagcctttagctgaatctgtttcgtagtgagtactcaagaaatactagctattttgtcattcagttggtccttacaataccccatagccatttgttagcttttctggcttgcatacaatccctttgaaaacagagtttttgtagttacagcaatgctgtatataatatcaaattattaaagacagtggaaaagaatttatatcccccaaatgaatgtcttgactgactgtaagaaagttgctgtttctccttattacattttgaccacaattgaaatgtggtcaaaggagaccatctgccaaaggagaataattacttcttcacagacataggaaaaaaaactcactcatggataaatatgtgtgcatatgtgaaatatgaatgcagtgatttcacatttttaaaattcctggcaatcaaatgagattgtgatagattatcttttttttttctgagatgaagttttgctcttgttgcccaggctggagagcaatggtgtgatatcagctcactgcaacctctgcctcccaggttcaggtgattctcctgcctctgcctcccgagtagctgggattacaagcgcccgccaccacgcccagctaatttttttgtatatttggtagagacgggatttcaccctgttgaccaggcaggtcttgaacttctgacctcaggtgatgcacccacctcggtctcccaaagtgttgggattacaggcgtgagccaccgcgcctgaccaaattatctttcttagagtaacttttcttcatagatattaatgtaacagttcttatggatgatgtttaaaatgcttaaggaagcaaaacttagctgtaaaattgggtattgcttgatgatcaccagtgtcccattgaggtctaaaatgcttatgaagtttaaattgctttgcagtgtgttatgatctttcaattatctttaaatgattgatttaatgagcttctattattatattttaggtatggtgtttggaatgcaaagtgaactggacagtttctttcctggaagatcttatagttcaggggttgacagcattttctataaagggccaggttagtggcttctcaagtggagacaagtttgaccccaagaaatatttgacaatatctggagactcttttagttgttgaaactagggtggaggagtggttggaggggagtaaagggatattgaagggaagatgctgctggtgtgggcagaggccaagattgttggtgcactgtaggcctacaatgcacaggacagcccttcggtgacaaggaattatccagtcctgggtctcaacagtgccgaagctgagactctctggaccagacagtaagtagttttggtttaatgagccatatggtctctatcacgactatcaaactgtcattgagcatgcgagcagtcatagatactgtataaacaaataagtgtgtctgtgttctagtaaaactttatttagaagagcaggaagtgaattgaattggccccagagggttagtttgctgactcttgctatagttaaatggcaggcaaaacttgataattataatgcaacatattaaactctatctatctatctgtctgtctgtctgtctgtctgtctgtctatctatctacctacctacctagatctatctgtctacctagatagatagatcagtcaaagttttcacaggtttacaatgaagccccagataagagcacttagcctgatctgagatattagagatggtctcctgaaagagaaagaacatgaacaaaagttaaaaaaaaattttaagagtgaggagttagacaaaaacagtaattccatagagagagaatagcgtcagtaaagtcacaaaaatgcaaaatagcatgataagcatagagaactaataataagctaaaggaagtagaagtggcggtaatggtagtagtagtagtagtagtaatagtattgttcccggaaagggatcctgatccagaccccaatagagagttcttggaccaagaaaaaattcagggtgagtccataaagtgaaagcaaatttttaagagagtaaaggaatgggaataaaagaatggctactccgtaggcagagcagccctgacggctgctggttggctattttatggttgtttcttgatgatatgctaaacaagaggtatatatttattaaatacctgctaaagaccaggctctgtgctaccgtgctacacaggtagtttgattattacaggtctgaggcctgtttgtccggatgattttagttcacacccatagtgacacacgggtctcttcttgcttcattgctttttccctttttctgggaaagggaagaaagggagggcgattcctggaactgaggattcctctcctttttagaccatatagggtgtcttttaacatgctaataactataattagtgtataatgagcagtgaggatgaccagaggtcacttttgtcaccatcttggttttggtgggttttggctggcgggatttttttaaattttatgtatttatttattttttattatactgtaagttctggtttacatgtgcagaacgtacagttttgttacttgggtatacgcatatcctggtggtttgctgcacccatcaacccgtcacctacattaggtatttctcctaatgttatccctcccctagccccccaccccctgacaggccccagtgtgtgatgttcctctccctgtgtccatgtgttctcattgttcaactccctcttatgagtgagaacatgcggtgtctggttttctgattttgtgatagtttggtgagaatgatggtttccagcttcagccatgtccctgcaaaggacatgaactcatccttttttatggccgcatagtattccatggtgtatatgtgccataatttcttaatccagtctatcactgatggacatctgcgttggttccaagtccttgctattgtgaatagtgccgcaataaacatacgtgtgcatgtgtctttatcgtagaatgatttatagtcctttgggtatattggccggcttctttaccacattctgttttatcagcaaggtctttgtgacctgtatcttgtgccaacctcctttctcatcctgtgacttagaatgcctaacctgggaatgcagcccagtaggtctcagccttgttttacccagcccctattcaatatggagtttctgtagttcaaatgcctctgacagcaatagcagttaacttttattgagtgtttaccatgtgtcaggaactctaagtattttacgtgtgctaacacatttcataaacatagagctcagtgttgctggagtaatgtaaaataaggtttaagatgtgtgcatgcaccagggctagggccttatttttaggtggatataactgggtatgagaagaccaacaaggaggtaatgagtaagatttattaactgattggatgttccaggtaagggcaggaagaagccagaagtttctggtttggcaacattaattgaatgtaggtatgctggaggagaggcaggcctaatggggaaagtgctgtttttgatgggttgagtgggaagtacctgtgttaactgcagaacaaggtcaagtcaaatagctggagttgtaactgtaattagaatataagcaatagagttaaattaattgaaattgatgagatcagttaagaaaccacatcaaaaggaagaacaatgtattttaaagaagacttctaagagtaactaatatttaaaagaaggcttaaaagggaaaattagtgaggtaggagaagaactagagaaaacgttgtcatcgaagctaagaaagtaggaagtttccaggtatatggcatagtcagcagaggtcagtgccaaagagaggaccaatacgttgagaactgaaagtgccctcatagctgagaatttagacattgtaggtaatcattttgttttgcttttgaatgacagtgataatcattttcaaattcagagagaaaaaaaggcagtggaagtggaaaagctaaagatataagaaaactaaatgttgaaacaatatcccagtgaataatttcaaacttttaaaaatgtatttattaaataaagtacatataagaaatgttgctattgggtactatgctcagtatctgggtgatgggatcaattgtaccccaaacatcagcatcacacaatatatcaacctgcacatggaccctctgaaactaaaagttaaaagtataaaaataagtaaataaagtcaaacatgtgaaaaaaagaaatatttcataggctttttttcagttgctctaaatttttaaaaatacgtttatgcattttcctataatttgtgttttgcatttatattctccttttctctaattgattagctctatcattagatttaactgatacttagagtttgattggctcaccatctatttatcataatacattgaaaagtcacagttgaaaactataaaacctcaaggatgtatttatgtgtttagcaaatggaacacaaacctcatagatttgtaactttgagacaccaaagaatattgggagacacttatcaattcagttgagttcaattcagtttaaggcatttgttgaatgctatgcatttttaacagtgatatgacaggatttttctttcctttcaaagcagcttgccatcttatctgtctgtatgtttattgcataaagaatttacagcagataaagatgtagttggtgcaaaaaatatacagaacttgaaagatctaatcataaagaaatataacaaaatgctatatcatatagcagagtcagtgatacaaagcaatttgtactaaagactttgggagggagagaccaacatgaactagaatattgtgagcatctccatctaatgtttctgcctaaatgctgttcttctctagacagaactcaaccaaattactcttaacagaagaacaaatgcaagtgatgaagaaccaagggacaagcaaaggcatcaatatattgtttgctatttgaggaccaactgtatttatttatctttgtatctccagggccaggcactatggctaccatgtattaagtacatgcagtcagtgctgaattgattacttctggtcattagattagcacagctgagctgaggtagcttggaccatgtgctatgtggatgcttccctattaatgatgctaatgacaaagagaatcaggtccaagagacagtgagttgggagtacgccacctatagaggactaggagagaaaatatttttgaaagagaagactaaatgctagatgcactattaatgggaattggtcacgcccacaggactcttccctctagcataacataccgatatataaaaacatgcttgctgtgtgaccgaatgagccaatcctggcttaacatagacaaacaaaaaagaagttgccaatgccttcttcagttcagtatctcatgaaagaaatgcaaggtgaagagaaagcttaaatgaaaaaaataaagtgaaatctgtaagcctggttctcatttctaagggtttattatactggagatttcatgaaaatagtattgagaatgactactctgtgatttttgctagcttttagtccctataggcagaaaagcatttctaaaagagatttgaaaattgtggactctgataacactgctagttgtcatgtttttctctaatgaacagcttatcagtaaatgtgctcagtggttaattaccacattagagtttattggcatcaaatgtagtagaatgccgattatccttatgcaaatttggatttactgcaggttaaatcctgtgacctgaaatctaagtcacctgtcataaattaataggtccaggtactaggcctgctgggattggcagtgacaaaagaccccatgagttgggggaatgaatcaaacctgcatgggcaagattcattctttggaatgtctcacaaagcctggtgcagccaattgtgctgcagaggctgtgtggtgtttttgtgttgttttgattttgtttcattttacagggcagccaggcagtccaagcaatggttcaagccactattgatgccagcggtgtcatccatgaggtggcactggcacttggaggttataggagtcaggtggagctatatatggttccaaaacacatgtcaagtttggggtgtgggtacgaaaataaagacagattcccagatgtctccgtcagttcaggctgccctaacagaataccatagactgggtggcttaaacaacaaacatttatttctcatggttctggaggctggaaagccgaagatcaaggcctgcttcttggtctgcagatggccttctttttgtatcctcacatggtggaaagcagagatcatctctcttgtttctcttctcctaagggcgctaatcccactcatgagggctcctactcatgatctaattagaaccaaaggtcccacctccaaataccatcatgttggagatcagggcttccgtatatgaatttggggaaaatgtgaacattcagtccatggcaccttccgtaggaagtcttgtcatggcccaatctaagcaaactaaagttcacagttatctcaggttttttgaggggagtggaacgtaagacagcatatccaagaccatcatccaaaaacctatgcctatagtgggcccatgtgacagagcagatatggctgccacccagtggccacatggcagcccatagctcatgagtgctctctgggtttgcagaccgaactgcctatcagaaactgggacagaagcagctattatgcctcctgtccctgtcaggactgggtcaggaatgagggcattagggcttttgtgtgtctctcagattaaactctgctcacttgaggttaaaacaaggcagaagctggcctgagataatcaaagcctctttcaaatctatttgcttataaaggcaaggtgtttttggtgtctacaaacttctaacacatttgtaggcactgattattctgcaaataatgggggacctttctgaagccctggatccctggccaatgcaccctactccaagcacattgaaatttttaacaaaatttttaataaaattgagagatccttggcatctcaagaacaggaaaatcattacttcttcaaatgaatcattggtgctcataagggaaaagtctttcatgcctagggcatgtatccagataattttggtggggaataacatttcttaccacattgtgagtgtttatgtggctggggcaaaagaagttgtggtttcggtgctgatccattagcagtgagtgtggtaggtgaaagttccttaattgttccccagagtaaaaacatcccagtatttatagactattaggggagagggggttggagaggcaggtgacttttcagccctacactgatgacttttatgtcttccaggtcacattaaaatgttttgcttgaattagaataaaagtagtcctttttgtccactctaaattcagtgtcttggttgaaagtatccacagaaaacattcctcagtcttcataatttcccatttacaatagagaagcaaggctctctgtacttaagaatagtacaagctattttagatgtcagatgtagtctaagaatgattgagtcaacaaaggagcatgaagacagtgatgagttctccacacagcaggtgctcagtgtagggtgataaagaactagaatggcagctaagtaggtggcaccagactctgaagaagcacttagtcattgtctagaatgtgccagaccaagtgcagttttaaagctctctctggtctccttgtcctgtgaacagacataaggcctaaataagaggcagaattgggaggctttttctttgcacctcaccttccttaccacctggccttctaggcattggagacagaagagaatctcccacatgcaaatcagcccccaggtcatcttatagcaacaaaagcctgggcaagaattaataaagaaatgagtggaatctaaaagtctctaaacataaagaaatacctgtaagatgtctcttctgagagcccattatatagaaaggagtcaaaggaagaagagaagccaagtgcatggatccaggagagtaactggtccagtgcatttctgtttaccatacctttattcctctaaattttttcagcagttctggagtagctccattagatccttgatgagttaattttgccctagatcaatttcaaagcttaaggatacagtgagaagagaaggtttgaaataccttagggaaattacaggatcaaataaattttattattatgccagctcagacagattggtagtgttgggaaagattctagtgtcacaggaaacaactatcctgaagtttctatggcgtcttctgggccatattttaaaatttgactattcaggcatacctcattttattgctctttaccttcttgcacttttgagttattgaattttcttttttcaaatggaagttttgccgccaccttgcatcaagcattttccaacagcgtgtgctgacttcatgtctctgtgttgcattttggtaattcttgaaacttattattatatttgtcaatggtaatctatgattagttatcttcgatgttactattgtaattgttttggggtgccatcacccatgcccatgtagaatgttcatagataaatgttgcatgggttctgactgttccaccaaccagctgttcctccagccttctccctcccttcaggtttccctattctctttgatacaataatattgacattaggccaattaatagccctactgtggcctccaagtgctcaagtagaaagaaagagttgcacatttctcgctttaaatcaaaagctaaaaattaataagtttagtgagaaaggcatatctaaagttaagataggctgaaagctaggccttttaggcctagctgtaaaggcctaaaagttagccaagctgtaaaggcaaaagaaaagttcttgaaggaaattaaaagtgggcacatgaatgataagaaagtaaaacagatattgctgatatgcagaaagttttactgctctaggtggaagatcaaaccagccacacatttccttaatccagagcctaatccagagcaatgccctaatgcttgagttttatgaaggctgagagaggtgaggaagctgcagaagaaaggtttgaaattagtaaaggttagttcaaaaaagccatctccataacataatagtgcaaattgaagcagcaagtgctgatatagaacctgcagcaagttatccagaagatctaggtaagatcattgatgaagatggctacactaaccaacatattttcaatgtagataaaaagccttctattggataagaaaccatctaggactttcatagctggagagggaaagtcagtgcctggctttagaggacaggctaaactctcttttttgaatctaatatagctggtgactttaagttgaaaccaatgctcatttgccattctgaaaatcctagggccctaagaattatgctgaatctactctgcctgtactctgtaagttgaacaacaaagtctggatgagagcccatctgtttacagcatggtttactgaatatttcaagccaatttttgagacctactactcagaaaacaaagtattttatgtaaaaatattactgttcatcgacaatgcacttagttaccaaagagctttgataaaaatgttcactaagattaatatttttatgcctgctaacacaacatcattctgcagctcaaggagtaatttagacttttaagccttattatttaagaaatacagtttgtaaggctatagcttccatagatagtgatttctctgatggatcacaaagccttttagaaaggattcaccattctagatgccattatgaacatttgtgattaatgaggaaaggtcaaaatatcaacattaacaggaatttggaagaagttgattccagctctcatggatgactttgaggtttggaagaagttgatcacaaccctcatggatgactttgaggagttcaagacttcagtggaggaagtaactgcagatgtggtgaaaataggaaaaaaaaaaaccctggaaggagagcttaggatatgactaaattgatgcaatctcatgataaaacttgtatggatgaggagttgcttcttatggatttgcaataaaagagcagtttcttgagatggaatccactcttggtaaagatgctgtggacaatgttgaaacgacaacaaaggacttagaatattacataacttaattggtaaaggaatgataaggtttgagaagattgactccaattttgtaagaagttcagctgaaggtaaaatgctgtcaaacagcattacatgctacaaagaaatcttttgtgaaaggaagagtcaatcaatgtggcaaacttcgttgttgttttattttaggaaattgcacagccaccccaacattcagtaaccactagcctgatcagtggttatcaaaactgaggcagaccctacaccagcaaaaagattacatctcactgaaggctgtcaacttagatgactgttagcattttttttaacaataaagtgattttaattaaggtttgtacattgtgtttttagacataatgctattacacacttaataggctacagtatagtgtaaacataatttttgtatgcaccaggaaatgaaaaaacatttgtgtaactcactttattgtgatagtctctttattgcagtggtctgtcactgaacccacaatattaatatttttgagatatatctgtatgtgtttatgtccttaagcaatatatattacactttgagtgttcaaaatttatataaatggtatcatactgtgcatatctgtacagcttactttttaaacataatgttttgtctatgttgataagatttatctatgttgatttcattcattcatattaactgttacttcatgctccatacttttttttttttttgtagagacagggtttcactgtgttgcccaggctagtcttgaactcccgggctcaagcaattgactcagcttccctaagtgattggagctaaaattatctcccaccacacccagctactccagtatattttcatccacagttgtgccagagtttatctagtacatatacctagaagtgcagtttcctgctaggtcataagctggatgtttataactttactaggtattgccaaattgctttccaaagtgatgtacaaattcacactcccaccagcagaatataaatattccagtttccttgcatccttgacagtttttggtattgccaataaatcaaataatgtagtataaaccaactcaatatagtgtaagccagatttaccctgtaaaacatatgcctaaagttcccattttaaggtccttgtttctactgagaatccagaggcctcaaaggtgcatatattgcacattacctccctcatttcctattctactaagccccagtgagtggccttccctgcaggtgtcagcttggagctggtctcttctttattagcaccaagttgctgtcttttaaatttagaactgttgtagttcttctagtcctgcagaatttcattactctggcctcaattgctcacatgtaccatctttcaaaaatgtcaggatagatgagaagatcacagggccatactctccttcagacgataaagcaaaacacaaccaaaccctcaaagcagatatgattactgcagcaacaggaaataaaggcacaaaaattgttataaatgattgttttcatagaaaaaaagtattaccaaaatacattcattttttacccactgtaggcttccctctttggaggcattgattagtagatacgaaatccttatcttctctctagagtttgaaatgtataattaacaatggagtctgccagatcaacaattctcatcacagaatgtcctgtgttttagtctttgtggaccatatggttgatctaccttatcattgttattagtgtggacccttttttgtgttagtctttttcttacattttctacaatagttaaacaaaatatttatttttgttgttatatgattttaaaaaccttatattattcagcttagcctgaaagcccaactgtgcaacagaaaatggctcttctcttaattaattaatttcaatttgatgaattaactttaataacatgctaatgtatagaaagctactaaatttttcagaataagtgtattgaaatttctcttccaagagtgatgccagctttgcttcctttatttgtgagtgggaagtgaggtttaatgctacaatggccttctagaaaccctgaagcagtagtttgacaaggatggaaacgttgagatcattgaattattgagcttgaataaacttctgagcattcattgattaatttatcaaataaccatgtattaaacacttccatatgtcaggcactgtgctaagtgttggagataaaatgatgatcagggagaagatatccttctcctggttcaaatccgttgtctagttttcatcagcttttgagtcaatataatgtttaaggacatgagattctacagccaaatagaaggatttctattgctctttggttttgacatttaacttgaaaagtaacactaataatgactaatctataatctaagattatataagtatatgtataattacatataattacatattttatattgtgtatatatgcatatacatggatggaactggaggccattatccttaccaaaccaacacaggaacagaaaaccaaatactgcatattcttatttataagtgggagctaaatgatgagaacacatggacacatagaaggaaacacacactggggcctgtaggaagacagagggtgggaagagggagaggatcatcaaaaataactaatgagtgctaggcttaatacttggtgatgaaataatctgtacaacaaatccccatgacacaagtttacctacgtaacaaacctgcacttgtacccctgaagttaaaagttaaataaagaaaagaagcaccttttctatttattactgaaaaaatacatattgtaaaccttaaaaaataagagacgacaggttcttgagcagaaactgtgattcagaattttggattggctgcacttgaaatactaacataaagactggttttgccagtggaatctgagtttggaatttgactcctttttttcctgctactcccttccccagcttgtacatgaatgcagtcttctagctcatttaaattagttctttaacttatagcaactgaaagtagagtggtttgattttatcaactggaacaaacaactcaacagtttttgtagtttttgtctgttgctgtccctctccttttcagatgtcattaagtgactttcctgggcttaagagtctaccctgaggacctcaatactctggtttctgcccaagttgtctggtctacctcctgaactagcatgtctacaatctgaggaaatgcaccctaaattgataccctgatattttcagtgggctatggattggcaggaagagaccataaacacacactttatttaatttctgagttaattatccagggataaaagtattatcagaaacatggtggctacacaggaaagcaacagatgtagtattcactaaaacagcttcatttggtacccagagtccttcatagcagcaagcagctgatagagacactccatttgggggttgagtccttccaaatctttctggaaagctcaattctttctatgacacagtcttatgtgcttggggcttatgtcacattctaaaataattgacattgacaatcgatgcatgcccatttaaaggattgtttttgaacactggaatctgtcagttcttaatgcaaatgtagcatagcaaggccacatcttcttctggagcgggagttagaatccacgtgcagatgttctggacaaatggctttgcttccagatttgcaaaatgttcttgaaaacccttatccctataggcacagataccataagagaaaaaatagaaataagtaggaatcgggattgggatttgcttgaatctttacagcaagaccctctccatattttcagttttcaaaatcagtgaaatacttcagatcagtggtttgtaaattgctctgtggagacctcagattctttgataatgccagaggaggaaacataagtatttttcgtttgttaggacctcaatcattcctggataatgaattttcagaggggaatggacttggtttattttatagactgtttgagcctaaaggaaaatgactacacctcccaaagcagatgactaattttcagaaattgttttttggaaaagtgggtctcctttttaatttcccattcgcaccccatgtatgttctcttatcagtgaaggagatgagaagccactctggggaaaagacacgtagaagatcaagaaagctcttttcctcattgcgtgattgatactcggttttgttttttttgttgttgttgctgttgttttatgggagtcttgctctgttgtcaggctggagtccagtggcacaacctcggcccactgcaacctctgcctcccgggttcaagcaattctcctgcctcagcctctccagtagcagcgattacaggcgagcgccaccatgcccggctaatttttgtatttttagtagagatgcggtttcaccatgttggccaggatgatctcgatctcttgaccttgtgatccacctgcctcggcctcccaaagtgctgggattacaggcgtgagccaccacacctggccgattgatacttttttgttggttcattccagtgctgaaaattgggctggatttgccaaaacaaatctgaaactggctttctatgcctgtggattctgttcctattgtctgtccattcactgttctgtttagttcatggattaagactgtcagcatcacgaagtatcagcagtaggatgtttggtgcagggaagatgtgagcacctgcatatcttccctgcaccaaacatctgatactttttttttttgaggaaataaaagccccaaggaaccaagtacgacactttgacagtcattgggctttttgagcctgggccttgttaaggcagctgcctgtaccgttgtggaatcacttcagctactgtctagtcctcagtgctacagcctcagggcattgattttagctaataatagtggtcaacattaattgagcatttactatatgctaaacagtgtcctaagtgcttacttgtaggaactaattcagtcctcgcagtaactctaggagacagatactacactgtcattgtggatgggatggggtttgggtggggaattggggtggggcttgttggggaaagaatctaaagcacaaagatagctttcccaaggccatgctgctgatttgggtttggaactgggattaaaatccacattctcatgggttccaagcccatggttatagtcagtcattatgttccacttcctcactagctcttcatcaagtattatcagaaagcaaggaattatttttcagactagcagaaatttactagtgacttagtaatatgtcagaatgtcatggtagaaaatcattccagagctttgctgtttagtacagtagccacaatccacatctggctgctgagcacttgaaatgtgcctggtctgaattgaggtgtgttttacgtttaaaatcacactgtatattgaagacttaataccaaaaaaagtgaaagatcttagaaaaagtttcttatgttgattatatgttgaaatgataaaattttggatatattaggttaagtaaaatgtattattaaaactaacatcactggcttctttttacttttaaaaaatgtagccactagaaaatttataattacatatgccacttattttatattgctattggacattattctagagaattaaaaatgtgcaaattatccacagccatttcctcatacctgtgacactcagtcattcatccgaattagcttgtggtcagtttgaggcagtttgtctaacgtttgagttacgagatcagagcaagaggtgctggtccattttagacgtgctttatttagtttgtagaaaaacacactgaaccatcctattccgctacagagtgccccagcttcacaaagcagaatatggaagggtagactagtgaaaataagtaaatacagataaataggttatgacatgtagttgagattcagataagtggagcaagattccgcagattgcactgtattagtgacagtgagtgtattctaagagaggagaggatctttatgtgtggtaaaagtagctggggaccaagttgttgagaattttgtatgtcaggaaaaggaatgcatttggagtgacaaacttttgtcactttccaaagactccttttagaattctttattgatcaatagaatattttgtcgtgacttacttcataatttatgatatgttaaaatttccaaattttctgtttattttatgttagttacatcttagattgatgattccctggtggaatttggaaagacatcttaatcacaccagcagtatttatgtaaaccatttttaaggatggtttacttcttagttaactctaaaggaaggataatgtcatctattgaataaagattctcacttttctacttggagatcatattgtcttcttaaatctttgtcccttaggctttgataatggactacatctcatctgggggcctctcttctctgactgtattaaccatacttatcttggagttgaaagaccttggaaggaagccaggatctaacagtcagggtctatggatctttggcaagtattacaggcaggccctggatgtgtggagtaacagaggcctctaacgagggggcacaatagggttggcttatgtggacattacattctgaaattggcacatgaggttaaaaaatgcttataatcaaatttggcctggataaggcttttaaactactcctaaattagacgcttgaaagctccaaagccaggatttagcattgttgattttgctttgtatttcttctgagacacccctttccaggagacacggaagtcaggtctacttggaatgaggaaaagggttatgtggtaaatagaaaattctcagtccaggcacaatggctcacacctgtaatcccagcattttgggaggctgaggcaggagggtcactcaaggtcaggagttcaagaccagctgggcaacatagtgagtccccatttctacaaaattagctgggcatggtggaatacacctgtagtcccagctacttaggaggctgaggcaggagggtccattgagcccacaagttcgaggctgcagtgacccatgattgtatcactatacttcagtttgggagacagagcaagaccttgtctcaaaaacaacaacaaaatatcctactccctctcattttttccccaagagtattgaaagctgaatttgtgtaagttatacataaatatcatgcaacttcattgtactgcttattttcctaataagttaattgacttgtattatgctttacatattttgggcttgttacttgtttgtgcctaatgtatgaaaggcagctagaacctatctttctaaactgaagagctctaaatctggttagggaaatagacaagtaaatcaagggttataatgcaaattaagaagtactttaacaaggcctttcctcagtgctttaggaccacagaggaggagccattaaagtgatctgggcatgagtaaaggctgtatgtgacatcctagcctaagctaccatcatttctcattgcattggtgcaacaactttctaaatgctttctctgtttctgtttttgcccctggatctccctctctcccaagtctatagctccctagcagctgcagtattcctcttaaaaatgtaagaggcacatatgctcctatctactcaaaaccctccagtggctttccatcttgctcagaatcagagctcaagttctaaaaggcctataagaccttgtacaatctggcccttgctgcctctctatcctcatctccaatgtgcacctcctcattcaccctgatgcagccacaccaatctccttgatgttctttgaacatgctgttcacatgactgctcaagacttttgtccttactgtagtctgtctgcttggaattgtcattactcaaatgtctgtatggcttgttctctcatgtttccaaagctctgaagaaatgtcacttttttttttttttttttttgagatggagcttcactcttgttgcccaggatggagtgcaatggcatgatctcagcccaccacaacctccacctcctgggttcaagcgattctcctgccttagcctcttgagtagctgggattacaggcatgcaccaccatgtcagctaatgtttttctttcttttttttttttttttgtatttagtaaagcctgggtttcacagtgttaggctgatctcgaactcctgacctcaggtgatccacccacctcggcctcccaaagtgctgggattacaggcgtgtgccaccgcacccggccatgtcacagttttataggcctttcctgactaccctgtacaaataaaaacaagaataagcctccaccctatcctagcactccttcttccgtttagcttgtccatcaccatctaacatgccgtaaattcacttctttatttgccccatccccttagattttaaagttcatgaaagtaaaactgcatctgtgtcatctactttggaacagttcctggcacttagtattttaattcaatacatgtttgttgaatgaataacttacttttctctctggcatggcttccacatttatttgcctaatgagtggatcgataaatgaatgatgactatattctcttggcactagcagaatctgttatttcccaatgtaccatttctctgaaataactttacagttctttattggaacaaaagactttatcaggacttgtcaggagctcttggattctgccaagacagcatctcactcacagatggaaattgccattaattgtctgctttgatggtggagcacaacattggaaaagaagacgcctcctggaaagcaggttttgccattggtgagagagaataagagtgaattgggctggccacagcctccctcatattgagaaacccaattggtaatactcagctagcatacagattagtaatgtgtgagtgtctgcatgtgtgtgcatgcttccgtgtttatatattaccagtgtatgtgcgtacctttgtatatatgagtaaaaatatatatgaagtaaaaaatcaaaatctaataactcaaaatccaaagacttgaacaccccaagggaacactgaagtctcagcagaacccttgatgcttgggaaagtagaaatatagggaaggtttgcataattccctgtgttcacttctagctcactgaatgtgactttctgctgagcctaagcatacagcaatgaataacaacaatagtaacaacatgaggggtccctgctttcatagagcttgcattctagtaagtggggcaaaaagcaagcaaagaaatctaagttatatatggtggtataaatgctatgaggagaggaaataaagcacaatgagggagaagatgatggagtgcattttagaaatgggaattgatagaatctgggatttgcttgacaaaaagttgaaggagaagcagatgcaaagacctgagattcaggtgcttgttgaattcaagggacatgaaaaagaacaaattagggaaggtcaagttatataaagcctttaagccatggtaagaagtttggattttattctggttacaatgaaaaagccatcaagcgctatttagcaagggagtgactggtctgaattaggaaaacccccctggctgttctatggagggtggagtatggtgtgtgctagaagagacagaagatacatagatggctgttactgcaacccagggaggaaacatagcaatgtggattagagtagaagtgatgggaattgtaagtagatgagtgtgggatatattttggaggtagagtcaacaggatttattgatgaattgtacattgagtatgcgaggtgagtaactgaggataactttattagtcaagataagctaggctgtgttgtggcaacaaactgttccaaaatctcagaggcttaacacaaaagaggtttatttctcagtaatttgtatatccctgtgttttggctggtggctttgctttgtttattattgttcttactctaggacatgggatggcagggtaaccactaactggaacattgctggttgacattgaaaagggataaataaaatttaaagggtttcaccctgggagtgattaagcatttggcctcgacatgacacataacacttctgctcaaactaattggccagaagtaatcatatggctccatcctgcacaaggggccgataaatacaatcctgtcttgtgccaggagacaaaggactagagcctactcagacagcaacaccaatgactctatagtatcttcctggtttgaataactgttaatggcattatccaagtgcagatatttgaaaggaatgagctggggggatgtgaaatccatatttcttttttagccttttttagtttaaaagcctattgagtggagatgtcaagaagacacttggagatatgattcttaagatcggagaaaatctaggggtagagaaataaatttgagcatccacaacatgaatatgacacttaaagtatcaggacttataggtacctgttgagaaccctcaagttctatctttggattcctataaagaaggaattcctatagagaaggaatccaaagacagaacatgagggctctcaacaggtagagatcttacagagagaaaaccaacaaaggaaataaaaagagagaggttctcatggtagatagaaacacaagagagtattgaatcttaaaaggcctcaagaagtaagtattgcaagaaaaagggaatgctgagaggtcaaggaaaatgagatttaattattggatctggcaagctattgaccattttactggtttggtataaagaagaggctaatttaaagggggctgagaagagaatggtaagtgtggaattgatgaaaatggtcatagacaacttttggaagagttttgctgtaatcatagcagtaaagtggggtcagtagtgaaaagggacatggtgtcaagaagataggtggtcaggaaagggagcaggtttgtgggccagatgatggttttgtcttttgaaatatgctgacctgataaaaaggtattcaaatgaaaagcattcagatattagttggagatataagtcagacatagagaaaaaccagtgccagcataaacatggaggagccctcttcatagagaaaagagaacagggaacacagatgggctctgataggaaaagtatagagaaaaaagattgagcgctcacattaataaaatcaggagaaaaaagcagattatgtcctagaaatcaaggaaagaaagtttaaatacctttgcaagaggtttttcttcactttctatgttcctggaaatatgtagtctatattctgtactctctggccaaatttgaaggggatagtactgtagctgattaaatatataatctaagaactgtggaataaagataggattaaaggttttttaaatctcaaatcagtggggttgatgctctttgtgtttctgttctttttgttattgttttctcttgttattttgaaatttctctaaaaactacttaaaagtatagttagtgccatactcatcgttgtatttttcttcttttttacctcctcctcctccttcatcaccatcttcactaatgattatcactagcaaaataatcatcaccatcagacttcattaaattaactattttggtattttaataattcagagctatttttcataatttggttagaactactgaggggcattcattttagtataatagaacatttttatagcacttcttgttatttgagtacttattaaatgcttactttaaacatgggcataatttctgccctaagtccttttcagttaaatttcctaggaaagatacaagagttccaggatggaaaagaagtgctcagagggaatacaagagattaagaccacaaatatatggtatcactagaataatttggcagaggtttatttctatttaggttagttggctataataaacatatgtagataaatagtataggaatatagtacagggtaaaatggtgactcaatatcttaatatcaaatgaaaaatgggctgcttcctccttctaggctggaataatgtactattattgacaccccttctctggagtataatttggcttagttctggtggtctgttgagtggcttggtctcactctctttctctctctctctctctctcaacctctctcccctctcccccttcctcctctttctctctgcccttccttctggctgtccatccttctctccctcctccgctcctccccactatctctcacttctccaactcagttctttctatcagtgtcttgacatctaactagttaccctagagacctcaaagcaattattctttccttaaacattctttcaaaacccagtcgttccttaggcatattgacttgaatcatgtctatctttgccattgctaccttcttagttctaatattcatcattattttctgggttacctccatggcatcctaacttgtgcctgcctcttttgttttattccactccaatgatccctcctattcacatgcctctcctccaaccttctcccatcttagttattgtgcttaagaaaattatggatcatagaccaagtataggatagcagtgtgaggaagtagattgaaggagggagacataggagttggagttagaactagttcggaagttagattgtacttgtcaatgagagacttaatccagattccatctctctaggacagaatagaccatttctatctacatggagtatcccttacatgatatccatatttctctcttaacatcattgtacacatatgtttacatgtgtaacacttctactaaattgtaagctccttaaggtcagagaccatgtcctaacattcagtaagctctccatggttgtttgttgagtaaacaaataaaatatggtcttaaatagaaccagtgtcagaaggaatagggtggagaaaatgaatataaaaaagattggatatggaattaaatggacttagtaaaatattaattctgggacaatgaagagagaaggttcagatatatctacacaaatttgagcttaggtgaccattaacagaaataaggaagttgggaggaggaaccgatgagtttgcttttaggcaggttgattttaaagttctgtagagaattttaattttaggtggatgaattgttccagcagacaattcagatttgaagcctgaagctttggagggagttttggtctagaagtaaagatgtgttagtgagtgaaattaccaagacaccgcagtgaaaacaggaaagagagccttcatcagatgcgtgggggaagcctctttttaagaaatttggaaaaggagctgacagaaaatgagtctgaaaatgagaggcagaaatgagtcatcaaagagttacttggaaagtgtacagtcaggaaacccaggaaaagaggatgttgaggaaggagtgagagaaatgccagctattgcacagatattgcatattatgagaatggaggcctatataaatttgagtagtagaacatcagtaatattattttagaattatttgctcttgggttaaatatgttttctcttaggaagcaactaagttaaaacacgatatttagagtgctgcagagacaaggttgtaaaaattctctcctatatcatcggtggttgaataaaattcctttattggtttttcttggaactgtaccctctagccaaacagcccagtggaatccagtgatagaagccaaagaaataaaagctaagtgtctcaatttatcctgttgtcactttcagctttctctgctcattattagataccaagataagcaatagatttaggttttttgatggaattctagtggatgccttggctctctttgtcctggatctagggacactctagtcagattctcaaattttttcttttttcttttttgcacattcatggcttgaataagggtaagagagcccgggatagatgctaacaatctttcagattgttatctgaaatagatatcttgagatatgctgttagtattttcttcaaggcatgccatgttgttagcattttcttcaaggcagcccatgattaggccagaggaggaggatgccgctattcacttctaacctccatccttgaattatggtaaatacagaagatgcttgctggtcagaagagagttgactcattatgtcaggtagtaaaccaaaaattttctccctttatgatgaaagaaaacgcagataaaagcatgaccaataaacaagccataagaatggggaaaacagtgatgacacggggttagtgctatagaagttcccagaaaggtgtttgaaaactctgggcctataaatttaattatgtactattatttactaatattatatactaatatttactttgtttggaggtagaaacgctttactatccacttgtctttagtgtgaacactttcttaggaagcattaatgaaacacctaatactacctgcttccatggcagtccaaaattaagctctaaagattgaggagtcagaggtaaaggtcggtaggtttttctgtggtcttgacttcttctcaagatatctatttgatttccagtaataggaagtggctcccaattacatctattcccagggtccctccctattctcttgtcatcttgatttcagtttggcctgattagatggtactaagttttctatatggtaatttatattacaagaaaaattggtaaatggtgggatactgcttcaaatctgcagcaatataggtaggtgtctttggtgaggttttgtttgcaattataggattccctagatggggactctttcatgaaaaatcataacagcaagtggttgaataaaggttatttctagactgttttctccagactaattagagtagtacaagggccaaccatacagcctcatagtttcaagggtgctttgggagtcagatggacttgagtttaaatcttgcctctgccacataaaagctttgtgagcttggacaagtcatttacttctctcagcctcagttttctcatctgtaaaatgagataattatggcatcttatagaattgttgcgataatttcagatagtctaaatataaagcatttggcaggccaggcgcagtggctcacgcctgtaatcccagcactttgggaggccgaggtgggtggatcatgtgaggtcatgagttcaagacgagcctggccaacatagtgaaatcccgtctctactaataatacaaatattagctgagtgtgtggtggcacacgtctgcagtcccagctactcaggaggctgaggcaggagaattccttgaactcaggaggtgggggttgcagtgagccgagatcatgccactgcattccagcccaggcaacagagcgagactccatctcaaaaacaaaacaaaacaaaacaaacaaacaaaaataaagaaataaagcatttggcacagttcttggcacttagtatctagccttcattattagtcttagatggaaaactggatgcctcaatagacctggccaggacagcattcccacagtctccatcaagtcagcaagctttatcagctttatctctgatatttctttctagacagttcctctcctttttcatcattaccactactgctgtagacctgggcactaccttctcttagttggattttttggtaatacttatacacggttgccatgtagttctcataaaacttgttttgttttgttttgttttttcccccactgctcaaatacctgctctagatccctggtcctcagctttgtacttaagactatgatttggtatgagccagttttatcaatttaatcatctattttttattttcttcacgcatttctccccaaacacacatatcatccccaagccaataataattcctttcaaagtactttttgtacttttggtcttatgtatgtcatgttgcaatagcttttcaagttgattttcgtgtgtgtgtgtgtgtgtgtgtgtgtgtgtgtgtgtgtgtgtgtgtgtgtgtgtgttctcttgctttcttttagttcattccctatgtgaccaccagattaatcttttatataataccaacctgacctcgtcactcttctgaaccagagcgatttcctagtgcctttaggatcaagttaaaacttctacatcagctggatgcaggaggtcttctggggcatttttcagcctcaactcaactgtcactcccactatactgtgcaattcaactatattgattgctcttgagactacacatatgccaagatttctcactctcatttcttgccatccgtgctatttcttttaccttcctatttcaaaacctggctaatgccactcatttatcaggtctcaccttagtactccatcctttcaaaggcatttctgattgccccttccctctgcccacagcttgaattaagagctcatccctgatttcatggtagtttggaaatatctttttagaaacctttatcatgcaaattgctcattttgattttctgactgtctcctcttctaaaagaaggcttacttgcagtattttttaatctttgtatttccatagagcatgacactcaataaatatatgagtgtgtgaaaaactgaataaatgtgtgtatgtctgtttcttttaatagagtaagttattttagggaagggccaatgactcttttctgcttgtaggctccacgtttcctagcatggtcctttgtatataatagttgatcaataagtagtgtctgaataatgatatacatgtctatcttccccagatcattctaagtttttcagcaaaaagattgtgtcataagaattagatagcctccagcacaacgaattacaaatacttcatactctaatgcacatgtttaatttttgcttggagttgaacttaagttatggtgccttatgagagagtcaggcagcttctctgtactacataagcatgtactcgatgaagcttggggtcaaaaacctggaaactaagtttagttggaaatttaaatgctggagactggatgcatcctaggagtggattactagtattgatactcctagacaattttctattcttatttggttctttctccataaacctgaccagtccatgtatagcaagcctcaaaggatgcaagccttgttctggtgttttttattgcaagtcaaagtctatcaggagctgaggaatgagcagcagtgggagggtgtattaatttcctgtggttgctgtaacaaattatcacaaatttggtagcttaaaaatagtaattttattttctcataattctggaggtcataagtcagtttcactgggctaaaataaaggtgttaacagggctgcatgtcctcttaaatgtcaaggagagaatctgttgcttgactcttcccatttctgatagctgcccatattccttggcttgtggcccttaatctctatctccatattcacatcatctctctgtctgtatgtgtgatcttcctttgccttcatcttataaggattcaagtgcttgcatttagggtccacctggagaatacaggatagtctcacctcaagatccctaacttaatcacatctgtaaagactcctttccaaataaaataatatttacagtttccatggattaggatatatctttggggaacattattcagcctactacagagatacctttctctttttgtagattcaaagtgcttgatcttctaagaacattgtttgcttacagacatatttcaggagtaaatgacttccaaactgatggtccgttgaaaaaaagcctggggctgctgtcaggaaaggtctaatttaggtcagcctaatgccactgaacagatgtatatggcaacattcccaactcccattaggaaaataagccattaattaatacttattgaggagctgataagtaactggaagagctggtctgagttctggacaaggaatcagtgacaatcagtttccactgtctggctgttgtgggtagattgtggtccatctctgtaggataaagtgtgcacagttggcttggcactcactcttctgtgtccagcagtagctcttgccatctgtcttatcaagagaataaaaatgggtctaagttgtcactgggagattactgagtatcagtggacactatgagctcgagtgggcaaccccatgcaaggttagagcagggacttcaccaatgtttgaattagggaacttcagtacctaaaattgggatgcagatgtttcttgacttcttcatgtcttttccacctctttcatataatctaagggggatatggaccttggaggagtcttcctcaaggctttggcaggtgctcctaaacatgcttcatccatgcctacttgagtgtaatctgctatcttaagccacaggcaggagagatcaatttttctagtaacttcttttataatccagctagctgaagaagtgtgatcaaagaatcttaaaagtgtgatcttgaagaatcttagtttctcttctgttgtagagagaggatagtaatagttgctaagcctataggctctgaagccagacttatctctatttccatgctggctccactacttaatagctgtgtgagcttaggtagataataaaatctcagattcccagttttctcaattgtaaaatgaggataatagtaaccaatatatgcaaggtgccaggagatattctaagcatgttacatgtatttaaccttcttattctcacatcaaccctatgaggtaaatgtactattgttatcctacttcaaagatgggaaaactgaggtacagagagattaagtaacctgtctagatcacacagtaacaagtcgcagaacaagaatttcaactcagagtatatgcttcaactcagaatatacttcaactcagcatatttgctgttaactatattttatgctgcttcttgtgcctcagattgtgaggatcaaatagggtggccatctattccaggtcaccttggaaagttctgggtaatatctcctgtccaggtgaattattaatagtgcctccttcttttattctcaaaggtattgtcacatcttggtttgaatatatttcacatttggattaaatagtctttacatgtgaaacactaagaacaatgaccaacccataggaagctctctgttaatattagctatcactgtttctactactgccatcaccaccactgtcaccatcacccacattcatcccaagtctgggacccttagggttaggggattaacccaagttctgcaaaggcatgtcatgggagccactgttcccagttcccacacccgtagcagacattgctcgttgatcacagtacaacagtcttccttacttagtgtcatagacaaccattcgtgatagatcacgtttgagatgtgaaattaaaattatttatcacacctagttttatttaatctcagaatacaaaatcccagcgtatggagaatctgaatttagtctgagcttgtggttttatatgaaaacttatttgattcctagaagtgataatgaatttgggacctctttagacatcctatgtcccttttctccaatatttctttctacctatttctctattatttctacctcttcttttatataaatataaaagaaatttaattcatcagtttcctattctctgcctataattttatatgttataataaaagactattgaaatactaccaaagtggacacaatataaataaggcaacggagtgagtcatcataggaattacagttggcacccaagatcaaaggcttagaaaatctatctttaaatgtgatttgtgtaactggtagtgaaattcatttcaggttgattttgcatggcataagggacatctagtggtgatctaggtctctgcagatttactaaaggtaatgcaaactcataggtaaaagtattagggcctatataccatcaccttgaaagggagtcccaagaaaggaggggaccttttgttgcatgactacttttaagctagcaaagtgtaaagaaaccttttttggaaaaaaattaattcgagtaccagcatttctgtctatattattgtcagtttgcacccaactcttatttgctgcctcctgtaccaggttggaaatcattctgttatcagctacctgccaacctgacatattcttcctatcactttccccacctcttttgctgattgcagaggggctctttggagcactttgaaaagccacctgattaaagccttcattaggctagaagcagaagtgcttcacaggccaggcaagaaatactttgtaattgcttctgacgggcagatctcctttggcggttgttgagccatcaggaagccgtacagcactggtccacgtgtattttgtataaattagtgggcttgacattacaagaggttgcccctatacgcagtcatcttcttagccccagagttctggaacttacccattagcctgcacctctttatagaacccgtcttacgcatggttctgaactaactgcttctgtcacctggattgcttacaatacctgcttgcctcatgtgctactattgtttccaaccaactatgctagacttcttaaaggttctatttcattgaatgcttttacagtattttctatgactcttttgtctttgagcctctcagattagctttttctacaaaagctgtttggcatgcctattgtcatctattttctttcagagtagctgctaacagccagaagctgctagttatggccaaaggcctcattgttggagagtcgttcttgttctttgactctaggtagagaggatgaaggctctgagatactgtctcaaaacattcatgtgttttctatgacaagtcaaagctacattgtcatattagaggtgtccagtagccccttagcgtgcctcagagtgggaggtagtgttggcaccgaactttgtcagccagtctcttagaggatcttactggagtttgtgattgagcttttacttcttctgttagtgttctgctgagacatatacactaatgatagctgccactctggggtgcagaactttccatatagattgccttaaaaataaaagcaaattttctatgcatacatgccggggaaaactctactaaatattcagtggttccaagaaatgccttttaaccatttgtaatactttagctttctaccttttcatctcattacttattttcaggcagaatagatatagaggcttctttctgcattatagtcttcacagacttaaaggcatcaggaagtagcccttgtgattttccttgctcttcttcttcccatttttccacctcctcctgtaagcacgtactttgtgtcaggcattgagagatacagagagaaaaggcataggtttctccccttgagaggctcctggtctactggaagaaacagacaattccagcacaatgtgatagatacaatgatagcagttagaacatgaagccatgggggcggagaggaagaaatcagctgtgggtgggaatggagtgggtagaaatattgaagaaggtttctaaaaagaggtgatgcctaaactgtgcttcaagtggcgaatagtagttatccaggtagagaatccaggcaagatttatccctggaatgataaattggaggacctgctgaacttttgtcaaggctggtaacaatgaagtgaggactagatcaggaagaggtttttatataatgcttcaaagtttgcatttaattctgaagttgataaagaaccatcgaacaattttaagcagagaatgacatgttattcccagacatgttaatagtgagacgattagagtcatttctagtcctcggaataaaaataacagtagtttcctagtggttcagcaaggtatgttttaaatttcgtcatctttttaatcaaactgcttaaggcttcctttctactctaatagttacctttttcccctaattgcataatgtatatatttttagagcttttcataatcaggtaccacctattcacctcatcttaattcctctgctttgtgacatgtaacttttactctactggagttggtgccctcatcaaatattctaaaacagaaggaaatgtaggcattctctgggtaggtttgtttagtgcctaagaaaatgcaggaaatgagagtgtgtatttattgagcttctactatgtgccacacactttgctaaatacagggaatgcattggttatcacatcagaaacacacaacccatgtgtttatgacgcttagtttagaggatcgaaacagtgccatccctagcaaccagagggcacagaagtacagtttcaatcaagtttatggtcataggtccttgtacattaattgacatgacaaatatatctcactccaattttgatatgaaaaaatattccccccttaattgtccttcaactttctctgtgcatgttgttggcagcaattgtgtctcatggtctatcctccatggtctagagctaaagatacagtggttatttagtacatttacatgggattttgtttctaatattctaatatagctaatcaattcatattaacttggcttttgcgttagaggataagaaaagtggagaataggttcatctcaatttctggctctcagtgactggtagttaacctcctggagcactaccttgagaggattctgaggcttcatctgggttgagtggaagtagaatagaaatatgtctattgatgatgaatgccatctgctgggaaaggagggtagaggcacatatttgccaacatggctctaagaaatgggagagctgctatccagttgtgtctgaaaagattaactggcagctagaaacttttaaaactacccattgactagttctatctcggagaactacaccccctacttgccagttcatgtcttatgtctctgcctgggtctgtctatgtcaagttcttatttgttaacttagtagaagcttagtggactctgtgaaaatgataaagcttgaaagagcaagcctgtgatagactgtgatagactgagcctttatagtatccttaatgctctagaaacttgattgactggaaactttttctttttctttctttctttctttttttttgagatggagtctcactctgtcacccaggctggaatgcagtggcacaatctctgccacctgggttcaagcgattctcctgcttcagcctcccgagtagctgggattacaggcatccaccaccatgcctggctaatttttgtacttttagtagggacggggtttcaccatcttggccagcctggtcttgaactcctgaccttgttatccacctgcctcggcctcccaaagtgttgggattacaggcgtgagccactgcgcccggcctggaaattttttctataagatacacaaatacattgcagcctgttcctgatcagccatttaagtggaataaaagtcctaagaaagttcttcttgagaagaataaaattgagacctccactctgaacaggcatggagcattcaataaggcaaagggtcagaaatcttgcttaacttcttactgttcacatctgtaactgggcataaacctataggatcattttcctttcacaaagaatccatcaaataaatacttgttaaagcctacgcttaacttgagcaccggtagtaatgactcgcattatcagcggggcttttgggcttgcactcatggctctgtgattcatgagggcagaaaaactgactggcttacagctgtctctctttttctggctggcctgcctgcatgcctagataactgaatggcttttttcagaatgaggtatggtctaaggattttgctacttcaacgtcagtttcctggatcttttcttctactccagcttgccatatgtcccttttatattttcttggccactctcttacaaatagggccatagatcagagatggtggccccatctggtgaaatctagctttcagatacgctttgtttgacccatagagtgttggatcacatagaatttttaaaaattaattaactgtcaacattgtactattgatttcaactttatctggagtctttttaacttttattttgagctctagaacttggacattttctggctcctgccttgcaagtctgaacctcagttccagttttctatttttggtgcttagtgtttttgtctttggcagatcctgaccactgttaacaaaatataaagcatgaaaatggtggcatccatgcgatgcagcagttgggactatgagccccaggttggatgtcagctgtatctcagcaggtggagttagtttactgacccctgttagcaagaccagagatgcagatgtgactctggtcatgccagatattaggtttttcagactttgggatctaagaggaccatctgctgccacatttgtgcttggacttcactgttagagtttgatcaatggcatcctgtgatgaaaaatgatgttcatgaatatgaatctaaatctgagcaagtgtttggtgtgtgtgcatctcataaatgtcacattaggcaattaagtatatacaatttataaataagtatatgtaatttataaatacatatatgaagttcataaataaataatatataacttataaataaatatataaagttatgattttatagtttattaaatccagagtttttcttttgttatagccctgcctcttaggcttgacaattggcttagaagttatcctcaagagagaatctttctttttcttttcttattttttttgagatggagtctcagtctgtcacccaggctggagtgtagtggtgcgatatcagctcactgcaacctccacctccggagttcaagtgattctcccactgcaggatcccgagtagctgggattacaggcataccgcaccatacctgctaatttctgtatttttagtagagatggggtttcaccatgttggccatgctggtcttgaactcctggcctcaagtgatccacctgacttggcctcccaaagttctgggattacaggcgaaagcccctttgcccagcctgaatctttccttcttaatgactccatgctatactgtctgttgatttattctggcttttctcagtaaataacaaaattaatagtgatcgccatcacttattgagtgcttatcaagggtcagaaactatgtgaagtacttttatatgtgggaccatcatctcctttatttcttacagtcctatgtggtaagatattatctacattctacagtataagaacataggctgagacaagttaaatatcgtgcccaatgtaacacagttggtaaggtgtccaaaccctggttagggtgtctccaaaggccataatcatgaccatggcactaaactgctacttcaatctaacatctaatttaataaagatatgaacatttgttaagcacctatatagttaggagcaatttcagatgttaaaaggtgtaattcatatttcttgctcataaggtgttcgaaatctattgaaaagacaagacttgtgctgtacaaagataacaaagttgagagagttttaagtgatgagtgagtggagtggacagtttagcggagggagaaatcacagcaggcccaagtcatcagctgcctgagggagagaagggaagtggggcagagacagtgggatgtgtgattccgtggagaccccagaagcaagattctttcacaacacttcttagtcattcttttaccctgagtaggaacgttatgcaataataagattagcccagaagttttatctagaagctgtatcatcctggaagctgaagagaataagttcatttcattattatctattgtcaaaggattaaatttggaagggagataagtatatatttatttttttgcttgttgtgagtaaatgactttgcagttaggtatacagttgaaaagctttattgagatttgtagtcaactctgctccactcatggtaccccaatactggcttctccaccattccatttctccaacttcagaaaatgtccacagcgtccttactttccaacattctccactgatgtggagtggatcattggtgctcaggcctcaagtcacaaacctgtgagtgacatggtcttatccgctgacctggtgttttttattgaagttgtcctctatgcagatagtttaaaaacaagagaaaagaaagaccaggtggtaaacctcctattccttgtcaggagaaatagtgccaagaagccatctgggcactccagggcacatgcccacatcccctcattctttctagttcccttgctggagtgcatagggatggggcatttacaacagaacacgtggaaacacattctcagaaagttgagaacagagtggcctgggataagatggcagagggagagaagaaaatacttctctgagtggggactgtctctaattcttagtttattctcatgcacctgccttctaactcaaataccttggaagaatttgaagtaataagtgcatcatgtagggttagaatactctctctttttccaatcaagtgggttgggcaagagggcagacagcttcctcattggtaggtaataaaaggattctgatttatcagattgtgggatcaccaagtaccagagtagccagggaaattctcaaatggatttgaaaatcctagggaaggagcaccatttagagaggctggagagaagagaaaggcactgcagcctaggaaacccagtgaacaagaatgcagaagcaataacacctgggttcatacagaaacctttgaggtgacccctaagcggggaggtatagacatccattagaaatggattgtgcaggaggggaagggctttgcacatcaagatggacttgggtgtggtttttgtgcgtgactaaggggtttctgctttgtgtgtaggcatggggtacaggagggcctagaaattgccctctctggagcatatccttaccccagtgcagtcagagagataagggctcaagttctgtttatgcatttaatagcctacatgatcttgggcaagtatgtatccctgctgaactccatgtctgtaaaatggggctaatgctacctatttcatttgcttattgtgtatgatataaaacagtgtttgcaaagtacctggcacatggtaggctcttttcttatattgttccggctctcagcttgctttactcctggtattgctcctgtgtgtctctgtattaaagatcatggaggaatataagtatatttttttcctgagagactttgtcttaactttgagattctgtcctcagctgttttactgtctggtctcctaagcatgagtcacgtgtccaaacagcagtctttacaagcccatgggtgggatagtaagaccagcttgtcactgtttgtgactctgcttctgtacctcccagtctgtgtgacatcttcccccatggggagccgtttctactttgtctttaattgctcctcaccgaggcgacttgtcagccaaggctgctttctgtcatttgatgccacatctcttcctatttcagccagccatttggggacattcatttagttgacagtctgattttacagagaacattgtaccagacaataatttgccttgtaagggggtccagcagggtttcctgcctccatgctgacccagggtgccagtacacttctgcgtggctgtggctgtggttctgcacagagcaggtggggaaggtgaagatattaacaatggagagtcccagttgagcatcactgggctacaagtcccttgccctcctgtccttttcctcttggtagataaaccttcacagaacctcaattcaggaccctatccatttccaacagaaccccaacaccatgggagatgaagatataggattatttcttcctaggtttgtgtgccggtttagaattgtctgtgtcctactatgtctaacatcccacttgatcttgacaacagccctgtgagctgggaaagagggacagtttgtggaacagatatcgaggctcttacctttggaataaataaaatgggactcagaagggttattcagctgtcagtgagagtggtgttggctttttattcacaacagtgaaaactccatataaatagacaggtaatttcagggccatggagtagatagagcactcaccctcaaagagcctttgagagaagtctggttatctctgtctggccagtttctggcccttgcttctcttacctatgtcttcagaaatcttcattccggctattcaccttctctcccagtctcagttaggtacccttctcacagaagagttcctcttcactgctcttgtatcttgttaaaaggcttttttttccctcctttttattctgtccccagcctgctgtagcaatgcctgatctctctttctatttattgttccatggagccaaacctccttctgtccctttgggatgacctattgttatacattaataattaacctttactaggaactctagtcacaggcatttaacccaaatgcagaaaaagccaaagtttgtttatgacaaagagttctcacatgctaaggtataatagtgaaggttagaaaggagaagctgacactcattaaacttttatgatttcttttctggtttactcacttgagtgattgcctgaggatcctgcaatatttccctttgcacatggtcagcccagtttagctaaaatgaaaaattcagcttttgaattgtgaagttgagcatgcatgactttccatgtaatgttaaagataagcctcacaggtgctgctagtggggcctggttctgagcatatggaccctggggcccaaatgcctaggttcaagtcctgctctgccacttatcagctgtgtgcctgtgggccggttccctaactgctctctgtgtctgtttctgcatctgtaaaataaggcaatgattacaggtatctcaaatgggtgttgtctgtatctaatgggatggagaggtgttaaatccttaccatggtgcctggtggtaggtgcttaataagtgttagtatcattattttcaatgttattgactatggttaggtccacggtcaaggttacataatagtgagtcattttcaatgcttcgccatagttatatatcactcttgtaatatccattagaatgcaaacagctttgcttgattctctcctggtgatgagagatgggaactaattctacatttaaatattggggattatatgatatgtgctggagtgacccatccaattaactttgtctcacagatatggacagatgaggcttattttagaaattagccattgttgttttggagatgataatgcaaccttttcagggctgtggaaatagcgaaatgagattaacaataaccctccaaatagctgcgacttttgtgcccttatgatattgcattcctaagtgcttcacatgttttaaatcattttattattacaaaataaatagtttgtttattcctatgttcccaatttcaggagaggaaacagactcagaaaatttactttgccaaagtcacatagcttgtaagtagtaaatgtggaattcaaacctaaatctgggtcctgacttagaatttgaataaggtaatataaagaaaataggaaaatagttgggacgctcaatactcagatccttgtctatttcccttccattgttttctgcttattaagtttttatggatacgacattgctcagagatcagagcgccaaaaaccattccagggtactgtatcaaatttcagttcaaataagagtaaaacttttttgaaattctaatttcatggagaaagattaatttctgcttttagatggattatacctggtttagaaagtcataacagatttttttcccataggttattggggttcaggtggtgtttggttacatgaataagttcttaagtggttatttgtgcgattttggtgcactcatcacccaagcagtatacactgcaccctatttgtagtcttttattcctcaccctcatcacacccttcccctcaagtccccaaagtccatgtatcattcttatgcctttgcgtcttcatagcttagctcccacatatcagtgagaacatacaatgttcggttttccattcctgagttacttcacttagaataatagtttccagtcttatccaggtcactgcaaatgccattaattcattcctttttatggctgagtagtattcatatatatatatcacattttcttgatccacttgttgattgatgaacgtttgggttggttccacaattttgcaattggaaattgtgctgctatacacatgcctgtgcaagtatctttttcttataatgacttcttttcctctgggtagatacccagtagtgggattgctggatcaaatggtagttctacttttagttctttaagggatctccacactgttttccatagtggctgttagacagtcataacagatttttttaactgccatcctcacgttctccacctacctacccactctgcaggacagtggccatggctttgcagaagtgtacactaaccttgggtagggcatggaggcagaaagctctgctggacccccttgcaaggtgaattagtatctggttcagtattctttgtaaaatcagactctcaactaaatcaatgtccttgactgactggctgaaatagggcttcagggtgtctcattctaccactgtacagagggcacatgcaatgtgcaaaaaataaaaacaaaaacagacctctgtccccaccagcttttaacacttactcttttctttcaagtaatatatccacatggttgaaaaaaagtctaacactgtaagagggcacagtgaaaagtaagtcaccctcccactccagaatattaatcccgcaaatatactccccaatgacaattttatagttccaaagagactttatgcttactggagcatatatacatataatgcccccacgcccccacacttttacacaatgataacataatgcaccctctatcctgttccttgacaatttcacttaacaatgtgacctggagagcttccacatcaaaaccaaaagcaataccttgtttgcaaggcctgcctaatattccattataacgctgtgccatctgctattgatggtcatttaggttgtttctggtattttactaagggtgcttcagtaaatcactttgtatgaagtatgtgaatccatgcaactcgatctctcttgatttttatttgcaagcttatgttgtataactttctgacaacacaagaaattggccaggagacaaaagaaattctgtagaaatatagaggcttttttggagcttgtgtgcacatcagatgtttcttcagatacctttttggttcctgtgtctcattgtttctcatgttgttttgggctatgtcctgaagcctctttttgggtcatttttccaggtgcccagtgagtgatggatggatactgtttgcaagattgattcacatggcacttttgtttggcttttgacaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtaggaagaggcaggatgtgtgactgagactagacgaaagctgtagcttctcagtttgttttttggctttatgtttcttaattttcacccttgcatgcttgttgattcttttgctactctctttaatggctgttgtaaaattatgtttctgaaaagatacctgtctcatagatggctcacattctccgcttatctctcttgtcactcactgcgcaattgtctcagtgatagctctacgatcctggagctaaggatggttttacaagtagcatttccactgctaccagagcaactctcatgtcactggtgtgatccgcccccattgccccattctttgcttctctttttcctcatcaccatggaaaccgattgtgacatcacagatgctgcattatgtgattattttgtaggataaacttcactgtgcaagaatttatgcaacaatacacccttcagtaattggcaagagtcatgttgcatggagaaattatgacaagaaaggaaaaggcaaattgatttttcctgaagatacattcaatttaaagccttcctttggtgtaaaagcctatatttcactctttgttcagacctcactaactctctcttcctcttcataaccttttacattttgtttaaatggctttgtttctgcagctgcagatcaaacaagctagccccaggcagtacatagctactatggaatagtaacaaagtgggggtgggggtggggcaaaatagtcaggggtttttgaatgcctggacagtctgcctagctttctatggaccatgtggcaatgaaggtcacattctgtgctatcagaaagggcattttcccaagagcagtaattagagcatttgccatttcagactcatttcctgattctccatttaggtaggatgtactcaagaagggtcttggcttcatgtgccatatttatagagattcactttcctgatgaacattaaaaagtctctatttggatattttctttctaggtacatttggccagtaagagagagcaataagttccccaaaaggctgaaactgggagtgactgagctttggtgggttggcttttctgcataattccaaagctaggctgacggcagagatagcaatattgcccttaggaagagctggatgggttctttgcagagggcagatgggtggcagattgcagccctggctattttattgcccagtaggaatctttactggttgtctgaaatctgatcagaaccaagagccttcaaattaaatgtgctcgttaagcaagaatgaatagtgtctacccttttacacagaaaaacacccaaaaaattaatttctttggaggctaaatcccgccacaccccccatacttcttcttcttcttttctttctccttctctgcttttcagtaaaatgacagcaagagcagagtcagaaagctgttccagaattataaagaaaacactgctgttggtttttaagagcatgtgtttgggatctctgaggttaggtcacggtggacgggttttgtgtctgactaacctagaccttggcacagcataaaagttaccttacccgtgtctcaggcaggctaaaacacacaaaattgccatttgttcatttctgtctgttcctaatacaaatttttctttcaaacaattttgaacaaaggggaacagtttttgttgtttaaaccaccagtggacccaacttcaacaaatatgtttgaatttcagaagtcttaaatttcatacctgggagctaaagcactggctaattcttttctcttttttttttttttttttttttttgagacagagtttctctcttgctgcccaggctggagtgcaatggcgcagtctcggctcactgcaaactctaccttccaggttcaagtgattctcctgccttacctcccaagtagctgggattacaggcaccctccaccaagcccagctaatttttgtctatttagtagagacagggtttcaccatgttggccaggccaatctcgaactcctgacctcagatgatcaacccatctcggcctcccaaagtgctgggattacaggagtaagccactgtgccaggcctggccagttttttgaactactgatgaatttgatcaaagcctattaaaaacttactgagtaaacaaacaattgtcccatgaaagcagtataatctaaaattttaatacagtctgttaaactttcattttttcatgagaatgttttctggtaacttgttttagattataaatctatactaaaggatagttataaaaacaagtgtatctaaatgtggtgcctccttccctgataatcttgaagaataatataacaaacagtgatctagaaaaacttttatgatcactcctcacttgggcaagtcagtcttagaacttgttaagtgcattcaaaactgttatggtcacacattcagagaacagattttcctcaggttgtatttaaggctctaaaatttaaattgattctagtattgtctttacttggcaatagatgtctccccattttagttggtgatcagattagccctgtggacctgtgaggggtaaagaaagaaaactatgcaacagagaaaatagtaagagatagagacctcaacttcctcctttgtaagatagagaaaataataactcctacctcccaatattgttttgaggatcaagtccaaaaatgcacataaaatagttaaaatggtagccaggacattattgttgttatataagtgtttgaaagattgaaaaacaaaaggcaaagcatatttctctaggagtaaacttctaggagggagtagtgaagcagattgttaaattccccttaatatcctttctatgcttctactcttgtgttgactttgcactttatttattgtttttaactttagttaattaattaattaaatttcttgagagctagtctcactctgccacccagcttggagtgcagtggcacgatctcagctctctgcaatccccacctcccgggtccaaggaattctcctgcctcaacctctcgagtagctgggattacaggtgcctgccaccacacctggctaatttttgtatttttagtaaagatggggtttcaccatgttggccaggttggtcttgaactcctgacctcaagtgatctgcccgcctcagcctcccaaagtgctgggattacaggcgtgagccaccacacccagccgactttgtactttaaagtgtatgtttcattcttgatcacgtctgatcttcgcagcccttcaggttatatacccttcataactgaagaaactgagaatcagacagaggtgaaggctgactgatggatggcatgacccatttatcttgataccaataaagcacatcaagaataataaatacctattttaaaatttctgacaggaagtttagatatcacctagtccatttccttaattttccagttcgggaaattgagccataaagtggttcagggattggcctagggtcataaagacatttaggactagaatccctgctctcaaggtcccaggttagcttgtggggtttcatcttctacaatctcatttgatgctgtccaaactccaaccccttcctgggtctgcttagctctctgacttgatctcctgctcaccccctcttgccttctctattctagccacacatctgcctacctcagggcctttgtaggtgccatcccctctgcctggcatgctctctctcctggactttgcatggctgaatccttctcaacattctggtttcagcttcacttttacctgcctagagagaccttcagtgactctacattttaaagtagaatgcatgagtaactagcacaccacccattttactctcttcatagcaactgcccttagctaatttatttcatttattgggttacttattgtattagtctgttctcatgctgctaataaagacaaacccaagactggataatttataaaggaaagatgtttaattgactcactattcagcatggctggggaggcctcaggacacttacaatcatggtggaaggagaagcaaacacgtccttcttcatatggcagcaggagagagagaagtgcagtgccagccagagaaatgccagatacttataaaaccatcagatcttgtgagaactcactcactatcatgagaacaacatggaggtaatgtccccataattcaattcacttcccaccaggtctgtcccacaacatgcagggattatgggaatggcaattcaagataagatttgggtgggaacacagccaaaccatatcatttattttttgtccctctgttctggaacatctgctcaatgagaggagagacatgcctatcaagttcatctcagtgcctagaactataccagagacagaataggtcttccatacacatttattaaatgattaaataaggaataatgtttcagttaaaatgtgtcacagggaatgctcaaaatattcactggcagggctggtagtgaatgcccaatctagagagtaccagtgcatggagagagagacagaagaggaagttccatcttttgggggttggtgagcccttgaagaaaactcaggcaaacatatggaggcctcattctgtctcagtcactcttaaaagcactttgcatatattcactcatttaatcacaccaacctatgaggtggggacagttattttcccattttacaaatgaggaaactgaggcacaggaaggtgaagtcacttcttcacggttatacagctcatacatattagagctggaatttaaatacaggcaggaactgtgctgctctcaacctgtatggtctcagccaagagggttaagtagagaaaagatacactagatgttaggtcactgagatttttctgggtcttcctaagggccagcttgacttagctggcagagattggaaccaaacggcctacattgtcttttccattgtcttgtaacatctaattctcttgcttacattgttctctcctggccagccaatggctgggctcagcactcacctgttaggtttcttacatttggttaagcaactggcagactcacctgagatctgtcttcccaccccaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaaggggtgagtcggcctagaggatggcaagtgagggcctgagtggggctgatgtgttacagttggatccctgggcagcccaagccttcgcacctacctgcactttctttcttccaagagtttttgggtttactgatttccagattgcaccctttctagttctgaatgcttgggtttgtttggctaagactgagttgcagaaagggaagctttataataaatattactgtgattatgatactttttgattaaatattttctatttagagagggtaaataattctcttttgggactccagggggcctagccaactggctgttttattcattcatttgacttgtgattctttagtgctttctacaagctaactcctgggttaggctttagaaatacaatgttgaacaagacaggtacatcgctgtttttatggagcttgctgcctagtggaatatttagccattaaataactgattacaaacatggtgagttttataagaggcagagtgatgtattagttaagaacataaactctggggccagactgggtgagaaatctggccctcatgcagtgatgggaatttcatcatggtagtcaatatctttgaaacttgacttcctcatttgtaaaatagaaatcaggtacctacctcacaagatactgatgatgattaaatgagttaataggttctcgagcatttaatgttagtgattattatagtcataattattctcatcaacatcattaaagagaaggtatagagaagcttgggaggcccttggaaggagacctaacataccatacaggttcactgtatagtgagcaaccctgacagttgaggacctgaacaaagtccagaatggactggatgctttgttcccttctgaaaaatgtccagaatagaattggggaactgttggggtggggaggaggggcatgagaggggaccaaagagatgagggctgaccctgtagactgggccagaatgctgggaggattcccttttcgttcaccacttcagtatctgacatttgcacccgatttacagtttaagtaaagggcatagataaaggcaagaagagggacaacatcaacacaaggagattccagtcaagctatttgcagattgcagcttggtctatttttttatatgccaagcacacagaatcaagctgaatatccgcaggctgtcaacttctatattcaatgaaaggataatttgcatcaggatcaagtttttgctaagggtatagctctagggctttgagaatgctgtacctgtatagttcttgccctcaagaagattatcatttatttagctgaggagttgagacatctatataataagctgtaataagatgatgtaagacagtagcatgttagtggacagaaaagaaggacatggagattcagagacagaagaacgttttgaggagagacctgcagggtctcatctctacagaccagtggccagtggcctatcagaagataggtgatgtggatggatcctgggccaggtctagaacaagggctgaatgaccagttttcaaggcctgtttttttgtaaggccaactgtggggccaactgtgttactagctaaggtatatttcaagagaactacaaaccctttttacagtcagatcagaaatagaatacaggacatgaggacaaaggaagaaaagagagctttcttggagcatatggaattaaaattaaaattcactgaattttcaagtcagcaaccaccagaacaggagctatgataaggaaatactcatctgggacaggaataggccacaaggggctggtcagtctgtcaggtgcctgggctctttccaagtatgtttgtagggtaacctaccctggtgctggttggggaagatagaaaggtcatttttgtctctgagatgcgtgagacagttttggtgtttgccaaagtgttgcagatcttctgttgtctatgaagacagtataaaggtcatctcagacatctcacttcttcttgggtctcctcttaactcaagcaagggccttgtgattgtcagaggcaggacacagtgactgtagccagctgtacaaggtgtctctgagctcacccatttcaagggtgaatcaacgggagttggtccaaaacttgccaagaacagtgaaagtcactgcaccttttacattgtcacttctgactagtcattaaaaggcagctgattggggatatatgagggacaattattcttggtgcagtgcagccaagagtcatccattctggccaaatgagaagaagcttagcaaatttaagatatttgatctatacatcgctcaaatcccagacggttcaactgattgttttgttcccctactaattgttttttgcccctggattgttcctgacaccatgttcagaatgaatcagtggagtgtaaaaattataggactcttctctgctagcaaagaaaagttgagattcccaatgacattgtttttctttatggaaactgattccttagtggagactcttttgagtatcttttgttcatttttcctgcaggaagttgacatatattgaagccctagtgtgttccaggcactatgtttgaggttggaaatgcaacaaacaaaaaatccaaaacagaaacaccaacttgacacggcctttacttgtgaacaaggggtgtatagtcctcccaggaagcaaaggaaaatgtgagaaatgtttaacatgtggttaatgttatggcagatgtctatagggaaacagtaggacaaacaggcaagaatggccacttctatatggaaggagtgatggcccagagaaggggatccaagctttcttggattttagatttcctatttctaactttaggcatccactctaggcacttctgaagaagaatgaagaaaatgtattgggtattctctctatacaggaatggaatacttttcggattaaggagccctgccccattcaccataacaacatcaacacaatcactcagtttgccattctctctctaatttttattatgtagaagcattctagaatcaagtctaagtctagaatggatcatttgtactaaatgtgttaagcctaagacaattcttaaggctgtgtgtcccagtagctcaaactgtgttctctactggaacttccttgggggtgagtccattggtataactgggcccacacatgaatgggagtgttagaaagaagcacttgtgtatatacactgaagaaagcatagatggaatgctgaaaactggagttttcatggcccaggtcagacactagacactacatcaaaatagaccaatgacccaagcaaagtcagcaacagataaatctaagagacaattcctggatcaaagtcatcagccaagtataagagagtcagagaataaggcctgggaagtagaaagtgtgtatatgatactaagattaatttgcatgtgtatgtttctcttacagtaaaattggataactcctgcttctaccctcataagagtgcttcttctgcctgtgaagatgagctactctaaatcttgatgtctaaaaataggcttgattgatattgtatttagatttttttcagcataatctgttgctattctaagatgtagctgtctctacctatcccaactgtttagctctaattatttttgttggctattcatagtgatgtgagagacgtctccatgacctaaacagcaaaggcctgttttaactacttaattctaatcagataggttgaaattctttagtatcatagaataccacctaccatccagtgaagtcctgttggacagaggaaacagtctagctggtctttagcctgctctggagttagtcctacttaaggagctatgatcacttgacctgggacaacatcttatctttgctggtatagccaaactgtctagttcaattggtgagcatcaagttccagcaaggcaaagccaagggtttgatttatttgtacatcatggagcttaaattttagaccattgctgaatctatgctcttccctgaatggctttttctaaacatatcctggcattcatttggcaagaaagtaaataaagctcagcacaagttcatcccaatgtcaagaaaaataacctacagtacaacatttatctgacatatgcaccagctgaacacgaagaatacaagtatttttacttctctccagtgactcttgttccagtgggaaaggcatgcaggcagcagctgctgctcctctccattcggggcctccctttttaggcaacctcctatgtgatcctgggtagcagcagcagcagcaaaagcaaatgattctgcctggaaagggtgagataccaatcttcgatgaggctggattgtgtcattgaaatgctacatatatgccacatggaaatcatgtcataagaaaatagtagggttggcagaggccaggagtggtggctcatgcctgtaatcccagcactttgggaggctgaggtgggtgggtcacctgaggtcaggagttcaagaccagcctgtccaacatggcaaaaccccgtctctactaaaaatacaaaaattagctgggcttggtggtgcatgcctgcaatcccagctactcaggaggctgaggcatgagaatcacttgaatctgggaggtggaggttgcagtgagccaagatcatgcagttgcactccagcctgggtgacagagtgactccgtctcaagaaaaagaaaagaaaatagtgaaaatagtagggttggcagataccgttagtgttacctgcacctcattcctgttttggtaaatgaggaattggaagccctgagaagttaagtcaacatcagtttagcttggaattgctatagaatggttagaatttatgattcctgattcctaatgcatcaggctttccattacattgagcagcctttccttcatatatactgttatatacatatactagatggttattaaatgtgggagggctccagggtttctgttttaggtctcttcttggcctgcacggttcccttggtgctcttattctttgccacgatattaaaggtcatctatatgttagtgacttccaaattgaggtctcttgcctagaactctccctgaaatctcagattcttatgtccctagttgtctacttgacatctccatttggatatctgatagattaacttaagctacttaattaatagctacttaatacatagctacttaattctaatcagataggttgaaattcttgaatatactggaagagcacctgccaccctgtgaagtcctgttggacttaatcgtatcatggaacagcttaatcatatcattgaaaagcagaaatcttgaggtcttccttcctgccccagacttcttttactttcagtttttccccttcttggtaaatggcatccctactgtccttgggcattttcttttatttttgtcctatgatattcaatctatctcagcaagtctcatccatttctcttataaacccatcctgcatctgtccactctctcttccatctctatcattttagatcaaaccatacttatcacttctttggacaactatatagcatgtagtatatgattatgaaaaatccaaattcattttgtgtcttctttagaatattaaagttaaattattaaaatttctatattctcaacacagtctatcttaaatagctttagtttcagtggcttttggtccagaaaactgtaggaaatgaagctatgatgcttctttggaattaacttcagcattaacatagagattccataaacaggtatttagctcttttctgtgtcaggctttgtgagctgatgaggatatacatttatattaagagaagacacactttctgtcctccacgagctcacagcacagcagaggggatagagacataatctgcaaactctaatgcaatctaccagtgtcaatgattcaggaaataatcacaggaaagaaaaagataacaattagaaagcaagatatgacgcacattttataccattttataattagttctggattcactgaggtcttgctcagactatctcactggtgtgggaataagagaaacctgggcttccaaggtcaaatataataatggtggttgctttcactggtctcagtgctattgaggaggggaatctgcgttatggctgtgccctcatccctcgtaggtttccagatcctttatttaaatgtctgacctggagatggatcctctgacctttcttttctgcaagaataaaatgaggcagttgggtttcacgctctctcaggcccttttcaactctaaaactctgattctcaaatgtcatcagcttggcaatgctttctcttatcccaaggagagagagaaaggtgaatgaagggcagcaatgtgagtccttgttccttacaatccgcagaactgtctggattaggactcggtttagttatatcagcactgcaatcaaattttcatctccctgattcattcatccaagaaaatgaataccttggtgtactgagtacacttcaggtccatcagacctgagttttaattgatggattaacgaatcgaaccttagatttctaaagagcattaaaaggctgtttcctctttggtccattgtttactctttttgatagataatgacatgtatctgagaaaggggcttcccaagaaatgtgcaattcatttacataaatcaaactgtctccttttttttttgtttgtttttttgcttttctgttgttgcttaagtcatacaaatgtatccctggtgacagccaccagcagagcacagattcagcctctttttttttttaacttccggttctgcaagtttccctttccacaagcacagggttttatgattgcagaaagcttttccatagtacatgaaccctagctgagagttattccaccaggtgagagtctgagctacctctgatcacagctggtcctgttactctaaaaaagagtatcaggattgtagattccggttattctagagtcttgaaggtttcgaggtctaagaaggacaggctggggactttggagatcttttaagaatcgacacctgcattcaacctgagaatgtgagggtcagcactttggtgcagtgtgtgacagctgcttatgaaccaacggcacacctgctgctggctgcagtgctgtcaaatgcagggactcggtggccatttacattgccactgtgtatctttattactgtgtgtgctcaaagcagcttaactgccagcagacatctgcccataataatgcaataattgaaatgctgctaaattatgagaaacaagtgctttgaaacacaacacaaggggattgttgcaggcttttctagcatctctggcttcatgtttcttttcacagagagatgaatccttcttcactacagtttggattaagaagaaaggaaagttaaaagacctactatttattgaaaaaaatgatgtgccttctctatgtttggttcttaatatatactgagtcatttaaccctcacatccactctgcagactgcatattattatcctcactttctacgtgaagaaattaagggccacccaattcattctgaatacctactgagtgctacgtgccagggactgtgttgagcacttgggacacaaaggcattgactgtggttctcataaatgtgctattatattctggtatctgagcaattgggacatgagtgtggggagaaatatcatggaaggcatcacagactggtgccactagagctgaggcttggtggagaatcaaagatctccccggcagaccaggcaggggaaaaaaaattccaggcagaaggaacagatgtataaaggtgacttcaataaacagtaagttttccatgtgggtggcatgtagggcttaaagagtgaggaggagggatttgaggggaagttttcgaagatgcagctgtaggggtgacagggccagccagccatgaaacactttgctctcccaacaagtttaggcattatcttataggaagcataccacgtttaacaatgggataaccaggtcagatcactgaggcagaagataaattgaatacagaagacaggagaccaacaggtcagcatataatagtccagtttgcattggtattaattcaggaatgagagataagagccctccctgaagaaacaagagtggaggtcgagttttcgaacatatctgataaataaaaaaggggcaatgtcaataggacttagttagtaatcaattacacacagctaaagaatagctgaaattgaattagagcaagggtttggccatggaagccttttgcttcttcctttcttctgagccatcttgaatcagtgggagattcttaggaggagtggggaggactgtggtgaccattaagcagatgtagctgagagtcaaacctacacctgctttggtcccactcggaacatatgtatttaccttctcaccttctctctgtgcctccgtttcaatatttgccatgacaatattggcagtgggtgtttaactggcttattgtgaggctccattgtagaatcaaagtgtataatgtgctcacatagataacaaagttaatattcccctttcagaatctggagtttagcaatgcaagaattgaaaaaatgatctggctggtgtttttactccatttttttttttcttgtgtggtggaaatgacccaggtcttatttctgtgtttaaggcatatgatacaggttagagtttaaaattgagaaggttggaccataagagaacataccaaagcatgcctttcttcatactttaaatggtgtatttggaattaaaatgtgactcttttgtaatcccgggttttaaagaattgcattaaaatgatctgttatgactgtagtgatctcaaccaagctttggcatatgtttggtagaaacaatgagttgtagtttgtctctctttgtcttgtaaaactggccatatttgaaattaagctaaaagattttttttccttggagatagaaaaatcatattttgaacttctccctattctggtctctcatttgggatttatagtgatgacacccgatactgagtattacgtatgtgtctgtgcctagagcacatgtgtatagttttcctctagcttctgagaagttttctgttttatcatgggttctgttttaatcccaccaaggactgttaagaggaaaaagcagcaaacatgtagtaatcaagaatagaagtcccaaacttaaaacctaaaacttgactgacccaacaaaaaccaggcagagtataaagagttgtgtaattacttatcttgccagtagaatagatgctcagatactatctagcaaaaccacccacccccaattttagatgaagaaactgaggcctccaggtgggaaatgagtggtcaatagaatagaatagaatgttcttagtccctcgttttggttcctatttattggctttttcaaagaaatatacatgcatctgtgcatctgtgcatatttgtgaagatatacttttatgtctcatgatcttctaggcagtagtcatgccgttatagcaaagccatttggtaaatctccagtaatttgttctaactgataaattttatttgaaatgttggcaactgatttagagggaggaaatgtggagggaagagatgtatatatttctcttctctttctgtttcatcacttatcccatcttaccccaacaaataacccagcccaacagagaggatactggggtgacaagtacatctggaacttgaggctggacccttcaatatgagtggctcttgaaagacccccttctgtgggctactggacagctatttttctgccaggtagatgcagtctttcttggagaagatcatttcatgcttcttagcatgtttaacctttatagcaagacactcttatcaaaatgacaaaccccaacagagccttctaagaggccagtaaatcagaagcctcatgaaatctgtgcgattagcatgttccccctctttgtttctgcagggtaagaaagccctgtgcatttcagatttcaatcttctctgcaggccccttgtttgaaacctcctgctgtggctcactggtatttaaatactgttttcattcagtcacctggggccacatactgacatcagctaaggctggcacattgtttatctccatcagcaatgttgtaaagaaaagataactgctctgatgtttgtttagttgaattctccccatcctggaaagcatcctttctgggtctgaagatagcagctgattcctaatgtcatcattcctgtagtagctcactgttgctcagcaggatctcatctccagccagttagttgtctctgatctctttgtcccatggctcagtctgtaatgaaactttcacaagcaacctagcatcttcagccactataaggtggagcctccttctgtggaaatccacaaagtcaaggctatattgagagtagaggtagaaggagaaaaaaatgatgaataacagttctgttgtctgtatagatgataaaatatttattagggattgtggggggtgactcttttatcggagtttacacatccatattttcaagttggaaaggacctctgaggtttttgagtctaactcaatatctgatgcatatatacccctggacaaaattcctaaattgctgtgtagagtctataggaatatgtactcttatctacatatgatgtactaaatgcttagcagtggttagcttatttaatctttgcaataactacataagatatgtgctattttcattcttaatttatatctgaggaattggggttaaggataggttaagtaacttgctcaaggtcacccaagaatacgttgaggtgatctctgggtcttccactcctgagtcctctcttctgtgatcgatatactttactactctcagtaacaaggattctcacctcttcatgaagcagccattccatttttggatattactaagtagtctaaaaatcttcctttcactacaactgaagtcccttttttgaaacactctttttattttattttgttcctttttttattatactttaagttctgggatacatgtgcagaacgtgcagtttttttacataggtatacatgtgccatggtggtttgctgcacccatcaacccatcacttacattaggtatttctcctaatgctgtcccttccctagacccccaccccctaacaggcccagtgtgtgatgttcccctccctgtgtccatgtgttctcatttttcaactcccacttatgagtgagaacatgtggtatttggttttctgttcttgtaaacactcttttttaattgtgataaaatacacataacataacatttaccattttagcttttttttttttttttttttgagagaaggcctggctcttttgcccaagctgaagtgcagtgatgcaatctcagctcactgcaactcctgctccctgggctcaagccatcctgccaacctcagcctcttaagtagctgggaccacaggcatgtaccatcacacccggctaatttttgtattttttgtagacatggattttcaccatgttgtccaggctggtctcgaacttgtgagctcaaacagtctgcccacctcggcctcccaacgtgctgggattacaggcgtgagtcatcacacctggcctcattttagccatttttatgtgtataatacggtggcataaagcacattcacattgctgtgcaaccatagccatcatccatcttcagaatctttcttttggccttggttcaggctttgggagctatacaggatttattcactaaaaaaaaaaaaaaaaaaaccttcactaggtgcttatcatgccatggatcctagagatgtccagaacaggtcaagctaaaacccttctctacaatagaccttcagttattcaaagacaactatcaggttttccactgaaatgttgtcagtcattctcaggataaacatcactagtttcattaaccagttctcacctattgtggttttaagttccttgctgagttaatccagcagtcattgagagaagtgggggaaggtgggagagggttctgtgttctgaaaggaatgatggcttccagtacttcacaggggtctttgtgaagcaggccatgcccttccaaggagaaagcatgtattgttaatgcagtaactcacatgaatatcagagatagtgacacatatggactatgggtttgtgtagttggcaggattcactggtacatttatggtggtggtggggtgagtgcttttgttagtttcttatcctgtaaaaatgctttgggccaggcacggtggctcacgcctgtaattccagcactgtgggaggccagggcaggtggatcacctgaggtcgggagttcaagaccagcctgaccaacatggggaaaccccatctctcctgaaaattagccaggcatggtggtgcttgcctgtaatcccagctacttgggaggctgagataggagaatcacctaaacccaggaggcagaggttgtggtgagccaagatcgcgccattgtactgcagcctgggcaacaagagcgaaaactccgtctcaaaaaaaaatgctgtgggcccacttcaggtaacatcacatttaccacctcgtcttattcctcaaaatagtcctagattgagtgtgttaagtcacatatctcaaaagcaaagctaaatttatttttgaccataggaacatcttagggtaccactagacaaggaaatcatgattttgacgagtgtcagctgacacaaaatcattgaatgctacagctgggcagggccttaaaaaatcaactattccagtgcttataatttgcaaagaaataactgagattcaaagtgattatataacttgcccaaagttacagaggtagtaagtagccacgctgggacttatcactcagtattttgaatccttgatgagatctgtctattctaaagcaatttcagaggtgctcttgctttgtacctttgggctggtcctttgtagctgagagtaagatgctcctgctgtgtgggtcagaagatttcttcacaagctcagtgggtccttgtgattttttttaacatgtaatcgtccctttatttattgcaaataagcttggcaatttatttagttagcaacttatggtctggaaaatctcattatccaaaccttacattatcaacacatctgtttaaaaagagatgcttaaagaagtggtctaaatatgcagattcctgatcatcttgaagaagggaactactaaaagggcaacctgggagggagtagacaattgtagtgaggccatgaaagccactgacattcacacataagggagtataaaaagggaattcacatttattgagtacctgcatgtgccaggtataatttggtccttaaataagatgaaccaggtttggagtcagacaaaactggatttgtgggggcggtggggaggtgcacagtggctcatgcctgtaatcccagtgctttgggagatagaggtgggcggatcacgaggtcatgagttcgagaccagcctggccaacatagtgaaaaccccgtctctactaaaaataccaaaaaaattagccaggcatggtggcaggtgcctgtaatcccacttctcaggaggctgaggcaggagaatcgcatgaacccaggaggcggaggttgcagtgagctgagactgcaccactgcactccagcctgggcaacagagggagactccatctcaaaaacaaacaaacaaacaacaacaaaaagctggatttgaatcccagttccattgctcactattatgtgatcttggatgtgtttttaacccctttttagcctcagttttctgatccatcaaaaagccattctggggttgttatgatgcttcaataacataattgtgtaaaaatcttggcaaaatgcctataattttgtaagtgttcagtacatggaggagtattattattcttctctcttttaatttttagagcagatcttataaagtttgtggtatcattcagatttttagatacttaaaccaaggatcagaaaactaaaataaatttccatagtcgcaatgttagcaaatactaaaggtaggaatttttcacccagtctatcagattttctattattctttgccattcatttaaacaggaggccttagaggtgggattaggtactgtgggagggagagagagctgtaagaaatgagatggctttttttgttcctcttccaaccttgtcagttctctgctttaggactttccaaggggcaaacatgagaaatacattgggatggaagctgtccatttggagtaaattcaggattgagaaaagcagtcaggatcttccacatcttttcattcacactgtttgttcctaggtggtggagaagaactgtaaagtttcatggggctggtccagaagagcatgaaatgagtacagctcaaaacttttggctcatcataatttatccagggctgcaaaataccctaactcatacctgcatatttacccacatgtacaaacacacacacatgcacatgcacacacatgcacatgaatgcacagacacaaattcttcggccataaacctggacctctctaatttttgctttgctcatctctccttctctagacggggagccatcggctatgtatccccagtgccaaggaaaaggagctcaatctgtgtttgtggaggaacaaatgaaagaatgaatgcaaagcaaaatgaatgggattatttctaaagttaactatagttagaattctggtttattatctgacaaatttgaaggaacttagtacctgctagacatctaaactgcccaccctcacccccaataacaagttaggattttcgtagttggagatgtgcctagagaaaaataatgagaagctcccctaggctggggcctagcctcttgggcctgtagcaactattcctgtaactcagtattagctatagagcggcaagattcagtgttgcttaaagtggacaggtgggcaggcatggaatgaatgaatctggaatagagcgagaagcaggcttatgcatctgaggcaggcatttctaccatctaaaacaatggggtgactttgcagctctccttggtgaaaagagcacttcgtggatgatacccttttgttccccctcactccctttttattcacccctctcctgtcctgcttaccttttctttttcctgtttcctcttctttatcccccctattcttcattatttttttccctgataaaccccacacagtcctttcttcatttctatttatcgtttaagcttgatgcagcaataatgtctattgtttaaagggcttttccctcccagagggatgagattgacccttatttattcagaatgacttgactcagggctgttataaaatgtgggctgcacaaaactgcaaggtggctggtgcctaccagctacctagataagtggtatctggttgaaggggaggacaggcccctaaggcctctttgagcacattgtctaacctggaagtcatctccttttgaaccacaataaatgagaaatggtcttagcaagacaaaacaatgactataaaaccaggtggctaaaatatggctgaggaatgcagaagagtgcactggtatatcaatctctaattggggaaatgatttggctgcagcacaaaggagcccctctctgtctaacattgggtttgccccttgagctttctgcaggcggagattgatggtggtggcgtgatggtcaaggaatgtgtcctcagatgaggctgagcagaattatttctttgtaaattttctttttcccctttcttcctccctcccttcagatatctcactttctcacctttctttcaccttccttcttttcttgcctgtgatcctttcaaaccactttagtttttttcttatgtggagaacatggttgacccattcaatttcttttcactacagagtagcgttcctgggggctttgatgggacaattgatataatgaatcttgactttggtaggactgttattctgtcttcataaaatgctactcaataaaccagtctctagattatagctctgttaggagtgtttatcactgttgaaaagaagccttataaaaattgtcatctgtgggttattgctaacattatagattatgaatctccatttaaaaaaataaacactgatttttataattctaaaattaatatatatttactgtagaaaatttggcacatggaagtttattaattcaacttattctttggccgacattaactgagtacctgaatacaaaacctgtggtggttctacaaaacgcatttcatgataaacaaaaataaatataattgagcataactgtaccaagcagaaatggttattattaacatatctgtatgctttattctattattttgggaatgtgtatatatatatgtgtgtgtgtgtgtgtgtgtctctgtgtgtgtgtgtgtgtattctattcttgaatatatactatttgtgaatacatatattctattctatatatatattatttgggagatatatgtgtatatatataacatgttaatgtaattttataagtaattattctaatttttccagttcctgttttttttcaaaaattatctcgtagttgcataat[450 bp omitted]cactatacccactctagtggaagggactgcaaagtcacaagcaaaggctgtgggtatataattcagaaacaggggaggtgcaactaattatgaacaataaaacagtctactatagtagactacctgatattttgttatcactaatgtccataggttgatccaagaagactagttttttatcctttctgttaacctctaatgtgccccaatattgataaatgccatgagacctttttccaaacacataggcttcagaagacatcagagtcttctccactgcccattttctgtttggtggttctaatgtatcttcccattgatacttcaactcatcatatctctaggagttttatttcttgcttcacagaagtctcttagaccaggtaagaaactagctctgattttaatgcagagaatgcttatgaccattattttagatgggcttaaaacaatgaagcctgagacctaaaagggccagttccagaaaatcattagcttcaaaatctagacatgagagaaaggttagatggtttgaggatggttctacaaaatataatggagggaggccagaaaaggttagtgggataaggttctcagacacttggattctctaggagcagtaaggaatgaatttagttttttgctttttggaaaatttagaattactgaaatttgctcaagtctgggattctttttctacttgaggttttctcagggctttgaagaatatgcactgcatagggttttggtattcaggcttcattatttttggttccattctttgtaacacctggggtcctggttctctgctgatgggcctcttaattttgtttattttgtgtctgaacctcagattttagtttgtatttattttttgaaataataatctggttactgaattagacaccaagctcatggaaagcttggaccatgcctgctgcactattttctgcctcatgcctgggatatagaacgtgctcaacacattgttgttgacggtgataggttcagggcacaggtatcctgtatcctcagtctttgcatccaaaacttgacaaatccttttctcacccatatattctccctctcatgcaaaccttcttactttagacttatattttgtgtttaacagtcaaacatttcctctaggatgcctagtctatgtagccatttcaaagataattttctaaggaagaaatgcgaccatccaagcaaagtgtactaatgtcaaggaatcagtgagtgctagaaaagccaattcagagtggtcagaggtaacaaggagactaactaaattgattagctttaataacttgtattgtctcccagagagaaaatattcctggccagaattttgtcaggagcttgttgctctaagtcaactatattgcatgaggactcagagagtaagtgtgcaggaaaggagaaatttatttgggaagattttgtagtggaagggatactatgtaaggctaatattacagaatgttagcagaaagccatctgttaccactgtggtttactaccattcagagagtatttattgagaccgtattatatgacatgcactatgataagaagaaggggtacaaaggctagccttcaaggagctcaaggtcaccctaagaataacaggtggctgcctccaggaagatggattgaacatgaagtctattgaacaaagaccctgctcttactgttgcatgaatgaccttgtttaagatgcaagattgactgtagatggcagaggagggggaaagagaataggcctaaatctcagtcagaatagaacttcaatttctccactctcgaatgcagtgagcatagtaagacttttctctactgaggcaaagaaactttggctacagttgaatcagggatttagtgtgaaaaacatgtaggtttaaaagagccaaacacacgtatctgcatctgaaacacacacacacacacacacacacacacacacacacacacacacacacccttttcatcttactaattcctatatttcccattacttgagagataacataatgaattttggatgcaagatgaaaagaaagtcattttatccaaagggatgttatttcaaagacatacatagatgagcactcctgcatatcatgctattcttcacaatgtcattttaaatgatatttactcaaatattagttagtgatgactaactgccagataccatgctagtccttgagaggtacaatggtgggcaaaatgtgatgcatctttggcctcatggagtttatagtctagtgacaggagaaagacatttaccaagtaatcaacaactaaacatgcaatttcaaacttttgaacttgagaagtatggagagccagccctagttgaggggtgatcagggaaacagctccagagggaatgatgcttgacttgacatttgaagaataagaaggtgttaccagacaaagatggatgcagtcttctaggcagaaggttgttacaaagcccaataggtaaaaagaagtatggcaagttagagttcaaggaacagagggtaagtcaggttggagcacagaaggtggaagtggggaggagagggaagaggagacagggcttggtcatgtcatcacctactggtagagtatgatactgatttagaatttatcctaaaagtaatggcagacccttgaacagctataagcaggagaataacatgaccagatttgcttttttaaaggtcatcttggctgtaggacagtgagtggattggagaagcataagaatagatgttaaaatactagttctccaggaaagagttgacagtggactaaatttggactagggcattgaccagggatgtgaagggaagtcggtgaatttgagatatttatagaagatcctatatttgtagcacttgagatgtcaaagaaaaacaaatcaggacttagtaagaagagatttttattcaaaacaattcttgtaagagaaagaaaaggacaattgcaaaacggagaatgctataacaataaagtttgcaaacatctcaatatcaaacagaaacaaaaatgtttttctttcatagggtaaaggaggaggctagcagagataagcagaatctttggggtgggaggaagctggacaaacaaggggaaataacccctggagtctgacaggacagagggtcttgctgtcaccagctgattcccaggagaagctggtaagcaggtacatgttccccttttatgtgtgtgctcagactttgggacaagcagtgttcaggaacctgtagaaatgactgaagtttggttaaggcaaaacagaaggatgagcaattgtgaacactaggttagagaatgtaattcaccatgacctaaaagatgacttcaaagggatcaagcaggagaggtagaatcttctcagtggatcagtcaattcttatcctcttctctctaggggacagttgatatctttaattcatattaggggtttgttttaggggtttcaaagtcttctcacatccttgagttcatttaccttcacaaattcagagaagtctgttagaattgaaagacctaagttagaagtcagttttctagtcttgttattttacatatgaggaaaacacagtctagagagggaaatgtatctaagacatccccattagatggaaaactgtgaccagcacccaggacttccaacatccagtctgggaatgattcctcctttatatggccgtttcctatctgagaattctcatgacattctcatgacacttcagtgtagcactgtagattcctcccatggagcaaactaaggtgctttccacccaccctatcccctatacagctacacacatagatatttactacacacatacacatagatccatgtatcttattctgaaagctgccagatgtcaatttgaaatttaatttaattggttccttgagttttcggttccccatcatcctgctccacctttcgcttagcgtggccatcctggagttcaagatgtagttaaaaggcaagatggtgtgatggatagactgtaggttttggtggcaggcagaattggtttgaaagcctaatagctacatcatcgaagtgaaattatttaagttttctgagccttatatttttttcactcatagggctggataattgtaattgtctcacttgattcttgcaactattaggtgagggtataataatattagccaccattttattgggcatgtactatgtgccagacattgcacaacatgcttaaaggacattgccccatttaatccttatgccataacctgatgaggtgggtaatattaaccctactttaaaatgcttaagagttcccaactctaatagtaataaggactattattcccacaatcatttatttacacttttattcattcacttattattatgaagtgcctattctgtttcaggcattcttctgggtactagggatacagagaataaaaaactgacaaagcttcttgcccccatgcaactaacaatctagtgaggagaaataaaaaataagcagaatacagtaaaatatatgtagcttattagataaatgttcaggacaaaaataaaatagagcaaggggatggagaagagccaggatattgctgtgtgtagtgtagggaggtcatggatgtgaccatcgattgaaaatatattttatcatttcagaaaagacttcctggtagattacatgaactgttaagttaatttgctttttgggaaaatttagcacttggtatatcctctcattcttccctttccccttcctccttcccttcctctcttaatgcctcacacatttgtgatattggctgtgttagttgctgagaatgtaaagaggaatgtttcttttatctgcttgtctacctaccgttcttcctacttaatcccctatttgttccacaaaggattaagacacatacaaacaaataggaatggtccagccttctaattcctctgctcgggctgtgcccatctgctgggggtgatttgggatttggaagctgaactgtcctattggtacccaaaggtaccagtaggggtccaaacacagttcccaagtgcactataggaaatccggatagagttggccctaaggcaccttaccctgcaccccaagatgaacactaaaaatctgttcagctcattaaggggcctcccagcagggtggctccagtctgtgatctttgcagagcaaagtgatgggtgccctcattactgatgtagtaggctcttgacccgtgagctgcagctgcacacagacagctctgctgcccaacacactctcatcccagtcctcaggtggaggagggatagagtttactgggaaatggcaaaaaagggggggaggggtagaaatgggaacattttcaaattaatttcagaaatccagtcttagctctaaacgacagctgtgagtttaatcactgaaactctctttctattcaagagcagcatgtgtctcctgaggagggggagcattatcaagcagttaagtcgttggaagctgcttaggggctggtaggcagtctgcagggaaggggaggatggcttcgcttttggcagtgacctgggtatagtaggtactgcttacctgctatcatctcatgctatctccagcagtccctgaggattgctctgctctgtctatcactgcgcggggtgggaggtaacatcttgtacaacggaagccaatggggccaagaaaacccatgcctcagcatcgggctaaaaaagttaatggatttcttgattttaagggttggggattcaggagggaattttcctttccatctgttaccaccacagcagtaacagcaactgcaactacaacacactccaccaactacaagagctaatgcttatggagcacttcctaactccctaaacattcacgtcttcgttcatttatgatttactgagcatcgactatgtgccatacattgtgctaagcactgggaatagagcaggagctaaggcaggtatcatccttccccttaaggagccagcagtttagtggaaaagactaaatgggcatctgatgaactcaaacctggtccccaaagatgtcagctcacccgttcgaggaatgagtctcagccttggtccgtcacttccagcctaggtgggggaatgtcagctgatatgaaagctttaccctcccctcccatttacctctcagaccccaccctcaggacagtggtatctgtccgtggctcccatctgtgtgttgctgcccatcacttcagaggaaccagaagcacctgccagagagctttatgtcatcagccatgggaacttcttccatgctgtttgttgcactggcctattttagggaaaactctacgcatgaagagggaagctgaaaagacacagggcaaaaagaaatattccccaccccattctttttccccactatgattttcttcttctttgtcttttgttttatctattttatgattttgcttttcattttaacactgtggtgaggggtgggggggtgctttaaaaccagagccacaagcaaacaggaattagatcagggaaataagaaggcagatggaagaatgatttttgagtaaagcccaggcccagtggaatctgccttgaccatgtggtgctcgtgtgggcccacagaaaaaaacccagaacattgcagtagcaaagtgaaagctctgtggactgtgaatgcagattagaattaaaagatgtgcttaccacactgtctctgtctctgtcccagagcctgcctgtgaacgccaagcctccactctcttccccagatcctattctccgtcataagttctccatcacacattctcacctcttccatttgagtctggattaacacagtagatgctgctcttttttgtcatttttcctctaccatgaccaagaatagtagtttaggcaaataaagatactttcttcctacatatcaagaagttccaagcgaggcagcccagagctggtaacagcccaacaatgccgctatggaatatagtccatattttgctccaccacacatagcatgttggctgcgatcctcaggtttgttaccttatggttacaatatggttcccacacatccaggcatcataacctctttacaggctggaggaagaagaaagcacaaagaactttggttgccctccacagagccttgggtactctttcacagacaactctttatatcttgttttattttttgagacggagtttcattgttgatgcggctggagtaaaatggcgcgatcttggctcactgaaacctccgcctcccgggttcaagcgattctcctgcttcagcctcctgagtagctgggattacaggtgcctgccaccatgcctgggtatttttgtattttttagtagagatggggtttcgctatgttggccaggctgctctcgaacccctgacctcaggtgatccaaagtgttgggattgcaggtgtgagccaccacatccagccatctccttgtatcttatgttcccatcccaaaaccaatcactggaggaagggatacaattaccaggcctggtgtggaccaatcatgcttcatcttctgatcttctgtgggtgtggtaggggcctactttctctcagaacaagggctttctaaccctaccttaacaaaccaggcttctgtggtcagagcagaaggggaagcaatgtagttgataagcaatgagcaatgggtgccacttgcctttgaggtcctccttttgcctaggttgggtgccctggcatctcttaagttgggggtggatgtgagagagttatctctttatgccaatattaataattttgatgttcaaaagaagcccacatgcagtttctgacattatgttccacttttaaactctcagagccctagtctctgaattagaattctagttttagaagtttttctgggcttgcttttctattagaaaccatttggttttgtggccttgtttgaaggcaccattgctcactggttaaactgactccatttgcctgaatgattatcgcctgatgtcttgaggcttacagacccagagaaacctttattcttttctcgtaacagttaataataaagcacttgttcccttgtctccttttttttttctgccacagtatttctcaacctactatctttccatcttttgtcagctagtagtaaaattcttctaaaagacacccaagttcaccactgtcctcactttcaacatatagtagagcactttaatttgcaatttttttcttctcttttcttttcttttttttttttttacacattagccattaaccctgcaccactgccctccacatctttgtcttctacatgaaacttctgtaaaaaatgtctgttaacacctagtgttcttctcctggataatgaggaccaaagaataacccaagttctctttgcatgttggcttgcaggaaacttagagttgaaatacacagctcaatcttataaaatcttatgccctaattatcagtgataattttcttctctgagacagtatcttatatctgaatttatattttttctggttatgacttttttttcttttggttagctctgatattttaatttaatatgttttcagtaaacatataaaatcttttgtcaaataaaacaatgtatttaaaagaaaatagctctgtgcagtgggctttgctgttcttattttacatgttaggatattggggaaactaaaagtcagaggtggccaagatgttttcctattaggtacctactctggctgattggcaaatttcaccctggcatgttaggtagagaaaccttgagaatctgcatccctcactgggatagagatgtagttatcaattagcagtgactgttgtaggtttcatggaaagaggagaagtgtgatatctttcaaggacacaattttcctccagaaaatccaggaatcctcattttatatccatgctgaaggctcctagagtagcattcctcctcttccctccctctccctctttttttgctgtaacaacacgtggggagatatgatggaagcgaagaacgaagtggactcttcagctcaatggaaaggcatcaacacttcatttgatttggaagccaaagaagcaaactatgaaaacctcaccagcattgcaagggagtgatagaaatatataactcacaaatcattatagcttctcaacgtctcagtttttaaatttttactgtgtatttttttgttttgaatcactttattgaggtatgactggcatacaaaaagcagaacctatttaatgcatacaacttgatgagtttgagaaaagtacgtactcatgaaaagcatatgttcatgaaagcatcaccacatatctatcacgtcccacccttttatttattattatttttgcaataagaacacttaagatatactctcttagcatatttctaagtatactgtacggtattgttaaccaaaggccactatcgtgtacagtggatctctaggacttattcatcttgtataaccaaaacttggtacccttggactcagctttttttctgaatgataggttagatgctaatttgcctgcggtgcctacagaagttatcagtgacataggggaagataatcttccccagcctttctcccctgtctagtgttcaaattgtaaaattttcttgaactggactaaatgccttaaaaccctggaatgttggtgtctttgaacccttactttgagctctatggagacctagattgtccctggaggtagtgcagcctcatttcaacaaatcaggttgtcaaaatggctaattgtttcctcgcattactctccctgagaattacctttcttagctggcttcccacggaaactaatggtatttggcaactgtctacttccaaatcttcctctagaatattgcaagaatgtctgaaagcacaacatttttggacaggccaagatgccatgggagaaaacacacacacaagcctacgtgctttctccaaaacttggctctgaagacagtcatatggcagtcacaccacaatccaatgaattgttttacctcaggttttggaagtttcactgctcccaatagcttgcattaagccctaaataataataatgaggaaattctattaagaactatttcagaagctagagaatgtaatgattataaataagaaagggaataagccatatcaattgctgcatgtatattgtataaatagcttgttttgcttaagcattagttaagcaacattaaatttaaagagtgtttctattagccaaaggtatgtagtgtgtgatatagaatgattcttggaactttgaccagattttctgtctgggatgggagaaaatctggccagagtgtgtcttgtaggttgatcacaaattcctaatgttcatcaagagtggaattttgacggtataatgaaagcctattttaactatgtaatactattcttattccattatgtaggtaatgaaagtttgtatgtaaataaaagtttaagcttctctttataataatttatcacaggaactgcctgcaaatagattctaacgataagaatgttcttcttttagctataaatccttagttttctacttcttgcaaataaacagcttagttaaataaactcaagacaccatcattaaacaattcaataattaaggtctaatactccttttattattaatcataatcacttttttatttgaattgagctttacttagtttattgcctctattattgtctgagaggagcactcttatattgtctgctttatgcaggcaagtgtggttttaagatgagcttgggtcaaacatcaaagcaaaaaagatttgactataaatcctagcttcctcattaaccagcttggtcacctatcacaaatgattatagcctctcaaagcctcagtttttatttttttgaaaaatatgtaagatactactttatctactttgttcatagtagttattgctgacatgggacaagatgatctttatgctctatttggtgtttgaattatagaatgcttcatgaattggattaattaatgtaaagtttttgaatgttggtgtttgtttaatcagtattctataatactgccaatctcttactccttgctatccacatatcttcctgggtgatctctttcgcttgcacagagtcaacttttgtctgcctggataactccaaattctattccttttgtgcagaatttcccatgagcattaggcacacatagctcattgcttgcctgacatttctaactggatatttcataatcaactctaaatctacatgcccaaaagataactcttatcacatatcagggtatcaaaactagatatctgggagccatccttagctgaacatagtttcttaagaccaaggcacaaaatatttgtgtagaggagacatggggcaaaggagagaagaaaagcaagaacgaggttgtaaagaaccttgtatgccgagtaggaaatgttcatctttattccgaaggcaatggagggatccttcattgaaagccttctgagcaagggtgtaacatggtcagatttaagtcttattaagattgttctaggatcatctaggggatacagtgaagagaactttactgaattcaggcaaggcaaagagaaagctattgcagtcaacctagcattcaaagagaacactccattgtggacaataaaatcctggttgtttaggtctaaactttggccttggaagggctttttatataatctagtaaattttcctttaccaacaaagtaacagatactccagaagtttttaagcttgcccaaagtgactcagctggcagatggcaagtaccaggctgatatcctgcaggttttttgtttgtttgtttgaaatggaggagtctcactctgccacctaggctggagtgcagtgacgcgatctcagttcactgcagcctccgcctcccgggttcaaggaattctcctgcctgtctcctgagtagctgggattacagcatacctggctattttttgtgtttctagtagaggcggggtttcgccatgttggccaggctggtcttgaattcctgacctaaggcgatccacccgcctcggccttccaaagtgctgggattacaggtgtgagccatgtctcccggcctgatatcctgcagttttgagatacagttttgtgtgtttgccttggagaaaaagagaatttcagttgcccacgattcatacatttttatgtggcagcttccttgaaagggaacaaacgttgaagggattcatttggcaacattattcccattttatagatgtgggtttttaggcttgaggaggttgtgacttttctaaagtcatgtaattaattagtggcgaaggtgttatttaatgacagcatctctcaatatccacttccacacctttttttaatgacgctgcactaaggcaagtgcctcctctgggatagtttctgctctgttcactgctataactgcacagaggcctgcagtttgaatgaagatacacacagagataactgaagtttcaactaggaaagggcaactggggcatgtaggggcaagtgtcaactaggaaagggcaactgggtcaccttaccatgatgacttcttcatggtttcagcctggacagcaaccttgcagagtcagaatcctgatcagcagttttgaccagcacatcaagagtggctttacctcccaggcattgatccagcattagtcaagctacaagacactgatgtagaaaaccataatgtcagtttactaatgtagaataagaaataaaatctcagaagacctgagctctcctgtcagcatgacttgcacttgtacttttcctttttgtagagaagctaaattataatcagaaagttgttttggtgagcttggaatcagaaaataggagtttaagtcatctgttcaacatgcagctttcctcagctgtgatagctttttcctgctgtccagtcttcatgtggagcctggtcaatagcaccagaattctaagtctgctggccaaggtgctgcctcctgcagagagagaaagcccatcaaagttgacttcagtgactcccccttcactcacccctcatcttccacggccaaccaactccctttttgattgacacatcatttctttacatacattaatgccttccatattaccacagagagtttgttagactggaaatcattttatttctttgatctacttcatctttctctgcattgagcctttgcgtactaatttatagctattttctcacaggatagtctatttccattatatctatattttctagtggtcctttgcgtttgcctcttttccagactgtatagggcatggtgccaggcacagtttatttgttttattctatatgctgatagtatcatcttttccatctttagatgttttatctcattcagagtgagaggggcacttggtcagtcctttttgcatctcaatagttgatcctcttttgattaaaaaatatttaatttctaataatgtgtgttagagtgaaaataacaggaattattaggcccagtcaagactaacagttcttgactcatagttccaaatcacagttccaagatttccttaacctttctgatcctcacttccctcccaaaaaagtaagaatggctataattacctacctcatggaaattataaggcttcagcaagattaaatgtactcatttatttaacatgcatagtaagaactataaatgttaatttattcttacttacattaggatactgacttatgaaacagagattaaacacattctgcaaaaggactggtattgacaggctttgattctaatagctcaaaagataggccatggcttgctagagaaaatgaaaggatactcaaggctcattagattaaaaggctgctaatgttctctaagctgtaagtagatttttgcccacatttatgaaggttgatttctaatcagattagaaatggcataggctggtggcgtcatctcagagctgccacagcattctcaggagactcagccatatcatgttgggttgctctaagaacacacagagacctttatgctttttcacaaaagcatactctttccctggagtgtgtaactctatgtgttgacctttagtgggataagttcttacaatggagctattctgggtacaaaacatcactactctgtgagatttaggaagataacactgtttgctgattttacaagcccactcgagtgtcttgatgtgtcaaaatgggagtccctgaacacggaggaaattcacaacatcctaagcaattgtaacagatgaccttatctaatgagaactggggaagtcctctccttttagggaaagtgaaaaatgtgaactaaataggactttctgtaggagagatgcctaaccacccatgggcatgctcacttctacttgtgcagagagtttgcacaaccccatctcatttggtcctcacatcttctttgtattcattcactcagctaggaaggggaatggaagaacacattctccaagagtagtgcctttgcaacatatttttcaagtaaagtgttgacacaatttttgttaagactatgatgaaaagacaattgagaaagaattgtgaaagccagatcttgacatatgcataaaagtacatggatgcctggctctgggctgattaatgatctgtggttgttaaaatctagttatgcctccacttgggaggagtaggtaagctcccagggcaggtatgaacctcaccattttagagaggaagaaatctcagtgtcaggatgttaagttagttgccaagacctcaaaactcataaatagcagagccaggaccagggttgaaagtctggtgtttcacattctgccacacctctctggccagtgttgttcgtgaacttcgggactaagactccagctcaaatcctatgcggatgtaggtcaatttcttaacctctctaagcctcagttttctcatccttgatgtggggatcataaatttacttcttacgaagatgaaatgaaataatatatgtaagcagtgtgttcaataattgttagttcctttgcccttcctattttctcaccaaggaaatcaggtgcaataagctttagtgatctgctaaggctagataactggtaaatagtgaaagaagagtgaggagtcaacagatgattctgcttcttatttcacgtgctttagtggtatttacagagccctggtgcaagagtttctctttgtacttagagaagttgattttctttttcctaatttcttcttatttgaactaagaaccctctacttctctccatcccatctgtattttttctgatgagttctgtagaatatgatattgcattcaagcttcatcatacttttggtagcgcctttgcttgctacatgataactgtcattttagctgcaatttttcaaaaatctcctaaaacactcttctcacacaatcggcctctcttaactaacttgtagacaattttgcccttctgctcaagatcttttctgcctcctttagatttcctccctatccatttctgtctcttctccctatgccttgatctaaagcttttgtgcattatgggactttctccgaatccattttgtagtcattcactcatgtaggataaatgcattttttaaagcactttcattttcattttacatgaaagagaacacttgggtactggtgaaatgcttaggtcagcaatccttttgggaagatacacatgaggggtattatgtatctcgtctttccctctttcaacattttctaattcaattctatataataaatatttactgagtatctactctctgctgggtattgtgctaggttcaggggatatataactgaatcagacagaacccctttctttacagagcatatatgatgatgtcatctcaaggggagcccaggatttcaggtcacctatgtataaagtgagaaataaaggctggctaggagtcagccatgggaaggggatagaataagttgaacattcatggtaaagagaatactgtattcaagatcctaaagcataatatgttggaaaacagaaaatacagtatggccagaaggcagaactcaaaggagaatgagagccagcggatgcggtaggaaatgtggggaagggtagataaagaagttagggggtttattctcaagacaatgagaaattattgaaagagctaaatgaggaattggtataatatgaaatttaaaaaaattatcctaattgcagtggtcagatgggacaggaggcaggcagcaagtggagaaacagaagacacacagtaaaggagccaacctagactcagtggtaacagagatagcgataagtgaacagatgagaaagatctgggtttagaaatggcaggacatgctgatgattgagctatagaggaagaggaaaagaggggagtcaaatacctgtctatgcactgttcataggagatttaatctagtcaactgttttgagctaaaatgtgaaaatacaaatgccatggccagagcaaccataactattaattagcagcaacccttggcaccttcacccaaagcaatcactatgctgggaatatcagactctgcagtagaaccaaatccaggacatccgtgtacagcctactcacatcacagcatctaactgtgttcacataaaaggcagtgtgaggcataacgacccaactcagaaatgccttttttttctggatgttcttttcctcacaaaacatcaaataagagagtctggccacattctgatgatttctcttagaaacttagagaaggggagaacaataatttcctaaggaagtgaaccaattgaattgtcagatgggctgagcagtgacttcttcctggctctactgtgggcctcctgatggatggacatgggccctgtggtaaagagatggttctagaaatgcacagaaactatcgattccaagttgacaaatgagaaacaaatccaatctcaccagccaatcgggactcatcattttgccaaaacaatgcccatagattgcctaccactattattaagaaaagcttttatgctcatttcaccttcagtgcccttgatccaaggtctcagatttatcctagtttcattttcagtgaagtattgatttgataaaagaaacgagtcctgctgctgattgcttagacacttgttagtttcacctgcatatgtaaggtggagttggctgtagttcaagcaatagaaagaagaggtactattttaacaacagttttcaaatctgaagctgatgttctggaaaaattagagccatcggtttattttattgtttcatttataatctcagtgtgcatgtatcttaattctttgggaatagagaaatggcttcagagaggctggctgaatggggaggcagaaacatccaactctgtccctctgggcttctatctccctggggttcctttcacttttcctccaactttgtttctttaggccctggagctaatgcaggaattgccaaaaacatacctatgtggcacacaggtcctgcatgttcttgttctagtaagtggtgtgaatgtgctgtctctagaattatcttgtcctgtctcatcaagaaaatcccctgcagatgtgaaaccctcaagcaattttctctatctgaagatcaggctgcattatttatttatagttccttcagcctccaaaagccctggctgaccctcagtctttgagaacagcacctctgtaaacagatgaaagggattccctgtctggaatgtcatggaaggttccatgaatctagcttccgctaataccaaccattctagaggataaagcccaccactgcaaaagtgtgatccagcctcacacactgccttgcaaatattcttcaggccaactgatgggtgaaggccaggtttgagaacagcacctttgtagcccatgaagtttcttgacacatttagcctcaaacacttgcagagcagatatagtcgatatatcctgggttcatgaatgacaaaacttttcttcatgctgaaaggccaatcataggaacctcaagtttggaggaagtcgcaaacgtaggagagtaggtgatcttgttatgcttaatatctagtgtgatgctggaggaaagacagccaaattggaaagttggggtgagataggatgtgtcttttccatatgtttaaaggatagtatgctgacaagatattattaaggctacaataaggcaattgaggaagctgtatgtcaataaggtcttgagatactcagagagattagacaaagcagagtaatattttcacctgcttaccctcctcttcccccaaaccataccaatgaacaacatgggccccagccctaaattcacaatctctgatgtaagagcctgactaagcatactggcattaaacataaggatgtttgtgtaggcaaaaacccccaaacaattattttagttatctcaccatgttttcatgtctgtttatgaagactcaggcttcctaggctctctgagggccagaggtctcagagctcaggaggtaactagcattggcccttcctttagtttctctttgatagcttattacttaaggaccccaggggaacagtttcccagaattctaccatgacaatttcacaatattgaaaatatattaaactgacattaacactgacatgcataattcctaccaaagcggggaggccgttttgtcatgcggcttaggtggaggagagatagtaagagctgttaggctctctgaagcctcttagataaaagaagtccttagctttgactataataccagctatgctcaagcctttttccccccactatattctttacaatttcacagttaatctctgcattatggttctctgtagccagaagacattgcagacagggaattgagaggatgcttgagttaatctgcagggtctaaggtggtaaaggcaattcagctaccctcatagcatccccgatgttccgaagaaaggaagcagagcatatgttttacatggggataaattctctttatagctaattaattacaaattgccccccagtgtggtgatgtgcacttggggatagattaactcaggggaggagtccagctgctaattcttttttttctccctccctgtccctccttgtgctcccctcctccttgctccctatttcttggaggctgtgtctcctatcgctctgtttgtacagctagcgctaatctaaaatcacagttattagatcacattaagctcctcaaagtgggtgaagcatctgtgagtgtctcattaagtcctggacacacatagtcttgccacccctctctaattaagagattcccactcttccagcactgctgactgcttcctaaagaaagtgtgcctgccctggaggggacggaagggggaaggagtgaggtaaagtaagggtgagtcttctccatagaccgtgaccttgcccagcagtgtggcctgctggaggagcagcagtagcacctgggagcttgttagaaatgcaaaatctgagccccatctcagacctattcaattgcattttgtagtttaataagacctccaggtgattcatgtacacggcaaagcatgagaagcactgaaccaggaaatggatagaggagtggatcccaggatgcaaactggcagaatcccagttgttaggagatcacgccacaggcagaattcatctcagcagaaaccgaagtcaccaatggcaagtgttcgtgtatttgtgacattccttgggaattgtgtttgtccttgcacttgcgattttgccttttaaaagagcattttggggccaggcgcggtggctcatgcctgtaatcccagcactttgggaggccccgaggcaggcagatggcttgaggccaggagtttgaaaccagcctgggcaacagggtgaaaccctgtttggtttcatctctactaaaaatacaaagattagctgggtatggtggcacatgcccatagtccagccactcgggaggctgaggcaccagaatcacttgaacccaggaggcggaggttgcagtgagctgagatggcaccactgcccaccagcctgagcacagagtgagattctgtcttttaaaaaagtattttgaaagagtaaaaggagaataataatgtcattggacacatttagaacctatgtatgccaagcattgggagtagaatgcaaggcaaacatggctcttaagaaattcacagggaaggaagattctgaaataatctctctgttcagggctctatggggattcttaaatattgggcttatatgtcttggaagaagagacattaaagtgagattttaagtaagaaaaagtataggcgtgggaagggtgtagcaggcagaagaagcagtgtggatagaggcccagggataggaagagccttgccctcagggctagttcagattggctgcaatgtggggcctgaccagagagagatggtgcttggctgcaagggtgggccagggtcatttcacgcagggggttgtaagcctggtcattaggagctttattctaaggacatcaggaagctgatgaatttttaacagagaattctgagcaggagatgtcaatgaatgtcctgattgtcatccaggtgccagctgcattgactcagcattggcccacgcacactgcaggctgagggtgtggtgtacacactctgctgcttccctggtgacagcattccaccgactctgcccttagatacagtgaccccagatgtcaattcagaaaccacacacccacgttacacagtctgtaagtgaccagccactcaggtgaaacaggagacttgagtgatggcagcaaaatgaattgcctccaaattcaactgaatatgaaaacatggatgggttctcatttcccttcaacaaggaagttccatgtctcaagcactcttttagttactagggatagatacaacagtgagcaaaacagaaaaaaaaaattctgtatttctggagcttacatttggggttagcggctgggtgacttgtatcgatttccatcattatgtccttaatttcacagacgctgaaactgctctggtttttggctatttagagattgcactctcttcctttgtggcttaagctggtgtcacctttacagtaagatatgttacctgaaagagcttttaagaaaattaaatctattttctcctgcccctgtggattagaggaaaacttcctattgcccagtagcattttttttatgctctcagtgaataatgatgataatggcagctgagatttgaatggtaacttgggtctaagtactgcatgtgatacatttagtcagtccccacaaacctgattagaaaggaattacctccagcattttacagaagaggaaatggaagcttagagcagtgggtaacttacccaggttgaaattggcagagctgaggtccaaatcagagaaattcagcatcgatggtgcaatagactctaggaagtggcctcatatatggtctagtcaatagaagaagccagaaaacgcttttcagagaatgagatctagtcttgtcaccttcttcacttaccaccttttcttggcttcccaaggctcaaagaataatatgtaggaactgctaaaagataaactggggcacattcaaattttaaggagtttatttgagcattcagcaattcatgaatcaggcaacatgagacttgggctgttcagagctccatgacaagggtgtgaggggaaaccttataaggtgtttacagaagcacaggaaagaaaatgtttgattggttaaaatggaagtttgtagttcgaggttaggcgttagtttcggattgttaagctcgagttttgcttttctaggctatgactctactctgagttgggttttggtttgcttaggtaggaacccaccacactggagctgactcagcctaatggtctcccagttaattattttaacactatggtggggttacaaggctctgtaccagttggcctccgtttctttgttcagccccagtcctgggtactccccaccccacaccgttctcctcactcccagccacacaggccttctttcagtccttaatatttcccctgtttctttctaccacacaggctttgcacattctcttctcaatgcctaggatatgtcttcttcacatattttctcaaacacaaatgcagatctcagtttcaaggtaatttgctcttggaagcagtccctaacttctctaactacatcaaatcccactcttcagttagttccacctttcaattgcaattaacaaaattgtaattttatatttagtagtgcagtggttttcaaagtgcgactgccacaccagtggcatcagtatcacctggcaacctgttagaagtagaaattttcccactccactctagacctactgaaccagaaactctggaggtgggtggggcccagcaatctgagttttaccaagttgtcctactgattttaatgcactgtgaactcgataaccaccatttcagtatacactttttttttttttttgagacagagtctcactgtgttgccctgtatccacacctttttataatatgcttttggaggttttcccatcaagaggtggaatatatttctctacttatttaaaatacctgactttggacttatgttgtctagtaaaaggcagcaaagttacattgtgccagttccaagcctagatgtcaagaggctctatgctcttccatttactctcatggaatgcccaggctaaagtgaagtggcacgatcatagctcactgtcacccccgggctaaattctcccacctcagacttccaagtagctgggactatgggtgtgcaccaccatgcctggctagtttttgtatttttttttttttttttttagaaatggggtcttgctatgtcgcccagactgttttcaaactcctagcctcaagcaattctcccaccttggcctcccaaagtggtgggattacaggtgtgagccactgagcccagtctagcgcatgcctttaatggatgccattcttccctcataggctgttggttctatcaggacagagactgagttgttgttgattctctcttgatacccttacttgctattcagtacatgttaggtatccaattaatagttgtttagtcaataaatgagtgagcacacttgacttttgtaatgtctttttaaagaggtattattttacagataaaaaacacctgaggctttgggagttctattgactgctaggtgtgagttatgttgggtcttgtgaatttacaagtttcttctttggagaaaatagcaaccgtagcagctctaggtgcaaaacatctttgatgaagagattccattggtatttcatggataggctgaggaaaggtacttagtagcagtcccctaccaacctgaaataaacctgttttgcttccttccttactcaagcatttctcaagtatactatagctgatcttggcattaccaaaatgaatactatcctcagaaagcttaaattatctgtatgtttacctatctgctgtgtgtatgtagatttcctatagatacacatttttctaaaaaatgctaggcaggcagtgacatatgcaagagaataataatcaaattagtaccaaatacttccagttgaaaaacatagattatgtatttacatgatggttttggacatggaaagtatgagagatatttctcacaaggctgcttatagcaagtaaaataccattagggtagtctctttttcattgaattattcatccagagtcattgagggcttccctagacaatgtttatgtattttgtgtggaaagtataatatccaagaaaaaccattttcatattttttaacacttttaaatggttcactagccgggtgcggtggctcatgtctgtaatcctagcactttaggaggctgaggtgggcagatcacctgaggtcaagagtttgagactagcctggtaaacgtggcaaaaccctatctctactaaagatacaaaaattagtcgggcatggtggcatgcacctgtaatcccaactactcaggaggctgaggcaggagaatcacttaaaccagggaggtggaggctgcagtgagccaagatcgtgccactgtacttggctctgtacaagatcagcctgggtgacagagcctgggtggctctgatcgcccaagctcagcctgggtgacagactgggattctgtctcaaaaaaaaaaaaaaaaaaaaggttcactgtaaaatgaaagttttgttgtacttgctttttaaaatcacatattccattctccctcacccttgctccaacttttaaaaattgactttgtttaaaaaacaaaaaacagctgtacttggcagctggtttggaaacagcattgaagaactgaggaatttgcacaattaacagctatacatagatactggttctaggatgaaaatgtttaacggtgtgccaccaactctgttccgtgtaatagactgattaaaatcttatttacatttcttccaagttcttacaaatcctatatttctccttaattttcatttggtgggttattagatttggttgaagggaaagcgaatgctgtttaagtgtttaacaggctgttttctctactcagctgatgactgttatatttcacatttactctgaatttgaaaactagctttgcaatctcagcagaacttgttactctcatctgaatgtgccttgcctccaccttaaaacaaacctgaatcttaagactgatggttcagattttcataacaatgattaaaataggattctgggtggagcacagtgcctcacgcctttaatcctggcactttgggaggccgaggggggcagactgcctgagctcaggaactagagaccagcctaggtaacatggttaaaccccatctctactaaaatacaaaagaaattagccgaatgtggcaatgtgcacctgtagtcccagctactcaggaggctgaggcaggagaattgcttgaacttgggaggcagaggttgcagtgagttgagatcgccactgcactccagcctgggcgacagagagagattccatctcttaaaaaaaaaaaaaggattctgcatgacaaattaattagcaatcatgtacctcccatgtgctaggcagagcccagtgttaggaaaggctaggcctcaggaaaggcatagtgtctgtcttcaaggtatggagtctgtctatgctagtcctcaggaaaggcatggtgtatctgtcttcaaaacactgaaactctgcatttcccaaaggaggatggctaaaggatgagattcacataatgacattgtgaatgcagtgtggtatcctgggtcggctcctgaaacagaaacaagacatgagtggaaaaactgtgaataaaaaatgtgaataaattctggggtttggttaatggtaatatgccattgttaatttcttagttttgacaaatgtaccattgttgtgtaagaggttaatatttggcaaaattgggtgaagggcatatgggagcttacattagattcataacttttagatttgtaacttttctataaacctaaacttccaaaataaaatgtttatttttaaataaaagcactaggattctagtaaagacttactggaaagctcctgggttatttatgggaaataattattttcaggaaagcaccccattcttgccctccctccctgcagccttagaggatgtgtgaagaattaactggtcactgggagaatgaagttatcttttgtggataagggctgtgcaaaatgaacatagccttgtgaagtgggaattagggccacatctggagaattggtacctgctcaccactttataattgtgtggcttcgggtcagttaatgtatctgagcctcaggttttttaatctgtacaatgaacgtattgttttgcttatgcagacaatgggactactctaatagcgaatttaaaataatgttgtaaaagtgctgtaatcactgtgctctaaaaatgtaagaaaggtacttaaaccttccagccatggccaacatgactaatgacagctgagtggtacttctaggtacttcccagacttgagccttcaacaacctgaactccattgctttattgaagatggagagacaaagctttcctatgaaaaaaatggccaaatgtgtgttttatcctcctctggtggatagtccaagcattgcagcctcttattggacttgagcattatctgcaagagcagttccagacagctcttatgtattgcagtcgctctgctccctgcattccaccttcagggcagctccatccgtttttctttcttatggtgcctcaaatggccttacaacaacagcgtactattaaatgtatcattttttgagaatgcgctaatgcttttccccttatacctctagggtttactttgtcattctgtccttttatggtttatttcaacatacttagcataaagcctagagtggtgggatgcaatatcttaccttagctgaattgtggcctggatcatcagtgtccttcgcaaagaagtatagctgtagattctccctggaggaaaaacccatttaatatttagtttcatctcctttcattttgttcttggtgtaccagaaaagcagcaatgctggctcaggaaagagggacttttcagcaattcatttacctccctagttttgaccttcctcagctggatgtaggaaaaaaagatgttctcatcctgacttcacccacaccacaaatgtacatttagtacctcatcctccggaccagatgttaggcactttaggttcaaagggttgctgcccacaagagttactaactgggaagactgaggcaatgcattaaaaaagctcacactctgcctcatgtaatcaatgccatctggtggtatttccgcttgttggtaataggtagtgataacaacaagaatgataacaacgacaaacattaagtcagctctgtgaaccagcctctaaccaggtgcattatatacgatatctcttttgatatgtccaacaatactagaaggtaatactctttaagatatttttgcaaatgaggacactggggcttgatgaagttaaataacttacccagatataaccattgtaagcagaggagtaaatattttgattacataaatatatcgctgagttctgtcattcagtcttttctcatgacttttcctcatttgtgtcacacatcactcatcagtcttggcatatcatttttcctctggagattctgaaattggcctcgcattgcttcttagccctgactctaagcagccatgatttcttgattagggttggcatagaagataaatcctattttccattcagcgaataaatgtttgttgaaagaaaaaaggcaaaaaattcctggctgaggtgtttaaggaaaagcttaacagaaggagtagaaatttgtctcagccttggaagaaaggtgtagggcctggtaagcaaagtttattatgatagtagcttgattattgagtgcttactttctgtcagcttttgactatagccactgtcaatccatttaaagccacagcatttctagatgatatgtcctattagtatgcccactttacagaagagaaacagaagcacagagagttaagtagcttgtgcaaaatcacatagtctgttcaaggcaaagccaggacccagagcctgcagtcttttttttttttttttttttttttgagacggagtttcgctcttgttgccctggctggagtgcaacggaacaatcttggctcactgcaacaacctctttctcccaggttctagtgattcttctgcctcagcctcctgagtagctgggactaggcgcccaccaccacacctggctaattttgtatttttagtagagatggggtttctccatgttagtcaggctggttttgaactcccgacctcaggtgatccgcccgcctcggcctcccaaagtgctgggattacaggtgtaagccactgcgccccacctgagcctgtagtcttaatacaccatactattttaagagagcagagatgtctgtttactgatgtattctaagggtctggaacatagtaggtgctttatatatagcgaatgaataaaaataccctctttctttggtaaaataaaagaggaaaggcattctagatggggaaaatagcaaaagcaatgatgaagagataccaatgatttgttagtgataaatggatttttatacagcaagaattgaacatacatttggcaaggcggattggagccagcctaaagagtttagactttttgtttagctctcattatcagaaatcgtcacttcctacctgtccaggtttgcataaaccatggatgctctgttttatggtcccatataatgaagattatgtgtaattacttcatagtggattgcactctagcaaaattaactgtccatatttcttctcatgagccctttgcgttaataaatgatgcatttgaggaggcaaaaatggttgggattttctgtgggggaattcctcatgaggagataggaggaatcatggaaaatacctggttctaacaagatcttgattattgacatctgtttctttggcttttcaaggtagtaattaccaaacagagtagtatagatcaccgtaatgacatatttggaattttctgagcaactcatgtttcatgtaaattgaggtatttcgatgtgtttcatcatattagcaccatagaatgccatatctagaactggggaaaggaaattattcataaaaaacaatcttcatggagaattcagctagagaaaaagacggaaatgaatcaaaattccccgcaatcgctcttttccacccaccattcacaatatgtgtttcttcttgagacctcaatatcctgaaagaaaatcctctgtctcagaaagtggaattaatccaggtaatattttgactggattttgactggtaatatcagctgttgctgataaagtcaagattaatgattccttggctaccagtgggctgagagtgtgaaagtcaaaacctgttagaaaccaggggaattgcccatgaaataagatggctttgtgaatgcgtaggtgactctgatttccagaggggattttgcagtaaatcaatccttctaagatatttagcttgtttaactcaatgacattttcattcataatgcttttatttctcatctcaagcaggagagacagtatcagttctgcacaaaactgagcttgaacttttacttgattgtattttcccatctataaactcttatcagggtgctaaaactgggaataaaacctagcagtttgaaaaaatataatcattttattaatgaaagagtctgtggcttgtggtagagtacacattggggcctcatttgaagaattaacaaggattaaggaagagctgcttttcatgagtgcttctctcaggaatatctgtacgtaaacatattagaaatgagtgctggtgagcactttttggacagcatttgatgtaagccctgggagaaagatgaaaaataacaacctgatggtatttagagtttattcatacatttttgtgtatattgtctcattgtaattctcataatagtttgtatcaagcagggtgttattatcatcattttacagatagggaaattgaggctcagatggattcatttactcaccttgggtcctgcagaggaaaagtgaaagcaagtgtttaaacgttgacactcagatctcttactccaaagaccattctctttattattaaactattgattagcagtgattcacaaaggtctgttttgtctcctacaaatgtgtcattgtgtatgcatgactgaacctgtcttcttaggaaatcacgatgtatcggtggttcctgatttcttttttagcacataacatacctttctgaccctgccacctaatgcaaagtgtactactattcactcattctgttcttgcattttgtagattccaaaagcattcattttcacacctactatgggagacggagttaggtaagggaacggacgagcgtagacttgaatagcagctctttttcttaccagcggggactttgcctctcagaaagctacgcaatctctttgagtctcagtttcctcactcataatatgaaactgagagtagtactgactgtatatttttgtaagaataatgtctgtcatcccctagcccattggaggtgtcaacacatgggggtgagttaaaaagagaagggtaagacagtctccatcatgaatacatacttagtccaaagggcgggggaagaagcaaaagtattgcaatcagtgctgtttcctcagttgaataattaatgtaataatactgtttacccaaaaaggataaaatgggataatgcatggagaacacttagaatcatgcctggcacatagtaagtgctcaataatttttagctctaatcatagtaattagtaagtgctccatcagaggcttgcactggtactatggttgctctgaggcaaaagcttcaatcattgggctaagtcagagaaggcatcacaaaaacagtgccatttgaatttagtcttgaggcatgtggaggagccttccatgctgtccagagttcttcaccctgatggctgatttcataaataagcttaagtgcaatgtgtaggaaaattggagtgaaagttggcaatggcgggagtgctggtatgtgttggagtaagggtggcagggactacaatgtcactgccaacaaatggcaaattttatggaaattaaaatatcctgcaaagtgcggattcaaggcaatgctgtcccctttgctacaggtccactgcattaatcacatcctttattacaagtgtcaacacatgattgggagcaaaattctttgaggcttaactgtaaaggaagaaagggataatggcacaaatgctgacctccattcaaatcttgccttaccactaactagctgcgtgatcttggagtaattgcattgcctttctgaggtttcattccccagatcttcaaaggaagtgacaattatataccttgaaatgttgttgtaagcatttgagataataggcatacagtgtgtggtgttttggtagattctcagaaaaataaaaatactatatataattataaatatgattctaatttattttataaattataatatatttacaattatagctaaataccaagcactgtgttaagagctttataggaactatctcctgtaatgatgacatgattaataatgacacatgatggtgatatgattgacagaaagatatcagcaggcccagatggaggatatagagttcttttaatgacaaggatgcagaaacatacggagattgtatagtacctagttttaaagcagcatgcacctagagagaggtgcagctttctgggtctcccagtgtttccctgggacacacagctggggataataccacctacctggagtaaggattctattgggtgcaagaagctccctttgctgtcacaagggtgatttaatcccttggcatttcttccttcacatctgactgttctgggaatctgttgcaacttagagttgcaaggaatgaatgcgaagacaccctaggacatttctgatagttgactgtgacactaggtgatgagcatgtcagttcctcaggatcattccttgggagaactggctttaggtctgtctaatgttccccactacagagcactcagtaacttacccaagatcacacagccagtacatggaaacattaggatctaaacatgatctaagtgttcctaatgaccatgccatatccagttaagaattgaattgtgcatacaatttacaaactagttaagagtagagggaggaaagccaaacatcaacttccaaagcaacagaagttagatattctataataaagttatcggttgcatgttgccggcagaagtaatgaccaaaggagttagagaagacagatgaccaagggctggaatagctgttgaggaggaagtacattcctggcatgcaaatgattcattgcaggagggcttaccacatctgatataccacgaggcttccttgctttccagctgaaatacaaccacaacttcaccctcactttcctttcccgttaagctgcccacctatcacactccaaaacaacatgtgggaaacataccttaaacagcttttaaacttttcttaattctccccccaccacctcttctggctccatagagaataacaattgctaagcttaaaacatgttacaaaaatgttaagaattcttttctcacgttgccaaagtgactactggcttagaagaaagttggaaataagtggtgaaaagcagcttagcagaggggaaatgcgtggtcatttcctgaatgtaaaaaacacctagggttgggataatgtgaaaaagagacagtgattagatcaggcttccaagagttttcgagaggagtgcaccattagaccttgctcagcgagccaccgtccaaggctccctgatcagtctatttggctaagagacaaatgtgccaacctccccagcctcactcaaggactgaggaatcaatatctgggggcatacttgcaaacaattcataaatcttatgtaaagggatttagacaagatttgctttgctagtgaagggagtgggtagaagaattatttaacctgcagctgggcaggttaactagagagaggaagctaaatgtatgctatggtcacctctgtagaggaagagagcacagaaaattttaccttttcctggattaccttcccttcttgtttgcctggtgtcctttttttgttttgtttgtttgaaatggagtttcactcttgttgcccaggctggagtgcaatggcgcaatcttggctcactgcaacctccacctcctgggttcaagaaattctcctgtgtcagcctcctgagtagctaggattataggtatgcaccactacacccggctaatgttctatttttagtagacatggggtttctccatgttggtcaggctggtctcgaactcttgagctcaggtgatccgcctgcctcggcctcccaaagtgctgggattacaggcatgagccaccgagcccagctgcctggtgtacttttaattattcttgaagatccaaataattgcttctcttggaagctacctttcacaggcagacttcatagcttccatatttgttcttgaatgaactccataggttacaaggatttcctcacaagtctgtttctcctgctagagtcactgagattgtgatactaaacagtgacttactcatctttgtattgctactctctagtagagtgagtttactggttaaagcattttcattaaatgtttgttaagtgaataaatgttgatatatatatatatacacacacacacacatacatatatacatatatatctttatatattctcaccttcccccatccattatttctttggctaaggccacctggattttctctgttttcatctccatatctatagactgcatagacctctcacacaaatttgcattgctagttgaggtgttctttgagcttctcagtggttatgacaaaaaggactttagcagtttgtgactgtgccctggaatccttcagcagactgaaataccttcagctgaaggagatggtgtttatgcagaagcccagcacctagcccatcaagcagtctgaggtttcagttggtgccagagataactccagtgagagaactcggtctaggtttttagaagttcttccccagctaaagatgacatcttaatatataaaggtttaataatcatggatggtcctttgtagacatctattgctgtggaaactctagttctctttaccttgagtagcttcttaaaaagaaaaataaagagaagaactagcagtgggaagggagaaggggtatcaggttgtataagcaaagtgatttctctggcttatgcttctataaatttgtttataaccacaaacctctggtaacagggcatttgcagaaggaaaatatttatagaagtctaccttgccaattacattgcaaaaaataaattgcctttagagtccttaaaaaaattcaaatatgttttccctctccactgccacccccacatcaataatttgcagctcgaggtctatgtctaaaggataagagtttccacaagttgattgtggatatctgaaatcaaatttaattacatgtgatggatcaacttcttgaactcccatatttctttcattgtcttcttcggattccatgcctcacctttgtggaaactgaactatagagaaatgataacatgactcagagccagccctgcaatcaagggggagtcatctaacccaaattggtgagttcaggtcagcagcatatagtgtcttggaaagagcatgggctttgcggtcagatagacctccttgaatttgaaacccagactgttattaattatattgggcagaattcttaaactctcactctcctcatcttttaaaatgaggtttgaaattcatcatggagctagcatgatgatttactagggaacatttctctgggtatcaaggtcctcaacactcagattgcacttgctctccaacagaatttcccagtaattccctatgctagttttcttttgctgcataacaaattactagggacttagctgcttaaaacaacacacattgattacctcaccatttctgtaggtcctaggtccaggcatgaattagttgggttctttgctttaaaactgcacaaagatgcaatcaagcacagggttgtgatctcatctgaggcttgggatcttgttccaagctcacacggttagcaggatttaattccctgaagttgtaagactgaggccctcagcttgtagaagctgctcagttccctgacatgtggcctttccataggtgtttcataatatagcagcttcttcaaagttagtggtaaaggcagtaaagaaatacatttacatttatatttactaatgtaatcacaggaataacatcctatcacctttgccccattgtattggttaaaagcaagtcacaggattcccacccatcctcaagggaggggaatcacatgaaagtgtgaatatcaagaggtgaagaggaccgtgtcaccctagggtctatctaccacactgtcaacgtgcaatacccctggcatgtgtcgcagagcgccctcttgtctgtgtgggttactaattgttacagtgaaattagattcctctttccaaagaagtcagagttgtgaaatgcttgggaaactatgagctgtttccccatcccttactggtgtagacaaaaataactgatacagggcttttatttcctgtgggttcacacttagtctcggaatgctttaaaagacaacacactagacagaagctaacatttggtcagtgtcagaaagtgttataacacctattcaccattcttgaactatattatatcccagtgggctagaagtatgggtttgtctagcaccattttaagcttagtagagagaactcatctcagccttgtccctgggtcccttgaagtacaagtgtccttagtaaggacaatgacaattcatgtggaattaattagtagaaattcccacatataaaatttgtccttcactctatttcttaacaggaaaaatcaaatcaaatacattaacaccaattagatgacaacataatcgaaaacaaatgtgtttaccaaaaaaaaaaaaaaaaaagtacagataggtaactagggaaattgttaacccaacaaagagagactacatgagtctgagtcccttgggaaggataaacatgtttgtaaataaatttatttctctgtcaatatttacttttctttgtgttcctctccatgtgctgagaatttccttctcaggccttcatgattctatgagtgaattactagaaatgctgttagtctcattatttttgtaaaagaacaccttgtgcctgttcttgggctcaatttaagttagagaaaaacaaaattcatgcacatgagagagttcttataagatggaagagacatactattgatctaagacttatttgttttaataggggtccttagtcatgaattatcagtaaaaagcattttatagtaagtgcaattttggcaagaccttgtttctctagttgcataaggaatcactacatgataagaaacaagaaaagtttactggcagaaatagagaaaagatatgtacatctattttatctacctaaacataagtagataaaaatatgtgtaaatagttccttatgtcaggaaactgtgtctgaatatctttctatccttaaaggcccggcacagtgctaagtacatagtacacagtaagcatatagtaaatgtttccatatttcagggacagagtttggacgctaaaatgccaatatttgtttggctatagtgatttaatccaggaaaatagaaattagtttccatgctgtctctggaacttccacaccattctcccagcattttcatctattcaccaaactagaagctctccaaaccccatgttttaaggtttttaaggaggatccattacaaaggcatgattaattaaatcattgtccactggtaattgactcaatctcctccatcttcatctccatctctggaagtctgggggtagggtttaaagttccaaccctctaatcacatggttggtttctttggcagtcagtccccatcctgaagctatctagggtccattaagagttaccttattaggataaactcagattatggttcaaaagggctacttatgaataacaaaagacactctcctccctgtcactcaggaaatttcaaaggattttgaagctcttgtgatagaaaccagggacaaagaccaaatatgtatttcttattatatcacaatatcacaggctgtcgctgtatccaaatttcccccttcctgtaaggaaattaaaataaggccaaccctcatccagtatgaccttgtcgtaacttgattatacctgcaaacatcctatttccaagtaaggtcacatttataggtactgggggctaggacttacacatgtctttttgaaagacacaattcaacccacaacagtaactaattgacttcctttctcctgagctaccctgtgattgaggcagagcaattttctctaaggacatagcactgcaaagatagagcctataatcaaacatcctagttgctctttaggagctcaacctaggtctagcctgctcaatttagtatagttcacttctacgaataatactgaacccaaagcaagactctgacgaggatcgagaaagcagtgacacacctaaccatgctgtaaggcagaatagaagagatataacagagatcaagtgtgtaatctagaaaagggacatattgattatgctgaggaggtaggcatgggaggcagtagccatttgagaggcagaagcagcaggagcaaatgcatagagacaagaaacttccatctattgagtgactggttccacttggctgaagtataaggtaagtttggagggacagggatgccagggtgtggaaacacaggtttttgcttatgagtcttcaatgtctgagaaaaaaaaaaaaggccgcatgggatgttcttgtctatttttgctgttaggtgataaataggcagatatatctaggtatgtgtgtgcgtgttgccaagggatctgtatttatacagatttagtgacaacatttattaacacaacggggtgataggctttggcatcaggatgttgtaatagttgtaatttggcttgtatcaacatccctatttttgcagatgagtaaactgtggctttgaacaataaggacctcacccagggtcgcccagcgctggtaaatgttgggtttaggaactgaacccaggtctagctggttccagagcacacattggtgctttccgtggcgtggcctgtaggtgacttctgagggaattcagctccttggtgctgagggcttagccatgattcctttcagagtgagttctccatgtcttctttggccaggttcctgtgctcagggggattttcaaagataatggtgtccactggagggaaatatatcttggagcaaagatgtgcaaggatggttccagattctccattcctatttatgaaaactggcagatttgctgactgtgaacatagtggccaaagggctgaatagatatgagcatttgagagtaaaatgtgttttgggaagctttaaattcttatttttgaaataagataataaatgtccaaatcaaatgggaaattagtgaccaggttaaaaaataaactgaggttttccaactccaagttcagtgtattttctattttgttaaaaaagtaaaagtaaattgcaaagaagatacttggagaggaggaacaaagtaagtaaggcaaggacatgatggatacagggggattaactggggagggaatgtctgtaaagtgtataaattttggggttggggggggtacagctaaaaggagctgtcctaaatcctggcaaaggccctccactttaataagcgttgtaactttctctttcattgttggaggtaacacgtatgaaaggaaagcagcaatcagaacaatgcagtttcccagagggctctttagcagaagtctcctgtggttccatgctgttgttaatgctccccttattttagtctcctggactccctaaatgctttggaccacttgagcaaggccacgttgctaattgtgcagaaccccttcagaggtggcaccgctgagcaagaccaggcaactcaggctctaatgggccttgattgtggtctctggagcaaaaaccacctcttgaaagctgctgtgagacagctattgggaggtttggtaggaagatttagtgctgctctttgaaggatcgatgtctaagctcttcaaaacctcctgacacctcagatggattctaggtggttccccagtgggcacaatctcattatcatccacatacatttatttatctcctaataggggcccatcactgtattatgagggccgcaaagcctagctatggggctaaaacaagcacacatgaagcaatgaatgagtattaactgctgagatgtatatttctgatggcctcttcaaggtgcagagaaagaagatctcctccaagagaattaaatggtcagaattggggaggtaaaaattagaatctgaagaaactaaacatgctttagagagacaggtggttggcatcagaatgaattcctggcaatagggagcaacctgcagacagggaataagaatgtacacagaatggcctgagtagaatagaaaatgtgtgtctcttttgattataacaaggaagaagtcaagtttgtttttagtttgtctgtaacacccactcattcttaccaatttgccttatttgcaaagagacagctgtgcccaggcctttagaaaggaacagtatctaccgtaatttattggtattttattttcattctacagattgagtattccttatctaaaatgcctgggaccagaagtgtttcagattttggatttttttgggtctggggatatttacatgtacataataaaatatcttggagatgggacccaagtctaaacatgaaattcattatgtgtcatatataccttatatacatagctggaaggtaattttatacaatattttaattaattctgaatacctgtcacatgaggtcaggtatgaaattttccacttgtggcatcatgtcagtgctcaaaaagttttgaattttgtagcactttggacttcagagtttcaaattaaggatgctcaacctgtatttatttttacggttaacttctataggcaagtgacactggtttcaatgaaaatgtatgtaaatgaaaagaagtgaagcaatttaaggaaaaagacgaaataataattcaggtagtatatagatggggcaaaaatatgtgatattgacgcaccattgaccaaagtttgggaaaaagaggagtcatagtaaaatgttgatccttgtgttgaagtttctgatcctccttgcactactcaccatagatactccagaaaagtggaagaatgagtcaataaataaatcattcatgacttttccaaaggaaataatccaactatctgctaataagtgtcaaaactagggtaatgacaatgataaaaaggaatcaatccaggtgacacttgagagtaagaaataacaaataacagatcagagttaggtcaatgtttcttaaactttaatatgcacacaaatcatctggggattttattaaaatgcagattctgattcactaggtctggggtggggcctgggattctgcatttctagcaagctcccagggaattccagtgctgctagtcagtgaaccacatgttgagttgtaaaagttctgggtggtatcagagaggggcagaatcacagtgaactgtaaagttttgtgctactttaaaattttgttgaaaatgcaattttaaataagaaattaaaaacaaacttctacccctaaacattctaactcggaggaagttcttttccctgtaaactttagtaatgtccttcaattctataatctcttgttttatttctgtaattcatttttagttacgttttgttcttgattctcataagcataaagtcccgattggctcataataaactctgagtagacgaggcctgtgaaatactctaaaatcatgatttcattaacacgggttgtttgcacttgaggatgaagttgcccaatgttacactgtaatgggcaaaactgctttgcaaactcaagttctctaattctggatgcttttgtgtgatgacttattgctattcccatgtctctataccaatgacaaaacctttcaaccctctgagtttttcccctagctcctgggactatgggtgggagagtctgagggtcatctattgatattgaatgtggcaggagtgagattcctactcctccccttcccttgcccttcttttccaagggcataagaaggaaagcatggagtgtcagccaggctgcatggagctgcctaccagccagaacctgctaattcttattttatggaagtacctgtcatgtttggccaaatctcctacagaaggataaaggaaccaacacagaattcagctcccacactcccctgcagttataaaacttacttagctttatttaatttttaattttttttttaagtttagaagcttcagttgagaactgcaaattaagttgcgttcaatagtcttttccagctcatatgctgctgctaggttgcaattattgctcgacacccttcctcagtgttttgacatcttcgccagcctgagaaactaaaacacaattatttattaattttaggtgagttttcttcaattttaataattcctatactttatttacttatttgtttgtttgtttgtttctttattttgagatggagtctcactctgtcaccaggttggagtgcagtggcgcgatcttggctcactgcaacctccgcctcccgggttcaagcgattctcctgcctcagcctcccgagtagctgggattacaggcgcccgccaccacacccaactaatttttgtatttttagtagagacggagtttcaccacgttggccaagatggtctccatctctggacctcgtgatcaaccctcctcggcctcccaaagtgctgggattacaggcatgagccaccgcgcccggccacttattttcttatttgcatgctttatacctgctattacttagttcctgtgatgtttcccagaaatatggaattagctgtgccagacactatggccagaagactcaacagtcacatagcgttatgatggttaaatgctaggattgaatgttaaataaattttaaagtaaattttaagtggctgcataataatttattgtgtattcactaataataaatcctaagaatctaatatcccaagataaatgagcccaagaatttattcagactatattctgtaatattctgtgtgaacaaagggaataattggatagtttgaggggtaccatgatttcttacatgttgtacaacttaaatattctaagtgtatcttagatcacatgctacaaatttctattatcactattaatagctatcagatattgaactctattaagcatcatgtactttagtcaatatttgaaaccactcattgaggtggatactattatctccactttttaggtgaggaacctaagagtcaaaaacagaggttaagagcaggtgtggtgccttgcccctataatcccagcacttttagaggctgaggcaggcagatcgcttgaggccaggagttcaagaccagcttgggcaacatagtgagacccttgtctctacaaaaaataaaaatacaaaattagctgagtgtggtagtgcacacctgtagtcccacctacttgggaggctgagacagaaggattgcttgagccaagggtttgaggctacagggagctatgatcatgccactacacgctagcctgggtgacagagtgaaaccctgtctctaaaaaaaaagaataaaaaatagaggttaaataactcatgggtaatgagtggccaagcttagattttaactttttaattctaccatccatgttctcaaccattacactacacccatttaatattatcagtagatttatctgtatctatcctgaaggtatttattttcaacctatatacttcctgcataatgtgatttataatcaatatttttattccacccctaatgggtataatgcactatgctcagttctgttgagaaatgcacagaagtaaaagccatggtgcttgtttaagagctttttacaatcttgttaggggtgtggtgtgtacatatatacaaagtttagtttagtagaaggcctcagcatctatacaagttagtaggataaaagctatcccatactcagaaaaaaatttcaaattagtatcatggttaagagcaacttgtctaacctgtggcccatagggcacatgtggcccaggatggctttgaatgtggcccaacacaaattcataaactccttaaaacatcgaggtttttgtattgttttgttttttgcccatcaactatcattactgttagtatattttatgtgtggcctaagataattcttcttccgatgtgacccagggaagccaaaagattggacacccctggaattttacaggaatgaggtgccattgtgagatagggtggcctgacatattctgctaggtcaataagtatctctgatgtggaaaataactaattgtgggttatatcataaactattctctttttaatttgaagacatgttcctttctttaggtatttctcaatttgttaaacaaggccatgtttgatatctgtattttaaaatactctactccccttttatccaagatttcactttcctcagtttcagttatctgaggtaattcctgtatgaaactattaaatggaacattccagaaataaacaacttataagttttaaattgcatctccttctgagtagcaggatgaaatcttgtgccatcctactctgtcctacccagggtatgaattactttttgtccagctggccagttattagattgtgttaacctttggggattcaccaagaaccaatgttatatatgatccaagagtccacttcagtcacacactcacacccagaatgccagaacttgcaagccactgtgtaaaatatagtctggaaattattttatggaacatagttatatggcattatatgaacagttcttcaagcatgtatacatataatgatagctatattattaaactgtgccaattgcctgccctaccctttccacattttaactctgattcctaaactgttagtaaattcagaattctgagtagtgttgtgcaatttcaaaggacctgccctttcatcatactgttctgtctctgattaaataccttctttgtgtagatccttatataacatagagacagatataatccttctaaatggtctcgtaattttgtataaacccgagcagataatagtattgggggatataggatttagagaaatttattctgataactatgagaagaaatttataggtcagtgtggcattatattaatcctttttcatcttatcacacatttggctcagaatataaaatgtgtacagacatgagatctgtacattaggtagttatttatttttctttgaataattcctttctaaaacaaaatgttggtcagcagaggtggtaaaaatgctagattgttggtcttgtttgctaggattcatgacctgtttcataaaggactttgctaggatttgtgacatgctccatgaaggacttaacttgatcagacacattaaacttcggaactgaaagaaatatctgagcttgttcaacccagaggttctcaaacttcagtgtacatcagagaccaactggagagtgtattataatatagtttgctgggtcccatcctaagagtttctgattcagtaggttggggtagggaataagaatgcatttttagcatgttgtcagatgatgctgatgttgctggtctcagagccctactttgaaaaccactggtctattgtaaggctttctttttacctatgagaaaactgaggacatgagggaggccattcatgtacatatattattcaaatcctgttcctttccatccaaaagccctcatgtggtatcctgttgaagtttgaataaaatcccaaatccttattatctagaagatcttgcatgcctgttctctgcccatccttccatatcagagtctccatagagccttacttactttcactgcagttattcaatggacacattcttatttcagcatgaaaaacaactaatatgggcacatggcacagaacaaaagtgaaggtttgacttacagagaatttcaattccatttttcaattcctgccattttcttgggggctccaaatacagctaatataagtcgcatgctgagtgacttgtcagtctatattcccatgtggtgggtccatcttgattcctctgttttatctatcagagagtttgatcctcattataataatagctattcataacatgtattcatcagccatgtactagctactgtgtcaaacagtactgagatttagatgctgacttctgaggctagactctttattcttagaaaataaacaacactgcccctctattatatactgaaataatagtgatgtttgtctaaacaaccctagctggtcaaacaatggcaaccccttcccctggctgctgttttactcaccatttaacaaaaaattaggtggtgcctttggaggaagagaagggagatttaggcggaaggatttttttttaaaaatttatttttgagacagagtctcgttctgtcacccaggctggagtgcagtggcaccatctcagctcactgcaacctttgcttcctgggttcaagtgatcctctcaccttagcatcccaagtaactggaactataggtgcatgccaccactccggactaatttttgtagttttagtagagacagggttttgccatgttgtacaggctgatctcaaacccctagcctcaagtgatccgcccacctcagcctcccaaagtgctgggattacaggcatgagccaccacacccagctgaggttgaagggattcttacaaagacatgtgaagagaataaattgaaaataaatatgattacattaaaactaagctcagtactttaagatgtcatgttctctgacttgataactgaagaatttgtgtgagtcatgagaagaaggtaatttgttgtactttatattttcagctatccttgagaatggtttctgcttcttacattctcaatgatagacaagtctgacacatggagtttactttaaacggttaggcaatcccatgggttgtggcccatagggtgataacaatagaatttccttttgtctgaccttaaaaaaggatatcagataaatactgcttccttggtgcagttaattttaggccaaaatacaattattggtcagatgcacaaattatctctttatttcttaaggattagaaaaaattttgaggaatcctactttcttcctaaagcagatctgaaatagaaataattttatacaagctaatttttccagggtttttgtttgtttcttcttaaaaaactattttaccagaaaatatgaatacgttctgaaactttaccataaaaaattctcatttcttcccttcttttccttttcttttctcttttcttttctttctttctttctttctttctttctttctttctttctttctttctttctctctctctttctttctttccttctttctctttctttctttctttctttctttctttctttctttctttctttctttctttctttctttcttttccttctttcttttttctacctcttcttattttctctcattcaagcattaatgacctatcaattctacagatagttaattcacacttacaatgtgcctgtcatatttattttaaatattgaaactcactagaaccaaagtccaaatatggatgctctgtcgtggtgagtccacttgttacaaggaccctggaaaatgaaatcaacttggatagaaaccaacatagacccaattttatatcattaaaccatcttctattctaaagaacaactgtatgtgtattacatataggcttctaatagaatttctgatggacatatcagcaaatttaattcggtattttaaaaaatacatcctaaacaaaaacagatttttctcaggagtgtgagaatgatacagcatcagataataaatttaatataaataatgatattaaagataaaggaacagaagcaaaatcatttcaaaaatgtagaaacatttaatatagtcagcatatttattaaaagtaatctgaacaagcttagattggagtaggacatttttacctcaaaaacaagaagctaccaagaaactacagcaaacatatatttacattagtaacaaagcaagaatgaatactatcattgtttctattgattattgaagtgaaaaaactagccaatggagtaagacaaaacaaaaaacaaaaaaacagaagcaaaaagattggagaggaatctacagtacttttatttgcagaaagtccataagggtttattggcagactattagaattaaaaataatttccacaagtttgttgggtacaaggtaaacatataaatctaattatcctctccctacaattataattaccaattaaaatgtagaactgaaaaaaaattcatatacaatagtgacaaaaatgtaaggaagctaagaataatcgaataaaagattcaagaccattaggggaaaaatgacaaaatattattgaagattataaagtcctgaataagtcatcaacattgaccatatttatgtatgggtagactcaataacatgaagatgccaattttttctaaattcttctataaatccacacatttccactcaaaactccaacagaactgttcatggaatttgacaagctaactctaaaactcatgtatgatcacggggccaaaaatagccaagacaactcttgggggtggggaaaaacccaagagaaaagacttgcccaactagacatcaaggcatgttttatccccaaattaattaagacagtgggacatcgacacaaaataggcacaccagcctgtgggacacaatagagctcagtaactgttccttacagtatggaaaattgatccttgaccaggtagacattgaaaatcattagttaataaacaaactagtcaacctatgatgctggaataatttcttatctatatgggaaaaaatgaaattagacttcattttatatcacccatgaaaataaattaaggatatataaaaatttaaatgtaaaatgcgaaactttaaaatttttataagaaaataatggtgattagctttacgacctatgtatgggaaagatttcttaaaagaagggaaaaaagcatagatcattaaaaaaatattgatatatttgattacaattatttttaaaacttatgttccagaaagatatgataaattaaaagacgagctacagacttggagaaaacattggcaatgcacccagcacacaaaggattggtattctaaattgtataatgaccccctacatgtgatcaagagaaagaaaaataacccaatgaaaaatgagcaaaggatatgaataagcaaatgacagatgccaaaaccaaaatggatagttaacatataacacataaaagcatgtatagccacactagaaccttgagaatacaaattcaaaaagcattgagatattacttcaaaccaccagagtagcaaaaatgtaccattctgacagtattaagtgttggcagggaggagaactaagagctctcatatcttaaagagtgggaatgtgaattgaggcagccactttgaaatacaatttagcattgaagctacacatgacatttggcctcacaattgcatatttatgtaaacacttaagggaaactctcaggcaatttacattgagctagttattagaatgtacactgcttgttatgtgaaaaaaaatctaaatcagaagagtgcatcaataaattgtggtatctctatataatataataacatccaatactggagcagaacaaatgagagctacatgcaacattagtgaacctcacagtcatactcttgagtgaaaaaagcaaattactgaatatgcaaactgatactatttagataaagcttgtaaacatttaaaataatccaaaatatttcatgtgtagtttcatatatattaataatataaaaacatgcatggacatgacgaatgtcccttttagaaagaagaaagtgggactgttacaagaatattgacctatgcctgtaatattttatttcttcaaaaagaatctgaaacaaatataccagaatgttaggaattaataaaaaccaggttacaggtatgtagatatttattatattattatttctacttgttcgaatgtttgaagtacttcaaaattaaataaagaaccagcctcactgagatgtgtgtgctgagtgctctactaggtttattcacaaagttcttacactccctgctctcaatgggactgatgaaaatgtatgactcaaccaaattatatatgaccgcatagcatgacattcagcctcattgagaaaatgtcaaaattgtgaatgttaaattctaaaatatcaaggctcaactgtagacatacaaaaccaactagggacataaagaataaaaatgaaaacaaaataaaagctgtttaataatagaattcagaacaatatataatctcttcttccctgctaaaatcaggccagagattggcatttgccttcctgaaggcaatagttagcaggaaaaaccacacaggttcatataatacaaaccaaaacaaaacaaccttctcacacgaagagaaaagaatactttgcaaaatggctgctgcatcttcccaaatacatatttcacctccccaaacagattttccatccttgaccttctcgttggaaacctctccttaagcagttacacacagctctgcaaatgttagagtgacatttggactgggcttgcgtactcagcttgcccgctcttctgggcttccccgggggtctgccaagctccagcacattggtattagccttgcaggcctcacctcccagagctagcaataacatttaccagctacagttttctccattttcaaatatttcctctggcccacatgccagtgatccagctcctccatagagtagaacctgaaaggagtggtttaaagaaaggagagccctcctgtaagaacttttaacatttacctttcattaaagattttacttgtggtttaatcgagctctcccactagaattctggtatgtttgggaaaaattaattactaaaatcttacatctctgggaggcggggtacatctttgatcattcttttgtcagtgaaaactctgaaaaacaacgcctctggttggaaaggaatcaaatctgagcttttgccgaaagctttttgcaatcccaagaaatctggattgaccaggaaattctaaatcataactgtagaaacagtttcacagccttgctatgcctaatatgtgacagggactgggtctaaggaccttcataaagtcaggtgcgttgtctctctcatttgttgtatccccagtgcctgaatgaatggatgaggaatgagttgaatagtctcccaaaagctaatgagtcatgagctaatattatccttatttcaccaatgagaaacctgagactcaactgagagatcaagtgacttgtccagtcacagagctaataagtggcaggcctcatatagaggctgagaacttcattgtgctggtgtaatctgtactagtagagatacatatgtgttcaaatgtcatgataagcactggcaaggagaggtaaacatgaataagaacacagttgagtttcaactcataaatgtaggaggaaacaggaaaagagaggatcaccagtagacaaacaccacattaataaatattgcaagcaagatcactgatggatgctaaaattagtggataaaagtttgaggagaataatatttgcataggctcaaagtattttctctaatacatgtatcaactacaaaggaaaatacaatcatttagaagtagagagacctggaacttggaagatcctgactttatcaaataagcaggaaattatcaccaggaacaaggcatgggaatatcatgaaccccttgatagaatgcactgaaaaggacacaatatcatttttatggtgttcttgccaaaaacatgtaacttctctccaatcctgaaaaaacactggacaaaaccaaaatgaggatctttgatacaatatctgactagttctctttaaaaagacatgaaagacaacaaaagactgaggaactattgtagactggaagggagcatggcaaaataatagctattgtgatgtaggatcctagaacagaaaggaagagaaaaacatattaatgggaaaatagtaaaatttgaataaggcctgaagtttaaaatattgaatcaatgtatatttgctatgattgataatcataccatggtaatgtaagaggttattagcattagggggagtaaggtgaggggtataagaaactcagtataatttttataacttttctataagtatgtaagtttgaaataaaaaagtttaaaacaattaaaaaatgagcagaaaatacatttgtccttccagtttgcttacagaattgagagagtcaaatatgtaaactaaactaaagtacacacaaaaaacagtcctgtaggcaccgccgataataaatgtatgtaccagatagaaggccatggaaaagggtggtcatcttacctgggaagagagcacaggtagcactcaggataggcttcatagagaagacgatgctcaaagatttcttatttatccaccatctgttttatagagcatctactatggaccaggcactcttctagaacatagctacatcatggtaaacaaaaaagaaaaggtatctgcattcttggagcttacagcctagaagaagtcagataacacatgagaaaaaaaaaaaaaaaaacaacaccaaacaaaattaattagatattttcggtgttgtcatgaaaaataaatgagctgatgtgatagaatatgctcagggagataggggaattggggaatacctttctgagaagatgatagttaagctatttgggctagggcctgaatgggaaagagccagccgtgcaaaatgaacaaggagcaggtaattccataccaaggaaacagggtggctgaatgcccaaatgcaagaacaaattagtatgtttgtgtttaaggaaacaaaagtaagccagcatgctgggctgtaatggacaaggaggcaatagtagatgatgagctgtaaagtaaggtcaccaggtggctctaagtccaaactggcacacttttgagtaaaaggtggtgctattaataattacaccaggacaacagaagtgaaatgagactgtctggccaaacctggacataagatcatcctttagcaaggaaagaaatcacgtaggacttggtgagccagccaaggagtatgaagttattcccagtgcattaggaagcatgggaagttataacaagggtaggaggtgattgttctggctgccatgtggagaacccactattgagagcaaagaatgaatgtaggggggatcattaggagatgatttcggaagtctagttagtagacagaggatgggggctttgactacaggagtagacttgggagaggagagaactggatgacagtagagtcaatgagccttgcgtgttctcagaagatagactgagaacattttagacaaaaggagcagcctgagcaaagtcacaggggcagggcacgttccaggagccaagagtgtattctatggccaaagtgaaaggaacagcaggggcaggccattggcctggagataagaccaggggctcagatcatatgcgatttagaattcaaggctaagtagtaagaactatggtgccattgaaagtgatatgattagattggttttagaaatatgagtctagtccaactataagagaaaaagataaaatgaacagaaaaatacagtgaaaacagagatagcttttgctagttagagaaataaacaagaagacattttgaggatggtacaataatgtgggagatatttttatttttactggaaattgtccacccattcatcagacacacacttgatcatctagtgttttgcaatataattagttgttgactcaaggactgctgaacagtgtcactgagtcataaagacggctccaagaggaaaactttgggcacaaattaatgctatgtaccctctactttctatcttctgctgcagcgctattcttggcccactcatttctaagttttagcaatatttctcaggctggtgtgcctcacatgcaattctggcaagctaaacatggtgacggagccagataacttgttccctgtagactcataaactcatcagctgtgggctggtaatataatttacaatatactttgccagccctataaaacagcttttttcttgcagagaaatggagccctgacaagaagtgtttatgacttaattttagctgtgttcttcgttgttgctgcagtagtagcctgcgtatgatgcatcctagtcatccgccaggcagttacaactttgttgttgttgtttttggcaagctaaggacaacattagactttgcttaatacctaccccacaatcctatttcaatggtggccatagcatgtacctccatgtttatgaataaatgaatcgagacacagttgttggatacctcacagccgtggcttataccttgatgaaactatatgataccatatccttctagataaagttcctgtaaaatgatattgttagaaggcttgagtggaaaaatctgaaatatgctgtttacagtcaaaatgattatcctcctgctgactagttgttctttattcttctccacagtgtactacaataactatttaccattcatatttcaggctaataaggttacttctattcagccattacataatgtgactgtagctaaaattaaagctccacaaggtaggaaatttgttttattcattgctagatcctcaaggtctggaacaatgcctggaacaatagtatgtactcagaaactacatgttgaataaataagctcaactattgacatattaaatctaccctaatgatttgggaactaatactacaaatagtgtagtcatcttccaagaagagcatattctcctgaggttggccagagggttgatgaattgatgtatcagccctgatacattatatagcatccaacagtcattccaataacatgctaagatctgcaaaactgtaactgcatatttgaattcaaatccagggacagttttttaacctaggtaactctagattctactgtacacaaagttagagttgtgagatttctctttattaattctcttttttctcttagccacatccactaaaaaaggtacttttatttcatgtcctgtatgagttgtatgtaacgtctggctctgtcaccattcctttgtgttctcattccatagctaactttccttaagaagtgttgtaatagcatatatttcagtgttcacaaaaaaacacaaaagcaatgttctgactaggtgactcaatagattttatgtgttttatatatacttatgtatatgtacacatatgtatttaatcatctgtttcacaacattgttgattttgtttttcctgattttggaagcaggattccaaataaggacagtaaaaagcaaactttttcatatctctgtaagaagggaaatcaaggctttaaaatattacctcagtttcctcaggtatgaaataaaaggtatgaatgcaggtaaatttcaactttctttctaactctaaatttctatgcaattcagagacagtaatatgacaacttctatggttctttttcgataaagtgacaagaaactgattttactttaatcagtttatcagacttcttaaattttctttgttggcttgacttttctaggaaattcatcctatatcttagacaacataattttggttcacgttgtatttgtgacccagtttgtccttgtaagttgtatgtatagaattgaggtttgttgaactggcacattgtgaaacaactgccaggaagaaagtatattttcttctgccaccctaaaggatttatctctctgatctggcctcagataatatggaagcacccacattctagtgagtacaactgtgtgtggagcagttcagttatctagcccttcaacatagtcatttggaaatcaaaagcgttaaccactagattagataagacaacaaaatcaagagttcagttgaccattaatcatttttccaaaatcagctcaatgacgttgtgtaataatatttagaataaagcaaaggtaataggtataaaaatccattcatttacagatctatacccacagtcaaacatccttcttgatggttcagagctaaagcctttattcaaattttactaaccagttattgtcaatgataatgagagagtaaatgtattctctggaatactgagaaaaagaatatggcagagtgaggcagcaagctttgagcaaaacaagcaagaatatctacagaacagtgctgttcaagatgaaaagcataactggaccatgatatcaggctcaatcactaaacatagcctgcccatgactgttatgagccattcttaccctcaaagaaatataaaagatttaactttggatttttgaatgcaatctctaccatgattgtgaaagtagatccattgtgtagggagtttgagaacagaagaaagcagaacgtcgcccttatttctctatttaatcaaagtagacttcataatgataaggaagactaacaaagaattgtaattaaccctttacaattatgttccactttacagtttgaattgcagagccctttcaaacatattttcttatgcagtttttaaatatggttcaagatttacgtaagggaaaagtaaggtcccacggttgcatgcccgtgagtagtggagctgggacctcctaacaccaaggctctttctactgaccagtgctacctgcaacatggaagtatcctctcatggaagcaatgggccacctctagacctcaaggaaattcaaacacatatgtacatgcatatatatacaacatgtactgagcatggtattatcaggcatggcttggatattttcacattcatacttcagtgttttcctttgtgctggatacattttccttgcaactctggatccatttccaatctttctccacccttcttcattcagttttgcaccttggaatgtgattctatgtggattgccctgacagctcccttgtcttctgtatttcagttgagtttgtcctgtgaaaaatactcatggaagatgaaaggaaaggatgagaatgagatctgggtatttaatttcctggctcttggaaaggcttgtctgttgacctcaaggtctccactcactttatctctttcccttcctctgcactctagcaattggccctcccctagacccattagggaaagtaaaagggtctgctcttaatagacctgaatactgcattacccctagagggcccactatctcttacctataccttttaaatcttacctttattaaactttcatcaaatggcacaattcaaatgggccatctgttttttaatggtttcctgactgattcggtattattattacacttgggaaactgagtcccaacaaggttttaccatgaaataacttgcagacctggaattccacccagatcttctaactccaagcttatatgcttacagagacagcacaccaagcaatgattctgaatgggaggctgacccatatgtgtaatcacagctctgcacaatagagctttcttgaattgactcagagcaattctcagaaacataccactgtcatttataatggtttattttgaaattttataacatgtttgcacaataaagcaatggcaaaagtatctggaagaaaattgaataagattacatctagtctttcactacaccacttggtcttccctgaatcaccggagttagtctaaaaagcaagtctgatcatgtcactttctatctaaaaatgctttctattgactaatatctaaacttcctaactgtgctttttagagtcatctatgtgttcccccatctcaaattttaccatttctttccatatgctctagttaaggggttctcaactgggggtgacttttccccctaaagggcatttggaaatgtctggagatgctttcggttgtcacgaccaaagggagtgccacagatatctagtgggtggaggccagggataccgctagatatcccacaatacacaggatagcctttgcaaccaagagttatctggtcagaatatcagcagtgtcgctcttgacaaactctaatatactccagccacaccaaattcctcctgaaccttgaattttctgcatggtattagattggtgcaaaagtaattgtggtttttgcaattaaaagcaatggcaaaaactgcaattacctttgcacccgcctaataactatcattcaccagattctgtgcttaataaatgatttcatttcatgcacttgtgaaagctgtgcttctacatatgctgtttcctcagccagagtgccttcccactcttctctttgctctttactcttatattcttgaaacatggtttacaggtctccttcttcttaattctcatctatacctttgtatagatgcctaagctgaattctcacattttctttattattcaagtataacagtttacctgtttgagtctacaacacccacttgctatattctgtactaatgacagagaacatgctatttgtgctttcccccaatttcagcacagtgtctgtcacatattagatattagtcattgaatgagagaacaaatattattgcaagcagttgatagagttctgaagaattgtgttatgtttaatttgtataaattaagtcatattttaaaattcagtggtaaaaattgctatttaagaaaagtctctataaactttttggtaaattgaaattctattagaaggtatacatttataaaccagagtttctctattccatttttttctcttttgaatattaaaaatatgaaagagtacatgcctgcttttcttaaagtgataaatatcaatccaaattgttgtcatccctttagagtgctctagattttggggaatgagaagccaatatgaccatatgtaatggcaggactccgttgagaatgtgaagttagttttcaaccttgtccacaagagggaggacatcaccccacatccattttgttgattccctggaaccgttgggtctgtttggagctggagatttatgttgctcctgctgttgcaaaatacagatttagaacctggcaggcattcttgcatagatttgcatgcagtttaagatcagcccagtttgggtggagggaaagcaatctgggcattttagaagctttgtcagaataaaacacacttaagcagtgtgtgatgccagttgctgcatgaatgagcaggagagtgtcttgaaggtacagaaagagaaaagggtgagggatgtgataatttggtggtaatttgcttacaaggttgaccaggagagtgtcttcttttcacaggagatggcttaagggctggtgggagtatagtgctaggaatgaacgtcagcttgatatgctaagagcaaaatgagagcagcaaagtccactttgtgaagttatggagctaattgctcataatactgtatcagtgccagtgggcctccagcattcactagcaatatcacatgaattgcatactctagtacttttgtttacttctttccttttactacctgccagtctggctttgtctttctagactctagaagatgtaaatggtatcacttccttgcaggtgtagccaagaagatcctggttatcattctcttcctacagtccattttccttatagtttttacttttctttttgattaggaccttatcacacctaaaacaacatatgcactggtaagattgaagactttgagctctaagttttagttattttctatctctttggatgttcagatatactaatttgattaaagaaaggaaagtgggaaaatggtagaaaggaagaacagctgcctgctaggggttttctctttcaagttaaacaaaaatgaacatgcaaaccaaataatcattatcccaaagtaagaaaaggggtacaacccaatgtcataagtctcaaaaattaggagcaagacagaattctgaagccaacccaggaggaatggtcaagcatgatgagcctgctagccccacctatgttcctaaagtacagtactatccacttggtaaaaatgctgagaattattactaatatccttatatatgaaaagaaacttagtacatattcttacctgttcccactgaaaactgaagagtagtggaaatggctataggagaaaaaaatatatgtaatagaaacagacaacgggactgagaatcaaaagaaaagtcaccaggagcacatggattcccctccattgccttgggatgttctctttaaccaggcagggtgacttctggaataggacacttaacaaagcttcaggaataagacacagtccagatagctaaatgaagcttacccatagccttgacacagctcttgatgtcttccctccatttcctgaacatattctgccatctctgaagctacagaaaaaaagtgtatagaactcaaaatattacacaattaaaccgtagctaattctaggtggcaagaagtcaacgaaactgtgtctgaacaattaggaactctggacagagatgcctgagtgtaagcaaggtaaaagggaatgacatggcaatacaaatgcaaagcaacagaacaataaagttaaaaaaaggaaaaaaagcttagaaaagtcaaataattcgatctagagaaaaagcaaaagaacagaaaatttcccgtgagctacattctatggctcaatttgcattattgaatgactcaagaaaaattgaattcatgtcacaagaactcaaagaaaaaaaaaaaacaaattatctgaaaggaaaagggagattgtagactaaaggcaaaaaaaaaaaaaaaaaaaaaaaaaaggaaagccaaaacaatgtgatcacataactaatttgaaataattagtaacaacagggggtggaaaagatatggctaaaaattgaaatattgccagagggaaagtgctgaagatatcgcagttaatgctgatgaaaaaaaccagagattaaattaatcacagagaaactgagatataaagagggcagatggtataattagatccctgaaagagaaaacctaagtacttcaacaaagaaattactcaaaggtatcaaactggaaagttttcttaatataaagaactgactctgaagtttgaaagagcatgttaagttgtaagaaaactacacagtatgttcaatgctaagatgtgcattgatcaagtcattggacttcaaggattaaaataatatccttaaggcatataagcaaaatttacagcacttatcacctatgaggtagattgctggcattatacaatctcattacacaaaacaatgtctataaaattgagcataaaatcaagtgggacaagaattatctgcaaccataatgtaactcaaatgtaaacagcaccagcagacattcacaaatacgaacaaactttggtaatataacactaaagagttcttttttaaaaagttgttaccatataataacaatataacacagatgagctctttttaaaaatgttgttaccatacaataacttaacagtacattttaaaataatttaaagagtgtaattggattgtttgtaattcaaaggataaatgcttgaggggatggataccccattctccatgatgtgcttatttcacattgcatgcctgtatcaaaatatctcatgtactccataaatatatacacctatattatttacataatcattaattatgtactcacaaaaataaaaaacaacctgggtaaactaacttatttttaacttgaatctatactccccccaaaaaataaaagacattacaataaaattcaagcatttaaaagaaaataaagttactcagaaatggaaacacttggtgagaacagtgacggcatttaaatatgcaagaaatacatggtacacattataaatatagaacaaagtatacatgtgtcagaggtcccccaaaccaccctcaatctgcatcactctctagaaggactcataggacccagaaatgagaatgtttatgagtatggtttattacagcaaaagttacagagtaaaatcagcaatggaaaaaggcgcatgggggcaaagtctggaggaaaccaggcacaggtttccaagagtcctctcccagttaaatcacaaaggatgttcctaatttctccagcagtgatgtgtggcaacacacatgaagtgttgtcaaccagggaagcaaccctggagtccagggtttttaccggaggtcagtcacataggcatacgatgcttacatgactgacttagttaccgaggctccagaccccagagggaaagcaagtgttcatcataaattatattcttagcatgaactatctagaccaactggtacagtctgactcaaggccctaggcttgcaaaaacactcttaccactcagaaattccatgagctcaatacacaggagctggtgaagggccagtcgtgcaaataggcctttcttgggagtgcacagtttgaacaactcagatcttttgagttaaccctttcttacacaatatgtgataaaaatagcaaaaaatcatagatgaaggagaaaatgtcaaagaataatgttctcatttttcataggaataaggcagttttactgggtaaatttgcaggagggagttcaaataataacaccagactgggcatggtggctcaaacccgtaatcacaacactttgggaggccgaggcgggtagatcacccgagaggtcaggagtttgagaccagcctgaccaacatgggaaaccccgtctctactaaaaatacaaaaattagccgggtgtggtggcatgtgcctgtagttccagctactcaggaggctgaggctcaagaattgcttgaacctgggagacgaaggttgcagtgagccaagattgcgccactgtactcccacctgggtgacagagcgacagagcaagactctgtttcaaaaaacaaaaaacagaaacaaataataacaccagttgtcttatgtgtttaataatatcttttgtaaattttagtgagttatcttggaaggtagtacctcataaaaagtagttgaaattcggagttttttcttttgctaactttgtgtaatattaaagtttagtttaattaaagtagtacatatagattttcctctaaagagtttgtctattctatttgtgtgtgtgtgtgtgtgtgtgtgtgtgtatataatatatatatgcttagaaaagtacctagaaatatgcctctctactgttaatgatggcatgatttgaaaagcttaatttttttctttatgtatgtctacatctcttatattttaaaatgatgaacatgtactatttaacaaaattaaatctctggctagatgcagtggctcacatctgtaatcccagcactttgggaggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttgagcccaggaattcaaggttaagtgagctatgattgtgccactgcactccagcctgtgtaacagagcaagactctgtctcaaaaaaagaaaaaagttcttaatttgatatttgatttttctttgaaaagggaggaggataatgaaagaccgaggaaatcataactctctgagacaagtttaacacagactgggaagggtggcttttatttttaagggaatttaagcatcgtacagataaaagaaacatacataaaaaagtaaatactatgattttctttctccctggattgctcctttaacacaataattttacagaaacctttttccattgtaagtattattatattgctcaattttccagtgccaatcccttcctttatttggaggagcctctgaatgccagtggggagatagttttcctcttactggtcagaggatggaaatttagagagaagtcattgattattgagattgaaaagcaatcagacaataagtaaacaatcagacagtaaaagcaaaaattggtactaaaatgtgttttaaaatgacacaatgattaaataaaattaattatatcctctagaaatagaaatgggcttactatgacaaatacagatatataccatttgggactaagaaaaattttatgaagaaaggtatgtgaaatatttttaatagccaaaaatagaggaactctggaatgggtgggaaaggagtgagcttagcagaccttctctgtgaaacaatcgtttagctggtgaaaattattaaaacatacacacacaaaagaagctaagacacacacatttaaaaaattgtcataaggacacacagcaaatggaaaaacatttattcaagacatctattaaataccagttagaaaaatgagaggtgtgatatttaaactgtaaccagctgccatccgctagctcacccctgctccttgttttggaagccaaaaggacaagagctttcttacctgccagttatcagtctagggctacagttcaaccccagaagaggcaggctactggtgcctctcattttccccagattcatgttgcagaagcggtattatgggtaggcatagccaagaacattgggctcacttcttttatccagcccccgtttatagggtataagctctataccaattgtggcagaccaataataatgcgtgtccaattgtctcttcctcagcttgcttataaggcagaggttccatgctgggaagggcaagctgaaaaggccagagtccaccatctttcccaaattcccacttatacaatggtagtgtcactcgggtggaagtgggccgctatttgtgcaaccaactgggctgtaatggcacagaaattctgcccagggatagatgcagagtgtcacaataagagtttccactctgcctggagtcactgactatctggaacagaagttagagaagttcatggctaagggttttcttaaacaatggagatcttgatggcaagcagcttatagggagcaggcagctctatgataccagcagcaatgagcaaactggtaaagcagccagaagtcgagtagagagaatcagggaatgagaaagccctgaagagccctctggggatcacacttatccctgagggtatggaaagttgtacatatttgcaaggctacacaactcagaggtaattagagtaagacacagggcagatttgaaagcattctcaagccatacacagatgcctcatccaggaggaagagtcttattggttcagaaggcttaaacgtgatctctcaaccaacactggctgaacaataaggtactcttactcaggtgctattcctaggaaaacaaacttaaaaacaaaatcgttcattcttggtggtctggaagactgtatttattctgaaggctgaaacatctcaagggtgacaggaggataatttctaagctaacagtcctttgctgaacatgaggcaagatcataaacttcctcaaagcagtctccaagtcacacatatacaacagacaaagggcaaaaatctaactgaccaagggggcttaagtacagtatttgatcaataagttacttatattgatacactcacaggaaggcaagccaaaagataaaaacaggggaacctttctgaggggggagacgagagccgtctgccgaaaatatacaagtctcagaattatctctatcaaatcactaaataaatgaacatatgaacaaacaattagaaataaacctagaggaacagggttagtgtccagacttgttacaatgtattatctaaagtccagctttcaataaaaaattaggagaatgcaaataaacaggaaatgtgacccatacacagaaataaatgcaggcaatagaaactgcctttgagtgggctcatatgttggacttaatagacaaagaatacaagtaactattataaatatgttcaaataactaaaggaaattatgcttaaaaattaaaggagaatgagaacaatgattcatcaagtagataataaaataatgaaattttaatacatattgtatatgtctattcatctatcttccaatagaaattttagagttgaaaagtccaaaaacctaaatgaaaaattcactagacgagctcaatggtagattagagttggcagaagataaaataattgtattagtctgttctcatactaccgataaaggcatacccgagactgggtgattggtatgaaaaaagaggtttaatggactcacaattccatgtgactgggatgcctcacaatcatattggaaggtaaaaggcacctcttacatggtggcagacaagagagaaaatgagagccaggcaaaaggggtttcctcctataaaaccatcagattttgtgagacttattcactatgatgagtagagtatgggggaaactgcccccaggattcaattatctcccaccaggtccctcccacagatgcgggaattatgagagctacaactcaagatgagatttgggtagaaacacagctaacccatatcattccatccctgacccctcccaaatcttatgtcctcacatttcaaaaccagtcatgctttcccaacagtcccccaaagtcttaactcatttcagcattaactcaaaagtccacagtccaaagtctcatctgagacaaggcaagtctcttctgcctatgagcctgtaaaatcaaaagcaagttagttacttcctaaatatattcagggtacaggcattgcataaatatagccattccaaaggggagaaattggccaaaacaaaggggctacaggctccattcaagtcccaaatccagtaagtcggtcattaaaccttaaagttccaaaatgatctcctttgactccatatctcacatctgggtaatgctgatgcaagaggtgggttcccatggctttgggcagctccacccctgtgggtttgcagagtacaattcctctcctggcagctttcatgggctggttttgagtttgtatggcttttctaggtgcacagtgcaagctgtcagtggatttaccattctggggtctggaggacagtggccttcttctcacggctccactaggcagtgccccagtggggactctgtgtgggggctcacaccccacatttcccttcggcactgccctagcagaggctctccatgagggctctgcccctggagcccatctctgcctagacatccaggcatttccatacatcctctgaaatctaggtggaggctcccaaacctcagttcttgacttccgtgtacccacatgctcaatatcacatggaagctgccaaggcttggggcttgaaccatctgaagccacggcctgagctctaccttggccccttttagccatagcgtgagtggttgggacacagggcaccaagtccctaggctgcacacagcgaggggtttgggggtgtggctcagccacaaacaaaaccattgtttcctcctagcttctggggcacctgcagttggagaggctgccataaaggtctctgacataccctggaaatatttgcctcattgtcttggcgattaacatttggccccttattacttatgtaaatttatgcagctggcttgaatttctcctcagaaagtgggtttttcttttctatcacattgtcaggctgcaacttttttggacctttgtgttctattttccttttaaaactgaatgcttttaatgacaccgaagttacctcttgaatcctttgctgcttagaaatttcttccaccagttaccctaaatcatctccctcaagttcaaagttcaacaaatctctagggcatggaacaaaatgctgccagtctatttgctaaaacatagctagagtcatctttactccagttcccaaaaagttcttcattccatctgagaccatctcagcctgaatttcattgtcagcattttggtgaaagccattcaacaggtctctaggaagttccaaactttcccatgtttttctgtcttttcctgagccctccaaactgttccaacttctgcctgttacccagttccaaagttgcttccacattttcaggtatctttacagcagtgcctcactcccagtactaatttactgtattagtccattttcatgctgctgataaagatgtaccagagactggataatttataaagaaaaatatgtttcatggattcacagttccatgtggctggggacacctcacaatcacaatcatggcggaagtcaaaaggcctgtcttatatcatggtagacaagagagaaaatgagagctaagcgaaaggggtttttcgttataaaaccatcagatcttatgagacttattcactaccatgagagcagtatgggggaaactgcccccatgattcaattatttcccacagggtccctcccccaatatgtgggaattattggaactacaattcaagatgaggttggggcggggacacagccaaatcatatcaataatcaaacttgaaaatagaacaatagagattatgcaatctgaatagaagaaataaaaattttgtatatttataatatataactttaatgaatggcgtgtttgtatatgcgtgcacatacaaacacaagaacttccatcatgaagcattatggatgtgctttggtgcttggaagcatgggtgtgctccaggcatagctctatgacaatttggcaggactgttaagtatacagctgggagaatcagaccgcctgcatgcaactcccagttctgccatttattagccatgttacttgatatctagaaaatgagataataaagtcttcatggtgttcttgaagattaaatgacttcttaatgcatataaagtcctagaaagcaccaggcgaatagtaaatgctcaattttaggtatcattattgatcttctttagattctgcccttccaggagataaaagatttgttttgttttgcttcacatctggatcatgtgttaaatttagattgtttccaatctaagaagagatcttcataatatgtcttattgtaacggtgtttgcaactgtcacacttttatctgtaatcgctttatagtttgcaaattgtaatgtgcagctgttagcatgtcatgagttttacctgggagatggctgattttcaggactatcataagtgcatttatattacttttcatcttttgtgtggtatctgaacagagtagggatatgataacaacacagactattttgggacccttcaatgtggtctgcctgactcttgtttctccctgtttcacttctttctagatatgagggtacgggtgtttttctcttttgttcactgttacgtctatcacctagaatagtgcctggcaatcagtaagcacagaagaatatatcatggtatctcataatctaaaaccatttactttccagtagatgcccaagtcctttgattttattccggtctcaaactaccttacatgataaccattttaaaaattatatgtctgatgctgtattagcctgttttcacaccgctctaaagaaatacatgaggccgggcgcagtggctcacgcctgtaatcccagcactttgggaggccaaggagggcggatcaagaggtcatgagattgaggccatcctggctaacacgatgaaaccctatctctactaaaaatacaaaaaattagccgcacatggtggcaggtgcctgtagtcccagctacttgcaaggctgaagcaagagaatggcatgaacctgggaggcggagcttgcagtgagccgagatcgcgctacagcactccagcctggatgacagagtgagactccgtctcaaaaaaaagaaaagaaatacatgagactggtaatttataaaggaaagaagtttaattgactcacagttctgcatggcttgggaggcctcaggaaacttacaatctgatggaaagggaagctggcatctttttcacaaggcggcaggagagaaaagagcatgtgaagggaggaactgtcaaacacttacaaaaccatcagatagtgtgagaactcatgagaacagcatgggggaaaccacccccatgatccaattatctcccactaggcccctccttcgacacatagggattatgaaaattacaatttgagatgagatttgggtggggacacagagccaaaccacatcagatgtttctgttaaattgaatagtttgttataatctgagcatcctccttctttctttcctttatgtctatagagatactacctgatctacctgttcaatatgatgccattgcttctttcattacaaaccctacccatctaccaagaccaacacagactctatcccatctgccttaattgccttcatccttcagcttccctcctctgaatgttacttgctttgtatttatttcctgtgtcatttaaccacttgtatgttccagtacagttacttgtgcattctgtgtctccctttagaacagggaccttgtctgtttcacctttgtattctccatagtgcatgtaggtagcaaatatttgacaacagccaatatttaataaagacctactcagtgacagatactgaacccaatgactggtttgattcctaggaatgtgagtgatattctcttcctgtgttttctaaaattatttgcctagtgaatatttaaacaaattcacatgttgaacatcatagtgtttcaaaacagcccctggacttggtatcagatatattgagtcaaatccagagatgctgtgtgactttgggatgataacatacccctttaagagtcttggttttcccaaacaccacatgttctcactcataggtgggaactgaacaatgagaacacatggacacaggaaggggaacatcacacactggggcctgttgtggggtggcgggaggtgggagggatagcattaggagatatacctaatgttaaatgacgagtcaatgggtgcagcacaccaacatggcacatgtatacatatgtaactaacctgcacgttgtgcacatgtaccctaaaacttaaagtataataataataaaaaaagtcttggttttcttgtctgcaagtaggaataatagaatcacactatagtgttaatcgaggtaacaaattgtcggtaacctcagactgaggaaggtatcaaataaaagtgagttttcagccaggcgcagtgggctcacgtttgtaatcccagcactttgggaggccaaggtgggtggattgtttgaggtcaggagttcaagaccagcctgggcaacatggcaaaaacccatctctacaaaatatctaaaaatcagctgggcatggtggcatgcgcctgtaatcccagctgctcggtaggctgaggcaggagaattgcttgaaccagggaggcagaggctgcagtgagcgaagatcacactgctgcactccagcctaggcaacagagtgagactgtctcaaaaaaataaaaaataaaaataagtcagttttcctctttccctatttgaataaaagtaaaatgagtttttcaagggtgtcattagctttatgttattgttctaactctgcctctatcagatattctttgaatgggccaaactctcacaatggctggacactggggatgttatgatgccagaccatgctgctactttttccttcctttaaaagctctctggtaaatatcgatttgtctgctctggtggttataaactgctgctctcctcctattcttcatgaaatacagggattctaagttttgttttatgtacttgtgttttatctatcgcatacagaattgcaaacaatactatttgtgaggggcgttttgactttttcaaaatatcttcatatccattatttaatttggtacccttcacaagtctatgagcctggtagggcaggtacctgtgtcatcataatccccttacaaatgaggaaatagagcctcagaggttaagtggtctgcccagcgtcacacagattaaaaggtggtaacaacaagggttcatcaaacacaagtcactaggctacaaatctggcaccctctctactcgcttagcctgaaagcaaaggggtatttggcaactgtgacatccgtcatcctaacgatcttctccattcttctttggcagaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacttaggtatcgtatgaagtaccctctgccacttcgtttgggcttgtcttccctttcttttctgattttcattggtttgattgaattctttgtttgtttcttgaaagttagctgctcacctcttgtttaacagacccaggataaaacccaacagcagcgatcaccttctccttgtttctgcatgaggttttgatgtcaatttctggtttctgacagtggtgatttctttactagattatttgttttctaagtttcctttcttggttttttggaatcgtttagctttgtgtaaaacacgctactttggtccatcttttgatcaatcatattcccataagtccaactcctcagtcaccactcaaaacagtcacagctgaggtcagggacagggcaggaagtggaggcaaaatgttgatggtggggttgtaggaaattaaactttgtgggtagggtgagaagtacattgtttctagctccacagctactattcaaatggagaattctggtggccttgatgacactgatatctcctttgactttctcctagagggaggacaagtagattgttgttcccttggaaaataattccctaagttgagtctgtgacacgtggaaggaaaatgtgtctcctgatacgtatacccatttttcttcttgacattcttaaccatcactcagcatccccttgtgcaaagattgttaccttgtactatcactcactaataactctcttcttcttatataatacatatctattttacctcagagttgaaaaattatgacttcaaatttgtggctttattggaataggattttctctttcattgtaattacctataacagaatctttagaaattttcctttatatggcctcatattctcttctgctattgacctttactgaattctaattgatattctatagagattgggatcctcttggtttttggcaaggaaaaaacaaacaaacactccatttctgctgtttctaatcagcagaaagtcaatacccagcattgataagattagtgagacagctgggtccaaactttctaagctagtgaatgtatttgggtacgtagaatatgtttggatacagtgataccttataaagatttcagtgaaatggtttgtcagagccatggagaaaaaatgatgaacaaatgtaccagatgcaagatcatatgtaggcccacatgtcctggtgggaaggtggggtttttgaatccataccaatcttatctgctgtcaggtcaactggacacacttggaaaatgcctacatcataaacctaaaatctctgggacacaaaggactgttttgagcagtgacttctttagttatgtcttttttttttcttctagttttcagtgtttacagtaccgtgctctttttcttgtccaacttcatttgatttctgttgtcagtgtgtctcttggtttttcttttgtttgtgtattgtgtgtttggtcattttaggttatatttttttcttttgctggatctttttgtgtgcgtgtgttcctgagtttccaatcctccccgccatcaaccatggtaaatcaaaagatggtattcaacccttcaaaggcccaaagcctgcggcccgcatagcaaacagccttgagaacacagcgtattgagcagcctacagagactggcatacccctgaccctactaccttccatccctgcaccatcctacccaccttaaatcaatataagagtgtgttacctaaaaccaacagccagcagctgattatctcctcagaaaaaaacaacagaaaaaaaaaaaaaacagaaccaaatacaaccccataactagctcactgaaaaagatgatgaagacaatttttatctctggatctatttcaaagtcagagagagacaaacatatgagaatgattcagccccacgcgatcctgagggagtgtacacagtgtcattaaacagacatttttttccccattaggtgttgtttagtaaagattagagtgtcaactttgacaggtctcacatcttagaaggaaaaactggggtcagtgggggtacaaataaaagcgtataagaaataaggaaataagtgtacagattctcattctctctctcacacacacacacatacaccttgagttggtcatacatcccacatgcatttctagaagcattatttttgtattttaaactctagtcaaagtctgagagatgtgcttttccaatagactttgctttttttttttttttttcccctttggcttcttttgttgcaatttcaatctagctcctgctgcgttgaaccatctcaggcaaaggagaggtagcctctctgtagagagcactgtgcttgtccagaagccatagttaattttttttacaccaaaggataggttcatcataattactggtttgaatttatttaactttctttccaacctgacatggaaaactgaacttaaactctcatgcttgtgtaaatgcagctcttcatatccacgccttgtttaaaggttttccttccgttccctccccaaaatatacccctttgcaaatattttctttctctttgccgtgaatttgtgtttcatttttctcaattacagaagaaaatgtatccaagtagaatttgtcttcacatgcattccaccaaaattaatttcaaatgatcactttgctccctcactctattcaagttgtgtcttttttctagcccatgcactaacaatattttagtttatttcaaattgatcacacatatgcattcatgatataaaagcctagtatatatttctctgatgtaacatatcttccaaatgtcaaggagactagggttttccaatggctttatcttctgcaggcagccatatgtggtgctaacaggtatgagaaatatcctataactcagcacaacttttaaaaagttgagaggttgactattgatcaaccatattttgattctttagaattataagctataacattttattattacagcatatttaaagatttaaaagaccttatcttattttaatctcatgatctcatggatctcatgcgattaatgataatctcatgataattttgtgagataaatcaagcaagtgtttttatgcttacttttacagatgtgtagcacagagagaaatatattacttttcaaagcttacataaaaagttggagacagagctggaactagaacccatgtctctaaactgctagatcagcctgcgttatttgtttccttcacagatcagcactatgggtcaatgatgtgttagtcttaatggcttccaattgtttttatgatggtcacctttgaaacacacacagagagaatctccattttcctcagtgcccagtttgaattgagctgcactagggaaaagacagttgatatggacaaaacctttaaaagatccttagcagagtgccaggagcccttcttcaatggcagactctgagggagtggcatgtagtttggtaaattgcatttgaattctccagatgttctctctctggaaatgtggacttgctattactgtttaccaaacacattattgaagacacacagctcttagaaacatttacctcttccatgctcgacccaaagctcaacaacgagaaaaactttcttggccaggcaccttaatctaattacagacacttaggcctgtaatcccagctctttgggaggccgaggcagcccatcacgaggtcaggagaccagcctggccaacatggtgaaacctcatctctactaaaatacaaaaattacctgggcttggtggtgcgtgcctgtgatcccagctactcgagaggctgaggcaggagaatcgcttgaacacaggaggtggaggttgcagtgagccgagatctcaccattgcactcaaacctgggcaataaagtgagattctgtctcaaaaaaaaaaaaaaaaaaaaagaaagaaaagaaaaagaaagagaaagaaagaaaaaaactttctatcatttaccataatttaaaacaaaacaaaattaaaacaggcaacacacagatatgaacacatacacatcaaaagatatgccaagacttaggcagacttttttcaagcaaaaagtctggctgctaccaaacgtagatttaaaggaaattgccttcccaactcagttctttgactcatattttttatttaaaaaaccacatatataaatgtgtatgtgtgcgtgtgtctatatacacacgcacacacacacatatttatacatatatacatacacattcagtaacaagaacaccccctcagagcctatcaagaaggctctgggatagattttccttctcaaaccacttgttcttcaggtaaaataacaaagtaattcttcacatattgaggtaaagtaaacaaactgtctgccatcttgaaagcgccaagctcttacattggtttaaagaccgcatccactttacatgaaatcatttgagtgatccagaaagatgagcccaagccaccacctctcactaggccagcttcttgtctaataataaaatcctcagctatgcagaagccgaagacaaaacccacttgttgtttgcagtccttgggtttgttgctttaggctcactcttcctctcataagcgtgcccatacaccagtttcctctctctctttaatatgtcaggaagggacatttctccagctttgggtgatggtaggtgcagtcagtagctgaagccatcacctcttcctccctccctgccctccctccttccagtcctcaccaggggcatggcctcctctgtctggtaatcataccggttgctccagggctgtttgctcccacttttctgttgcggttgacgacacatgacaaacctaaccgcacgaaaccaaacccagatttttctcaagagatgttcttctcgggaacaaataagcattctgcctccttactcagaataactgggtgctataaatcgctcctctccagatttcacgtagcttcattctcccctttattcttgctcctttaaaatgattcactttggggaattcaaatggtggcatcatccttgacaagtcctctaaaaactactgggtcaaccttaagcagaagaagagtactttgtgactatattttcccctctatctttcttcctttaaaaaaaaaatcatttcgcttctaccttttagtatctaacggtaaacaaatccttattggaatttccaccatgataaaccaaccttaggctgaaccgggcagcttggtaacaactaacctgagacctttctctgaccttttctgcccagtcccctactatgcccactgattctactcaaggacttctatgttgtgtgtccatgactcccaagcagagattaatacaatgatagatatgctgatctctggcacagaataccttgtctgattactagctctggccagttggtcactcttttcttccctccctttcccatttaaaaaagtgaaacaaaaaccaaaaaattttctctcctcaagatgtggaatcacagagtgaaaaatactcaagatgtcaaaggtgccgagacctcctccacacgtgcctggcttgccttctccctgaatgctgtgggcacttgattcagtctgcgtattcaggcaggaagacagagatgggctgcgcgagggggttgatctgggagcctttgaatcactagcaatcagagaacccaattcattgtgataacatcatacaactcctttgaccctacacccgaccccacctctctaaaatctgggatgggtgtttgtgcggttagctgtttgcaagtggccattttatgacaggaaatgaccaggtggtgttaaccctttccttaccactaaggaagatggcaagtgtgcctatgcaaatttctatagcatttggggcccaacctaaggagagggtggagggagtttgattttagaaaaagagaaagggttaagtacgtcactgagcaacttcatgggcagattttttaaatgatacaatcagtcagactggtgatatgtctttggaatactaatacaaaaattgtgttaatgctactttaaaaacgaattttaagaaaataaattatagaggaaaatagaatataacctgcatttggtggggggaattattgcctatttttccaagtttgacaaaattaatatttcaaagtccaggtttgaaatactttatataaaagaatagctttttttgaaaaaaaaaaaatgtttggtgtctactgtggatatatatgtataccagtatatatctctatacatatgtgtatatatatgtgtgtgtgtgtatatatatatgtatccaactttactaaataatatactgtacatatacacccacccttaaacttgtacatactttatatatataaaatggccacatttcttacgtgtgtctgtccccggaagggtggactgattgtttttggatgtctgcagctgttaccttgaaggatgcaatttcatctttcatttatttttccccatctagactgtatcaggataaactgtaactccagtaagttttccctcaagtttcattttgttctttaaaaaaaaaaaacaaaactgactttattttgtttactgttttatgagctgttttttatttgaattattttttcttttaacaatggagtgggggggacctggggctaagaagatggggggctgggtgagggtgaagggctgagtgtggttttgggtgtggtttctgaagtgagggcaggtcctctcttctttccttgcatttgctctatatgaagaaaagaaggcaagggcacatgaataatgaaataatgaaaaatcaagttgaaatgatgatttattgtttttgggaggtaactctgagagtgaacaaaaagctttagggcaaccagcatgcacttctccactaccaaacagtttagaaaataaaagcactgttcttgacccacaggtggctgccaactctgacatttctttcccagtatttatctctgttgggaacttctagcaggtgggcagatcactgctattggtgataaggcaacactttaaccaaagacttgagacacactctgtctctgcaaaaggaagaactgcagtattattttcaccttatcccattcagataccctagttcttgaagaagggtcctaacaaggcacaggatgaaaactactcatgtatttcttcctcttccttagaagtaaacattagcttgagtcaacatgtagaaggggaatatgaagataaataggaagaataggcacaagagaaagaataggcctagatgatgaaaggaacaaaggaagaaatatgctttgagtactatagcatattatattaggcttattaatactaactactgtaacaagcaatcccaacattataatggctcaacaaaagaaggttttatttcttgttcagtcaaagtccaatgctaattggtcagttttcccagacagctctcttcaaagaggtaattcagggatctaggatccttccatgaggtgggtccaccacctcggagttctttacttctggctgtatccgtagggaagagagagagagagagagcttgggtggttgtgcagtaggttttattgccttgcctggaagtaacaaacatcgcttctatccatatttggtttgctagacatgactccatcctacatgcaaaggaagctgggaaatgtagtcggctagtgcacccaggagaagaaaaactggattagttgatatctagcacatgtaattctccatagtatctcatcatctttaaaattctttcctcactaggaaaaatccaacttttacatttggtttacttgttgattccatcctagtaagtcttttataggtgctagtttaaacttctttcttggtagaagatatattataggcatgacaaactaataaagcccaattctactttttggggggcaaatgttccatctaagttaacacaaaaagaagaaatttaaaatatcgatataagcaactgcttactaaatagagtgctttatccttgtcttggcatcacttacagttattttaagcaatggcctattttctgtgtttaaatatttctaattagccagaaatttgtcatgatatttagatcattaaaagcctaattgaaacatcctttctctccaaagcctggagttttctgttcctgtttttttggtttgtttgtttttttaagcagctttattgagatacaattttcataccactacatttacccatcataaacctacagtttaaggatgataattaaacttataaagttgtccaaatatcaccacaatcacattttagaacatttccatcatccccaagatttcttttctggtcatttgtagctaatccctgctcctacccatcgtcctaggtaactattggtgtgctttgttccaataaatatgccttttttggacattttatgtacatggaattagacaaattgttatatagtcattgtatcttgcttcttcaaaaaattttaatggcatttctatggaaatattttctctttccttttgcattggttttcagaaggaaataaggtggaaacccagcatgaaggtggaaagcctcgtatccgaagctacatctagcatcttctagcttcagagacttatttggagaacagggaactgaggcagttatttaatcaggatatcagaatttgcttttgctgttctatccacactttctcatgaagtcaatcccatatattccacatgatcagccacggaaagtcatcataagacaactcccaggattacctctgttgggaagatggtgacacagatgacagcaggttttcttaatctgataaaatattttctatttacaccccaccaaaaacagcattgagaggaaaatatgtcagcaaagttatattcccagctttgatcacaaagtatagaaagaatataactgatttcaattcaatacttacataaagaatcaagattagattttggaaattgtttttgagattttcacaataaacctttaatgtactaagaacatttattttgttggaaatttaatatcagagaaataatacagtgctcaatggttgaccagtgtttgactggaaaaaacaaatatacatgggtcttttaaactaatctaacacctttagagctaaacaatgtaaccacgtatctagggttatgtagagtcacaaagtaaatataatacattttttttctgaagctaattttaattgttaatatggagtaaaagtttaaattgaaaccaagttgatatattatgcagaagaatgcaaataagcataaatctttaagaaaaaaacataagaattcaaagacatttcatttttattgtgaatcttctctatttcatccctggtattattggcatttgagtggaaaagtttgagaagactatgcaattaaatttggagagaaaaagggcctacatgatccgaacttctaagcccctcttcttattgactccatgtcagatttcatagcttgacctgttacaggatctcacattgtctctgtaataggtgtgccggtccttactcttatctgattttcaactgtgagagtatttgcaccctgggtttgagggagaggaggttttccctgagccttacctcttgctgctatttcaatagaagtcatagggtaccttgcttaattttcaaaacagagcttcttttttttttcccccttgaagggaaatactgaattaaatttgaatcaaggtggattataagtttgtgaactttttcagtcattcttttttagaatgcctgtcctctgaaaagtcacttgggtaaaatactgaatgacatcagctatttttttttcctgttcatctgctataaaatgttgtttgttctgggaaatggctatttccaaggcattctgtgacactctttaatggagacaagagcatgaaaaagaaggatgatcttccagcatcgagagaaatcaatgggccatgagagagaagggtgatcttgaggggaaaaaaagcagttttcttctagccttcttccttttggcttcacttcctggcccttttgtcagagactatggcccagttccatgccaagtatttcctcccaagaagaaaagcaattttctaatcagctcttctttctgcctttcttaacttctcttttttaatactttgtctttcctcatggtatctatgatatattcattattattcattacaaatcctactactcctgctttccaaatcctccaagaataccacaccataaattgctctctagttactatcaataaacatatattacagagtgtgtaaatcaaggtctttggttgaatcaagtttgttgctgaatttgattcatctggcgggaatgtatttcttaatacacttaatacatatagttctagcttagaatttatttttaaattgcaaaagaacaacagagttggcagccatcatggcgaattgaactacagggtgacctggaacactactaaaggaaaacagaactggccggatgtggtagctcacacctgtaatgccagcactttgggaggccgaggtaggcagattacgaggtcaagggatcgagaccatcctggccaacatggtgaaaccccatttctactaaaaatacaaaaattagccgggtgtggtggtgtgcacctgtagtcccagctactcgggaggctgaggcaggagaatcgcttgaatccaggaggcggaggttgcagtgtgctgagattgtgccactgcactccagcctggcgactgagcgagactccatctcaaaaacaaaaacaaaaacaaaagcaaaaagaaccagggctgttttctggagaatttctggaggaaatgtcctgttcctatggctgtagttccataaggctggcagtaacctaagaggcacgcggttctgaaaacaggtatgaacttctcgttggtgtcatgagtgcgcaagtgaaagtatggaaaatgactttttgtctttgaccttgtctgattgtgcctttccctgtgatttcctagccactaatttattctatccctttcaagccatgtgcagtatgaatgaatatagagaactaataataattaaatatatggatagcttgaatgaatacagtaaacacatattaatgaatttcaactttttctttctttttctatttctctttcctctcaaacgctaattcttctgtgttgtggccatcttcattatctttctaaaatggagtgtatatgtggcatggaaattgtgagtttgtgtataagcctgattatttaggtatatgtaacagtgtctctctcactaattactttgaacctgaagacccactaatttctctgtgacaaggtttattttttcttcttagacacagaggagaaaggaagtagtgtgctgtacaaaaatatattgaccttaagacacttaagtgccacaatagagttatttgtgtcagagaatagctttgatgatcttgtgtattccctatataagctgatacctttgattcatcatagaggtgcacagtaatctcagagatgtatgaaaataacatcacaaggatatgatatctgcaaattttatctcccaagactactagtgtttgagtctttctcctcttggacttgcttggataatttgtttctttcttttttttttttttttttttttgccttttcccttagcttctctgccttaagtttctaagcagactccatttccagtgctttggaaaaattaacagcatgtgggtggttattgcttaatttaggcatagtttagtgagctgcagtttattatactggacttatggttttcttctctttcttttactctgtctttcctctccatggtacaagaatatgttatttcatctttacgaatcgtttatctgagaatctcagagccaaattgtttagctctttcctttaactcagaaactcttgcctcagaccaataaggagggctgacttcttcatcactaaaagtcattctcaaaggaaattgtagaaccctctttggtatccattttaaaagtcaagtaatcattactgtcagccatttacctggtgatgccacttattagaatcttagcagagatggaaaagcaagagcctatgtatcataatgtattctctgtcaaactataagcaagctataagcattgcacttcagagtttctatcttcataacgcatatttttgcttcttttggtatgttttatatttcttgtaacatatagaacacttcaagtgtaacaatatttatcgtatcaataacagccagattttagtatgatagtgggatgcttcctaaatatataatattaaacacttcttaataaatattaattcagattggtttattttaaaatagttaataagattatacatggaacaaaaggcaaaatagtaaaaattcttcccactcatcgtattcctcaaactccttttcccaaaggcaaccaaatttattagggatttttgtatcttctttcaggggtagcctatgagtatacaacatataattatatccacgttcttctccttttcttctttctgctcctccttctttttgacacaaataccaacaagcttttccacatcttatttttccactaaaaatgtcttagagactattccatgtaagaatatataggtttattttattccgtctaatagccacataacatttcattttaggggggtgctatattttattaaatcagcaccgtacatttaaatttttctcagctttttactactaaaaatgtaagaagtatatacttttgttcattagttaatgcatacatgtataagaagatctattggataaattcctaaaagtagaactgctgagtcaaaagataagtgcattataaatattgatatatattaccaaattgcactccaaagaggttttacaaagttatatttctaccagcaatatatgtgtttgcttctcctcactcttgtaacacacatcatattatcaaactgtattttcattctcttaagatagcttttcaaaatgttgctgtcacatatttatttcccatagatcttttcctcccatcctttaacatcttcaaatatacatagggatcattgtcattcatgactttggtgacaacttatatcagaaatcttttaatagcaatctgctgtagcaacatttcatatgttaatcttgttttgataaacagggatattgtagaaaagtagcaatatgttatagtaattttgtgtaatttatctcctacattattattgatctgtgttgggatctcagcacagacaggcatttagtgcaattacaaagagcaaggaggacactggagccaaatagcctgggttcaacacttgtctatgccacaaatgagctacatgtctttgacaagttgcttcaactcttagtttcctcaattgtaagtttcatatgaaatttagaaagaataaagggaatgggatctagcaccaaattaaaaagtaaacgtgatgtgaacttgaggcattaaattacaaataagtggtttccaaaagagagtatgctttgtctcatcaaaggaagaagcagaggaaacagcaaaagaggaggagaaaaagaacttgttcaaagcacaagccttcataagttatgtcttagtccatttggtgttgctatgatagaatacttggggctaggtaatttataaagataagaggattatttggctcttgattctggtggctgaaagtttcaagagcgggcagttgcatttggcgagggcttcatgctgcttccactcatggaggaagacagaaggggaggtagtatgtgcaaaaagatcacttggtgagagaggaagcaagagagagaaaccaaagaatatagactctttttaacaacccactctaaagggtactgatctattcccatgtacaaagagaagtcactaacccctgcctgagggcattaatctatttatgagggattcaccccgtgactcaaacgcctcccactgagcactgccaccacaaaaaaaaaggaagcaaatttcaacatgagttttggggggaacataccatatccaaaccatagcaagatatatggatataaacaaagttaatagagctgctgaattctaggaaggattgctagacaaaggaataaatttttaatatctgaacatcttaaaataggcaaatacccagccaatgtagaaattttatattgttaaatatcaggttaatagaggcagtatatagactcatataactgtttatcaatcacaatttgaactgctgtattatgttaaattagtgtacatggtttagatatataaagttagtgtacctagtttggaggtatgtatacacacacctgcacacacaaagagtgagagagagaaatatctaatgccagtacagcctaaaatttttacattgatatctgccactgtatgatttttatgacttgaagctaccttggatatagtatatgcttggtaaataattgctaagtaagtgaatggggtaatgaattgtatccattgcgctaccttaatttattatttatacaaaattgttaagaatcaacatgcaaggtacaagcctaaaaattgtaaagtacagtgttttgtcttgttgtcactcagaaaggaagaaaattaaccaaggagtgaatttgtcgtcttaacctaataatctaaaggaatatatattactttctctgtaaaataagagatttctgacaaataaatattttcatgaagtctgattgggccatattttggttgaaagtaaggaaaatttcatgaaggaagatgaacgtgtatctgtaaatattgcatgttgtcattcttccttgttcttcctcattcacttattccatggacatttactgagagtaagcagagttccaagagctgagtgtcattttaggaatttatactgcaaatttccaaggaaaatgtaggaggaattctcatagactgagtaatttctttatcccaccctactcttccctttcacattgcccacctccatttcttgtttttcttgaagaaattggacctcagatgtatgtatctctaaaatccagatgagtctcttatggattttgttcagggctaattcaacattcaattcaacataatgatgtcttttttcacaatgtgtgtgcatttctcatgatggggccctaaatgctggtttacttagggattttcctgatttccttttttgttttgatttgccctccttcatctgaccacttgcttggagcctcgcaagctgtgtttctgctcccctttaaaaggctgatgtttcagggactgtaattttagtaaaaatactatttctgttttccttctacctttccaagatttctttatgtactccaatccattttatgtgtctaattgctatagtcagatatacaaggtgacaaattctgtaagtacagttggtcctccataactgctggttctgcatctgcagattcaactaacaaaaaaattgaaaataattttaaaaaacaataaaaaaccaatataacaatagaaaataatacaaataaaaatacatataacagctatttgcatagcatgtacattgtgttaaatattataagtaatttagagattagagtataggaggatgtacatagtttatatgcacataatataagacaccattttatataaggaacttaagcatctacaaattttggtattcacaagggtcctggaactaatttctcatggacaccaaattaggaccgtattagtttcaggcacagtttatattttgaaaattaggaggtattatggtaaatttaaatggaaactgggcctgagaaatccctgagcagaacaaagccagttaggccgcataaatgaccttaaccttgctggatttgcaaataagagcaaaagttaatttgagctacagctcataaatacctatattcagagaaaacagaatgtaagctcaaccaatcagaagcagccaacaaatttataattatataactagggactttccaataggataggccaaataaggcaacagtgtaactgtaatccatcaaatattttctttgctttactcgcctatttatcctataaaagcctgctatttgcattccctcagtggagctcctgagccacttttgatttagagcttccctgtccaattcatgaatcactgtttgttaataaagtccttaaaatttttattgtgcctcagtttatcttttaaccgtttgacctctatgcggtgtaggatgtacagtgaccatttggtaagctaatattattaacctaaattctttattcttgtttggtaacaagataaatgtattaatggatgtatttccctttcattatgcctaatatatataaattatatgtataaagtacatatatacatatatatatatataaattgcagttgtttttatgcatatcataaaagataatataatttgaattctggagtttccagaataattagccacaaaatgaaagtctgtttactgattcaaagcatctcaggaaacacagtttccaattttgggaagaaaactttacagaccaggagatgttatttctaaaaaaaaaaaaaaaaaaaaatggagtaattttctggctgttctgttgacttactagaatcacatagctttttaactctgagtttatttgaagttagggaaataaaactaagaagactttatacatttccttctcaaaattaagctgtttcagaggaaatctgactatataatatctgttcagaaaatcattgtcatccccaagcctgtgccagccctctgtcagcagcactgtcctcaaagattcctcaagggaccctgtggaaaaatgaaaacaagagaggctatcaaggggtgcaagtaagaggtgcagtgttgagttataataatctaagtgtccttcctaaatggctgaaagtatattgcagtagaaaagtattaaaatgtgtatgtgtcccaaaaaagaggcaaaatgtaatggagatcatgtcctctaaagcaaaatatttggatggttatgaactcaggatcctccaataggcctgctggggcacatttcttttttaatatcaacatattacaaatggggaaaccaaggctcatggacactgagtgcttgacataaaatctcaaggtgatgaatggtaggcatgaacctttataaatttagttttataattcttcatcatatgagtactcttttgtcccctaaatcaagctgtctcttaatgatgacacaggactttgtttttaaaggattaatggggaaaaaagagggggatcactgcaaaggtaacgaattagaatatttttacctaaaccgatgaataggagtggaatgaaatttatttctgaaatccaggagatgacagagaaatgaaattggtgttatccacaagtgcgggcaggataaaatctaaagcaataaacagagggctgctcctctgttccagtataataaaaagtaatatttgaaacacaaaagcgagagagaggaagacctgcttatttcctgtgaggggttttcctgtgataggaggcacttttcttcctttcctccccagaatccgaggagaaggaactgccccactgaccagagtgacaatgcccataggactgaaggggtaagagcaacagaaacggaatgcttgaaaggagcagaaacagtgtatggcagcagcaaatgtgtgtcagatagaaagacaaagggaaagggacacaaagaagtattcacaatggagcaacacacatgtagtgtgttttataatgctggaaaaattctgtacctttcccatctcacagagaaaagagaacacaaaggaagatggataaaaaaaaaaaatgatgcagccactgggccggttatctctggctagagaaggattaccatttccttacaaaaagaaattgataattgaaattaaactcagattgcccaggtatacctgccggcagttggaatgtttaacttaactgctcggtttacttattgacaagcaaactcccttttactaatagaaccaatttacaaaactttccggtcatcataaatagaaaagccagatatggtaacaccgcgatgactagttaagtactcaggtacttatccatgactttgtttatccatcctcctacatatctgatagaaaacacaaggagtaggaatctcatggttaacatttcaaaggcatgaaaattgaatactaagtgaagatacaacttcattctttcccctcttcatatcttcctggaccctttttctcctttgtcacagcaaaataatataggctactaagtctatgcacaaggatatttacaataaacatttgacagtctttgctattgctatatgaagtgcatgcacttgacaggtggctactaattattatagtaaaaacaatagcattgagtgatttctgccattatgggataagaagtttgctggcattatcttatttaatcttcaccacaatcttataaggtaggtgtcattaccctcattttagaaatgagacttgttcatatggaggctgggtgtggtgtctcaggtctgtaatcccagcactttgggaggccgaggtgggtagatcacttgaggtcaggagttcgagaccatcctggccaacatggtgaaaccctgtctctgctaaaaatacaaaaattacccgggcatggctttggacacctgcaatcccagctacttgggaggctgaggcaggagaatcacttgaacctgggaggtggaggttacagtgagccgagatcgtgccactggactccagcctgggtaacagagcaagattctatctcaaaaaacaaaacaaacaaccaacaacaaaaacaaacaaaaaaaaaaaaaagaaaagaaagaaatgagacttagtcatatggaatgttttgcctagcttcagattcagtctactccattccaaagcctctgctcctcaccattgtacatattgcctctgccacttgtatgctgaagtgttaatgcctaaatgaatgaaatctatcactctagaacaagtgctgatggtcccatgaaagaggccacttctaatcactaatacctcctatctctgtaggtagtctttctgaagtcttgaccttccagagtcaagctccctcagctcagctctataggcatattagtgccccatgcttgccataaccagtctcgaaggcattgtctatttcagtgactgaaaggtacttggcatttagagatgcatagaagatgaattaggaattattattcaggaacagagacaactaagaagaggataacattagaatgccataattcaacttatgtttattactgatgaatcactctccacatgactgatgctttgttgaccttctcttggtaatgctggtactctctgtctcttatttccttccattgtactctagtcctctagtcttagccaacaggttgtggctgctgcaatccccgaggctcttctacgctacctctgtgtccatgctttgctgtgtgccctatagactgttcctctgtatctgcctttgcaacagctgtctgctcatccttcataacagctcaaggggttaccacctagatgaaaccttccttctactccaggcaggtctagctttttccacctttaagttctcctggcacttcgcacatctttcagaactcttatcacagttatatgctgtaaacaaagaatcatgggttttataaaattggaaaggagaactttatttctcataaagggttgcagcctgcaggctggccatcccagaggctgggaagcatagcctctggcaaaagctgagagcaagcacattgaggtgatcaggggtaaagggaacaggaatttatgctgagcagggtagctgaatatacatatttaatacactatagaaagagtcatgaatatttacggaggagaaccatgcaaatgtgcaattgagcttcatgcctcttcatgggttacacgttaaaaaaaaaatagctgtgttagcatgatctgagggtggagtttttggccctctgacatcaaaaagtaaaccagaggatatgaaaattgccagtgtatatcccccacaggtcagccaaaactggtccagagatggtggttggtttttaggaagggatgccttgtgaaactgattaactgtcacatcaatactgtaaagagggagagagagtctggttgtggcctcaggtgattggctaaagacaataaagaaatgggtcacctgcttcttttttttttttttttttttttccagagctggtttctgttgctccttaggaaagaatcctggttaaaggtgaataaggaaggggtatactgaggcatgaatatactaaggcatatctaccctccctgcccatcatggctggaaacttagtttttaaggtttctctgggtactccttggccaataggggattctgttcattcagtcaagggacttgagattttatttttagttatctattctttatttgtttccatgagtatcttcagaaccaacctctggactcctcatgatttggggaaatgcactattcatcattgtatcttcaccatctagcacggtgctaatcatatagaaggcattagtgaacacttattgaattaacaattgtaagtttaatgacttgaaactttgagccacaggagaaatctgtagataaacacagatttcttagtaagaggaaaattattccatccttacaaagacagaaatctcagcagatcagatgaaaataccatagattatcataatgagggcacttgcccaactcttgaagggaaatatgtttttagaaacccttattaaatactacaatatcagaaggctaaatttaaattaaaaaaatgtgattccaaaacaatctgagcacaacggggtgaccacagtcaacaatatttcattgtacatttagaaataactaaaaaaaatactaggattgtttgtaacacaaagaaatggtaaatgcttgaggtgaaggatactccatttaccctgatgtgattattacacatcatatgcctgtatcaaaatatttcatatactcaataaatatatacacctactatgtacccataaaaattaaaaatataaaagtaaaaatcggatccatcttttccctaaatagtggttgttcaaagagacatttaaggcacaagtgttgtttgtgcagtattgttttgcacatatcaaattctaggttttatgtcttacccaccctggatagaaatttatatccattccaggaggcggaggttgcagtgagccgagattgcaacactgcactccagcctgcgtgacagagcgagactctgcctcaaaaaaaaaaaaaaaaaaaaagaaaaagaaaaagaaaaatttgcacccattcctgtattctttttataggcttctgtaagcttcaaaaatgatccttaaagagattgaagatgatgactcagagcagaaaaataaaacaaaaacaacatgggtggcagagttgcgtgatagaaagaatggaaccttcaggtccagttaaacctgctctgctattaattagtttttggttttgaggtgatttttccaagccgtcattattagtaataagagctacaatatcattggatgaagaagaaaaatttctgaacagaagcatagctcccaaccatatgttttccataccagcatctatacaggcaccaaaaatcatggatgttcttatagccttgtgcctcacggcgtgaattgctcattgatcatttgaactcgtaacaatggaaacatcagttttaccaggcctcctgggcacttgtctgacctttctgatttgtcaaatggaattgcttcgtttgtaaaatgtttcataggagacaggacaacaatctctgtttgatgaaggtgaatgtacccaagataatttctagggttttaatggaagagttttgtgacagctggtttagcatctcatgtaaaataaattcaaggccttttgtctcactgaaagtaaggtcacattattaagagagaagatcctcctctaccaaagtcacagggattgactattcagttgaaccccagaggggctaatctgtccctgataaagttgagttggatgagtatcatgcattgcatgtgtttgcccatgatgagatatatgcagaagaaacaagaacaataatataggccaatatttaatgaggacttaccttgtaccagataatgttttcaattgtcacatgtattagatcctttaattctcacaaggatgatatggaggatacaggaccatttacattatttgtgtgatctagtgccaaataaaaatgtaagctccttgttctaaaggcagaatgaaagctttttcctttctttctcaattttttagttaacctgtcaaacatagggatactcagggagcaactgtagacccccacaggcactcacgaccccaccccacgattctttgtgtggaggcagaaggttgcagcagttgctagagggaggcagaaaagtgaatgaggaagaatctgcctgggtaggcaagaacattcaagccaaggctccaagtccctggctcatgttccattgtgccattgaacttgaaaaaacatgcacacgcataaattcacagataaaattcttaagcatttcaggacagtgactagaaagcattaagccccaaactcattgggttctaagtgactgcactggttgcatacctttgaatatggttctaaaagtaggtaataatattatctgaattttacagataaagaaactacaattaccagaaacaaagtttttgtgtttgtttgttttggtgatgtgtttgtctaccatataatcacgaaaacatactatgcctattatacaaaatttagcttgttctatattttggtatacttttaatactactgttttaaaattcttaatttctcctgcatgtcttccctcatggctaaagataaatttggtatcctatgaactatgttttccgtcaaggtttgcacaacggcataaaacaatccatcacatttttctggccaatagatacatgctttatttctgaatgtcaacgtttaagagactgaagtctgtgactactgttaattttgctagtaaaaataagttctccctgattttggttattatccattgaagatgttatcttcaatagttatccatgcctatgtcatgatatcttcacttcttcccaaatattatcttcctcagatattcaattgtgaatgaaaagtcaagctccttgtccatttttactgtacctcagccttcaaaggcctaaattaccatttcatttctgttgctgatcatcagcaactagaagacagaatttggatattctcacaccaatgtactattgctgcagaaatcctttgggctaactgagaggaccgaaaaaaaaaaaaaatacaaaagaacattccagaaataattacctattcaccatctttagtacaatgctgtacaaataattaatttttggttcgttattctctattcactttttcctaacatatggacgcatatatatgggtccagtgaatcccattcaaagagaatagatggtgggaaaactattggatgccatcagaatattttaaagaaaaaactgtcctttgaaacaaattctgcagaatattttgaacggaataagagaaaattggtttcaagttaatcagtgaaagtgaaacacttgctgaggccataataactgccattcctaagggctgacaggtcatgccattttccaatgtcttgctgaaaaaaataatttgtgtaggctaccactgagtagccatactggcttgccttgttcctgccttccttctgatttggggcactgcagtgggagctgacatgctgagctactcagctgtctcagcctcatggccaggcctcactcaaaacagtgtccgaggaaaatgacaacatccctttggggaactgagctagacctcatatagtatttgcattcatggaacagcgttttcttgtacttacagaacactttgttctatttaacagcatacatagttgtatctgattttattgccattgcctttgaaggcacacattcattgtgctatggtttggtaatgttcttctattcaaattgatttgtaacaaagaatgggtttacttggactctctgcatctagtgttggttcatgtcgcaattacctgcaggcagcaactgtttattgatgaggattttaccatagttttatgtgattacatgttagtttagctttcccttctaaatcaccacttagtttatagttcaatattatcgatccaagtgctaccagagagcaattctattgatggcatgttacgtgtttggaaggcagtctaactttcaacccacactctcttttggagagaatgttgcttcaactaacaatattgaggctcttgcttaaatattcatctcacacattagagtaattggcattaaataaacttcatatctgaatattttcattaagaactggagagttggtggtccactctaaagtgtccatatagaagttggctaactttttctgtagatggccagatagtaaatatttagatttaaaagccatatagccctgtcacaactactccattgtgctcttgtagcacaaaacagccatagacaatgtctaaacttattggtaaggctgagttccaatacaactttatttactaaaacaagtggtaggacagattttgcccaatggccatagtttgctaatccctgttctaggaccctaagagaggtacatttgtagaaattatgtttggaaagcagactagctacccagaattccaaacaataggcacatggaagtttggaaaactcttcatttaaagcattttttagttctagatgctggtaatgcaatgctgaacaagaccaacatggtttctctccttataagatttgcattaacatttgtgaatgcataaagacttaagtgagttcaagtaatgccaaatgcaataaataaaattaaacagagtaaagtaaatgcctggatgtgggaggaagtataactttagataaaactgccctggaagcttttctgagaaaatgatatttgaattttggacatttgatacttgaatgatgagaaggatctagtcttggaagggtttgggaaagagcattctgtgcagagacattgacaaaggtgaagggcttatggaagatacatacttggtgtgtttgaggaataggaagacaccagtacggttgagaagggaaagggactgttatctctatcttgaactgtccccattaaactgatctataatcagaattttaagtgagttaaattctctttctgatttacaatcatcctttcttttgttcttagtcacttgtggaggcaaattcgcaggttatctgcagcctttcatgtcaaaatgtaaatgtttataaattccaactcaccattattaaactggaagcaagccagtgtttcagttgagggacagttaaatcacactgtttgaaccatatttgaagaaatgatgacaccagtgtattagtggtaagacttgtggggttaaggatccataggtctagtcatttgagctatagagaggatttcaccatagtcaatggtcttcaattgctaaatcgggtaaaatagctcaactattagtttcactatggatgtctagaagcccaaaactcatcagttaattgaatactgtagactgggggaaaaaattattttatccaatcccaaaagaatcaactcaagtttattttacagaaaaatattgcatctagtcctatattgtaattttctgaaggtttttaaaataaaattattttaaatcctttgttgctaatggttgtaaaaacactaatccaaagagaattgccagtatctaaataaaacaccctgagttaatttgactcaaaaaatcaagtcctttgcctcagttaagtagaatgtgagaaaatggttctaacagaatcaagttcagctcagggaagttaattagagtgtcttgccttaaaagacaaggtagttttctaggcaatggtatttgataacaatgtttcacatgaatgcaacaaaattctgtgctctgttaagaattgccgaaagagaggaaaactctgtgagagagtaacctgttacagtttcagatagccagagggggaaatcagtctgaattcataaaatagtatatcatggattttttaaaaaataaaattgcttcgaaatacatacaataactcgcccaagatgtgtatgggtgcgtgtgtgtgttatctccatcccaataaatgctattgggaatatataaggctgacattatcattttagttgattaaaataaaatatctaagttactcgtagcatgcttaaaatatttttataagtaaggtaaataggcttgacaaactggtgatatcttaatttgcttctcatatccatttttatggatatgataaaggtacttgtcagcctagattttgttacaaattctcaatttatgtttgattctgaataaaattttattaaagatgtctaaatgcagcatctctgctaacataggatttccaaaattttaatttgtcaggaaaatgaagagtaagagattacattgtgtaacatagggcatttttttcctgcctcgtcttagcacaagatattacaggggtttttactctttttttaaattttaaatcaggattagtatactcatttttttcttggtgtttcctatttgtaactgatataatgccacaggcctgggagctttaaagaaaattatttaataataaaatagtatttaggagctcttttttttttcattttctgagaagatataatgcattcctttaagcattttgaatctcttctctagttggcagcagcaaatattgtaagggaatatttttgaaatatgaatcttaatcacatcttctgccatatccacaagagtttccattttatatgccacattcaacttcattcatctgacaacaatggaaaaatgttactttagacatcaatggaagttttactgagtatcatcaaatgcttagcaaatatttaaaatatttcacatattcttacgatcagaaattacacattgaagaatacttcttgatttgggaactttaataaaaagaagtgagaaatagatcttggtctgacatggaaggtggagcaagctgatgactttactaagtgacttgctacattcttatagaacaaggtagtgggagtatttttcactaaactatttatgggaccaaggtcacgtaacttactcttgtagcctaagctggtgataaggcttggacttttaatttccaaattatagcatgcaggtattagaaaactgatgacgcaagccacgattctcactgaaaaagaatagaacaatatcacacctgtaaccccagcactttgggaggtggatcacgaggtcaggagttcaagaccagcctggccaagatggtgaaaccccgtctctactaaaaatacaaaaattagccgggcgtggttgtaggcgcctgtaatcccagctacttgggatactgaggcagagaattgcttgaacccaggaggcggacgttgcagtgagccaagattgtgccactacactccagcctgggtgacagagggagactccatgtcaaaaaaaaaaaaaaaaaaaaaaaaaaacaacaacagaacaatagcactttcactcatttgcaattttagcagagttttcatgggtgaatatcaacatctgttgctccatttcctgaaaagtcctgtgggttggaatgccagtgctgtcccaattcactttgtcttttgctttagtaatagcaaaaatcaatgtaattaccatcactattcacagttttttttaataaatagtgggaccctcatttaagtcgataaaattgttctgtctcattctttgcctttgttcaggatcacatatgaaattcttttctgcaagatggttttctacctccattgaccttgaaatgaaaaattctttcaaaataaatattttacaaaattatttctaagtcgaaaaagacttagtgtcttggtgtacaagagtggggtaataccagcatgtttctcagtggggagtggggtaaaagaggaggacaaaaaggttaattaatgcataaaagtgcctagatcaaaggcaggcaccactgtaagcaaaagacatctccttgaatatttcctactaactttcaaaaacgaatggaactcagctgtggtttaaataataataatgcaagagacaaattcaagagctttgtctcttgaatcaaaaatggttgtcaagttttctggttgcatatacttaaacctgccaaaggtaatgatggctacttcaagaagtctgcctaagatgttgatacaatcaacgactctgtttagttgttcttgccaagaaagaaagaaataattccagattccaggtgttactacttagctggatgttttactttataaggaggcagcaattcatgagaaacagctgtaattacacagcattcaggtatttcataattaaactaacagctgattttaaggtggcacatggcatgagattttgcaactaggctaagtaagcatgaaagtgtagcttagttctcttgctgtcggctttggacaaatcctctctgtgccttggtgtacaagagtaggccaataccagcatgtttctcagtggggagtggggtaaaggaggaggacaagagggttaattaatgcataaaagtgcctagatcaaaggcaggcaccattgtaagcaaaagacatctccttgaatatttcctgctaactgtcaaaaacaaatggaactcagctgtggtttaaataataataatgccaaatactggaatcatagaaaactgagtattcttatcggtatccctgtgactcagtgattttggttccttagagaactcatcttgttatgtaggactgaagaggagcttggatgtcagttggataacattgatcctgttgaagctgtaccaggcactgtgtaaaatacaaaagttgtagagtcatctgcaggtctggtatacatggaatttacaatctaagtttcacgcataaaacatctttccggggaagacataagctattgcccttgaagatttgtaacctaggggttggagatagactccatgaggctgaggctcctctattccccatgcttcaggagagttgctcaagttagtcatggctgtgcctttgcttgtctctcccaagttctatttctattgcttggtaagtaaaacagcttattttcagggttctttaacaaattctgtaattagtactctaaagtgttcagtgatcctgactgtgttacttttcactattgcttaagatctcatgtcttttgagtgacctcttccttcaggaacccttagagccttggttttgtgagcccataaatgccaggaagcctccaagatttctagctttgtgaagtttacagaccattcatttccgcagtctcctgttgtcatctctaggggaattgcagtgtgtccatccacccttgaggcatggcaaggtgaacatcccttggactgaagactgaatgcttggttttgttcccatacttaatctgagagattcaaataattctttactttgctgctttcctaagactattttaataagaaaagcatcaaaagaacttggtcaagatggggaatcttgggtcaggaaaatttggagacttacttgaagagaatatttgaaaaagattcaaagattttgaactatcagggtagagggaaattgtttctggtggttaaaatggtaggaagtggctttcaaatctgaaaaaatctaaatgtttttaaggtgttccaggcactgtggttaacaatttatattccttttcttatttagtcctcccaacaaccctgccaaagaggtattattattcccctttgaagtgaggaatcttagtgcattcaaaaacattcatctactatttattgagcacccatatttctaagtgctgataatgtagttgtgaacaagacagcttatattttagaggagacaggtcattagcaactcaacaaataagtagcataattttcctaggaaaatatgttgtgcagaaggtaaggctaggttacaggtcatgccaattgaaggtgggaacacagtaggtgggtttgcaggacagaaagaatgtatgtatggctggtgagtgaacaagggaggggtggtggtgggaaaagatgcaaggatcaggcagggtcttgctggccaaggtaaggagtttgcatcttattctaggagcgacaggaagcttgaggaaacatttataaataaatgagtgatgtgattccgttatgtattgcaaagtttcctccggcagctgagaggttgaataatttgttcaaggtgaggtgggcacaaagaagaaagatggagggggataaatgactcacttggcacctgggtccctctgccttgaaatccctttcctgaatactggtctattttacttgactactagtattaagagattggaaagaaagaatgcaagtaatggtcagagaggcaaaccgacttaaaaagctgaagcaaaaagttgcattattttaggaaaatgaagcaggttcattcgtgctaactcctgggaagctggcctttgagtggctggcttgcgtggcccttgcagtgttacctggcaactaaggtaaccaggtgaggaggctcctttttaaacataccactgagaacaaagcttcgtttttggatactcaggtacaaggaggactgatatgtttgggtctcctgaactgtgttcctgaatttcctctgccttcttgctaataacctgaattgtgcagatactgctgcggctaccagcacacaccagtgttgaaagcagcaagctttggaaggttaaggagcaagttgtgcatgaaacacttgaccctgccctgctaaataaagaaccgacatacagcctacagtgggaagaaaagagagagaggatgctccttgagaatttttttttgtgttgcagactcttcccctccccttcctcctcccaacccacccccagtccatctgtgatgcctgaattctttacaggctgtcttgctaaagacatcctagccttaatcaccttctctgtattgtgtatcactcctgtatctatctacttatgtcagttgtttaccagttcccttcagctgtctgctttttatcatattattgatcagtcagtcttgggcgtcttaggttggaggggagagagagagaaccggcaaagggaagcaggagtagagaatagcggtggcggacaatcagttaagatggttccaaaaatagctcagctctgctgatgacagctctgcttgcagccaccccgtatgggatttacgcacttcactaagattctctgctgaaacggattcgaccagctgctcctgcagttggtggtggctggtggcggcggtggcagcagtgggctggttacatcttcagagaaggaattggaagcgataggtttggggcaaggcaggctcccacacagggacatgagatttattatcagaggctattaggactcaggttgtggggcatctgtgttctttgtacactatgctctgggcacttggcatccagtttctttttgtccctatctcttttgaatgagatgagggagtaagtgatgagaaattgttatatttctcacccactgtgtctattttgttgctattgctctagtttattatatacataggctttttttccctactgcactttctgttgggagactcagctatgtacaggtcccaactttataattctttggtcttatccaagactttcatttgtcaaagaaactctgcaaagtggctgggtctaaaaatgtaatataagtaagtacaacattgatagagggcccctgtccctcaaagactctaagtctatgctatgtagaaaatgcagtgtttcttatctagtaaggtgatcctctcttagaaaaagaaatgatcttgcacaggctctcaggcttttgtaatcaagactccttccagccacaacacctctaattacagggtttttggcatcctgattgtcccccaatgtactatgtgtaggggcactgtgggggtgccctataatttgtcaagcttattatcttgctctggcacacagaatacactgaatcaatttttaaggtctctttcaaaatgtgtctacgtcatctaaaacccataaatattaaaatcatatgcactagaaacagttaagatgtttaaattttccagaacacagagacttaggaaacaggcaagacacaacatgaaagcaaaaaaggaaagagaatgttacttattctattatctgccatgatggggaaaggggagacagaaaaacaactttctccttataaatcccagcttttgctgctgcctttactataaatattgttattcaaaaggttttcacctccttcttgggaggctattcagtgaagtataagatataaagagcaattttattgcctaaatgagaagctggccaaagtgtagtttcctcagctccatgctcagaacatctgattcagtaggttgagttgggactgatatacattttcataagcatgtgcagtaattctgatgtagctcgtctgtggaccacaactcaggaaccctagtcttttaaatgtatatttttttaataacatggtgctctaatttggagccctcagaaagaaaggaaaataaaacagcataacctgtgtcctccatgatagtttagtgggctctagtattagtttatttcatgacatgtaattgttattttcatttaatttgctgcacaattacttttatgtataatccatgttgagatgtgaataggacaatttactttatttaaatactttcagcattggcatacctgaggagataatagactatgagtagggaagacatgggctgatgttctacagtgttccagggtcagccattttcttgctgcaagccggagaagatccacacttccttctattctattgagccttagagtggccacaaggagtatcagttgctccctcctttgaaggctggagtctgtgaaggcagtgttcaagttcacttgttaacccacatcgccacctactgtccaccccccatccttaattaagaaacttttgcctgggagttgggcggagattagtgtgagaggctacagtatgaatgaaaagtgagattgtgaatgcacctctatcgagccctattcagaatgcttgatttgcaatagtttattaagaattacagcattactatccttaaatctaaagtctctctctctttcagtccagaagcaaattacttttgggttagaaatagcagccaagttcctgttaaaatgaaaacaaacctctctccaccttgtgtctaaggccctctttgttggctttaaaatgtttattgatttggggatttaatgttggatccaactgtgaatagtggccactttgggcctggtgagtgatcctggaatttgtcaaacaagtttatggaaggaaacctgaaaatgcttcaccctagtcctttgcctctttatttttgtgggttttttttttttctctttgagaatgttttctatttgagtggagaatgctctcatatggtacttttctctgatccttttggaaagagcaagtgtcctttgagaaatacttgttcttggttgttccctgctccccacccccatgcctgtccctgccacttctagagcaggtggaagtcgcctgtgggttcttctggtctcaggctttgactgttcccctccacaaatttgttcttaattcgattttgtattgaagcacatcagttatttgggcttccatctttagtgaaaagccacctttgcgtgttgttatgccacattacagtgttccagaaaacatattggtgtagatgcaaaatcttgccttcataatttttagccttatgttggattagagagcatattttcaagttgatctcttggaacctcagcatgaatctatattagaagcccagagaatgctaaacagagttttcactgagccatattagataacaaattattttacctataaatgagatattaattatatagattagatttttgttattagattatcagctatggagtgatcaccaaggaggataaaatagaaatagtataatcttctttgcccccctttaactctactatctgtggaatatactgaactttttacaaccaagtctttaatgctctttactttccctagcaaatgttcttccatttaaaaagtctttaaaatacttctttattttagcagtgcttcagaaaatctatcttagaccattctatgcttttaaatctatgataagattaattaagtaggctaacaacctcacttaaaaatattacctcgttcttgtaacattaatttctacagatttttttattgtgtagaagtagatacatagatattcctagtaactatagtataatataaaattaaaatcctatgtgttgaatcattatgttaataatagctgccatttctggagcactgtgtcttccaggcctctggtaaacactgttgcatacattatttgtcttagttctcaaaataatcttgagaggtttgtactattctttccatcttacagatgcagaagttgaggcacatgaagagaattcttaggatcctaaattttcataaatgccttcaggggaatttgacaatcaatctccattaggatcacattctagtagttttggccaaggagagtaaaggaaaagcttgtctttcttgcctagaagtttaaaggtcaaatcctctctctagccatattgcaattctggggacagttcctattgattgggcacttccatctaatatgctgttcaactgagattctttctggccaagagctgtgcaggggtaggtggcctcagagaaggagctgctggaagggagaaaaaggtggctttgtccaaaagagatgaagctcataggcatgctgtgcttcataccctctactagccttgctcatttaggttatttgctgaaaactatgcctgtctcagggagaatagtgggtgctggagatccgttggtgagtggatgctttctcttccctcatatagcttaattgttagtgctagagacagatactaaaataaatgtactggtgcaaagttaacaacttgacttcataagagccataaggggaaattttaaattgtgtgaaaatatatgactagaagagctgctctattctgggatggccatggagcatcacgaaaggctttgctgagcacatttgtgctggacttagaatgatggctaggagttactaggctaagaaagagggatgtgccaaagatctttaaggaacttaacatgaatgtggctgaggaaaagtgagggatgagcttagagagtgtggaaagggtcagataatggaggacacagtcagtcgtgataaggattttgcttttttatcttaaaagcaatggagctcatgtactttcctcttgatctgcccaagtacttcagtcttcttttccccttttatgcttttcatctgtccaagctcttcagctgagctttcctcactgatgacagcactatctggagtgaaggaggtgcagatcctgagatggactgcacaccccttggggctggatggacagactactcttcgagtgagataagggatgcaagtgtaaagggcgagtatgttgcctcactcaatcacatgttcaccaccctctctgccaacctttctgcctcctgctacaccctgcctaagccatgctgaccaaccttgtcactctggcctcactggagcaagaaagtcttagaatgctggagggttccacaagaataaaaagagcccaccacatctgcatgcataaacactacacagctagctcttgcttatttctgagtccagcaaatattatttgagtgtttttacacatcactgatccaataaggaaaacttgtataaagactaatgtttttatgcttcctttatagaacatgaacacatttgaggttttgttacttattctggagcattaatgcaagatccaagaatatcagctttaagatttgtttttctattctcagaataggtttgaaacagagagcaaaatacctacctgtatgccttctttagtgacagttgtttctaaaatatctgtctttcttctgagagaactatttgagtagtgagaattaagtaggaatggacataaagagattatcatgaagatggttttatgatcatcactgtcattgccattgtcaaagaggcatttattaaatgccagatttgattttagcattgttttaagttctgttacctgaagagaattcaaaatcacagtctttgtcctatgggaatttcaatctatcaggcagccttgatttagaaacatttgaagaggacataaaggtaacaagaatgaaaagagattggatcaatatataaaaactgaaagcatttatattacttagaagttaaaagtcaaaacaaatctagaatactgttgggatagtcagaataggttaggctgtgttgtggtaacaagccaaccccatacctcaggagctagcagaatggagtttatttctcacttcatacttcatgctcatcacaggttggcaagagtatgctttgtgtcatcattgttaagggacctagactgagggagcctttactatccagaatgttgctcgtcaccctggaagcaggaaggaaatcaggtgaattctgactggctttgaaaggtttctatccagaagtgacactttactttcacattcgctccattagcccaggcaagccacacggtaatgcatcactcgaagagaattagtaaaacagtaaagaaacacttctgatcaaatttagtaattattctagccacagtaatcagtcaatctaattagatgataatactattagtacttatcagcaacaaaacatgtgctaggtatcaaatgctttgttaagcaattcacacacattactacatttaatctttactgacttatgaggtgggttctatcattatctctattttccacatgatgaaattaaaactgggagtctttaagcaacatgcctcaggccacacagctggtattttgtagagctacaattaaaacccacttactcctaatttaagagtctgagtgttttttcaagattcctatcatgtcacagaagtccactgacttgttttgatcgagctgagaagaacagactagagtcacttctgacctggccacttagaattattaagaagtgtctctgctttgctagaaatctgtctttggctttgttggtatttagaaccagatggatgatgatgatgattattattattattgtaaaccgtcttccacttgttttctatttcctttctttaagggtgttagtgaataattctttctttcacccgggttcctggagctccttaagaattaacttcccaggctctttcatgtttttctggcaccatcttggatgatgagggcttagaacattttgtgactatgcccactgtctggaaaggcttgtaggtgaaggattctttaagaaaactcagatacttttctcaaattcacttatgatgatgttttcccaaatcattttttatcaattctatttttggtttctctcacttatgaattgtttctgtctccttcattttggaacatttttctagttcattgtttttttgttttttcactctccctccagtgtctagcaaaagcctaacacacattacttggatattcatatcttaaaaatgaaagaataaattagtaaagtggtggattcagaattctagttgtttttcagctcctctgccttgattacctctcaccaagattttaacgaagagtgctatgttaacaactgagccacttactttctccattattatataattttaataagtttggtagcatgttttctcacctgtaaaatgagaataatgatagcacccatctttcagggttagaatgaggatttgataatttcatgctgcaaagtacttacgatactgcctgacacacagaaagtactaccataacagcaacaacctctttatcctttgccttgggaatcaaatattttctacagatttcacttttcaggttttctttgtacactgaattgtacctaaaatttcttgtgcctcctataagagttcatcccgaggagattggttgcattattaccatatatttagatatttatttcctttaatctggtcatttattatcaggcaaaattcacccccaatatttcacataggttcttttctattttcccgaagtgttggcaggtctgagaaataaagggaaagagtacaaaagagagaaattttaaagctgggtgtccgggggagacatcacatatcggcaggttccgtgatgcccccaagccacaaaaccagcaagtttttattagtgatttccaaaaggggagggagtgtacgaatagggtgtgggtcacagagatcacatgcttcacaaggtaataagatatcacaaggtaaatggaggcagggcgagatcacaggaccacaggactggggcaaaattaaaattgctaatgaagtttcaggcacgcattgtcattgataacatcttatcaggagacagggtttgagagcagacaaccagtctgactaaaatttattaggtgggaatttcctcatcctaataagcctgggagcaccacaggagattggggcttatttcatcccacagctgtgaccataaaagacagccgcccccaaagtgaccatttcagaggcctaccctcagggatgcattctctttctcagggatgttgcttgctgagaaaaacaattcagagatacttctcccacttgcttttgaaagaagagaaatgtggctctgttttgcctggctcactggcagtcagagtttaaggttatctctcttgttccctgaacattgctgttatcctgttcttttttcaaggtgcccagatttcatattgttcaaacacacatgctctacaaacaatttgtgcagttagtgcaatcatcacagggtcctgaggcgacatacatcctcctcagcttatgaagatgatgggaataagagattaaagtaaagacaagcataggaaatcacaagggtattgattggggaagtgataagcgtccatgaaatcttcacaatttatgttcagagattgcagtaaagacaagtgtaagaaattataaaagtattaatttggggaactaataaatgtccatgaaatcttcacaatccacattcttctgccatggcttcagctggtccctccattcggggtccctgccttcctgcaacaatttatcatctgtttgggttattgtcccagggaatcatattttggtaagacacgtattctttttagcttaaatacttgttattataatacaataggcttaatgactttggctccatgtatagcaatgttttcatttgttgatttgttcttttattcaacacatatttattgagaaaaagaaaaataattacagagactcttagagctagaaagaatcttaaaatcttttaggcgaaattcaccctcacttgtacagacgtaatactaagcatgcaaaaagatcagtggcagaatttgcttcttcagtgtcaaagtagattcaatgagagcagcaaaggaaggaacatttcacttcttttcatcttttccttgggtaattccatttccctcaataaagaagggaggttcttccatgaaattaggagtttctgctcctgtaggtttgctttagtattagttgaaacattttgaatcaaatatgaagaacagtaattcatatataggctgaaggacctagattttaagttgttatggctggccccaagtctgcattgacataaggaatgtctagagtacattctcaggtctgcagccttgcattctgatgtcaagaagcttgaatggtgtcacagaaagggtgtctgaagacatggtgcatctgtttcctgtggcttccaagcaaattaccaccaacctggtggcttacaaaaatacaaactctcttgcagttctggagcctggaggtctaaaatcaaggcactggcaaagttttagtccctccagaggctctcacggtgactccattccttgtctcttccagtttcaggtggtgctcagcactctttggcttgttgctgcttcactccaaactctgcttccatcctcacatggtgtttgctgtgggtctctgcttctctctccgtctaacttataaggatacatgtgattgcatttagaacatgcgtggctaacccaggataagcaccttctctccagatgcttaatttaatcatgccttttgtcatataaggtaatagtcactcttttgccatatgagataacatttatccattctggagattcacaggttctggggattaagacagggactcatcttttccaggggctgccattcaactcactagacctgaatttaagttcttgttctttgactgcctttccatgattgggcaagttactgcatctctccaaaactagggtttctgctctgtaaaatgagaataataacgcctaatttacagggttataataagaaataaaagtggtaaatatatgtatttatatatatgtaaagttacctaacccagttcttagcataattagttgctgtagttccaggcattcaatagatagaacagattttaaactactttaaagactagtgtgaggctggcctatacttagttaagaatttgttaaagtttgatgatttggttgaaaaaatattctggagtgtgatggttaatccctctggagaaccctgactaatatactgagtaactacaaaatgattttatatttagttcaccattatacatagaatagccacaaaatggttttatattcagataaccattatttgttggccatgcctcatttaataatatttcctctgtctgctttccactgcttcataaccactagcacattttgaaacatattactatgtgatgtcaaattctttaaataataatgagttttagtttgagtaacaaaccagtgatgtctgtgatgtcacaggcctgaaaaaaaaactgttgcaatgatcttcattggctaaattaaaatataaagagtagtatagaatttatcatccacattttacagaattattgtttgagtcatttagggtttctattccagtctcttaattgaactgtactttctatatctgcaagtcaaaacactcatcaaaaaatatgacttcaaatatgatagccaacttttgtgttactacatagtgttaattttacagttttttatatgaaataactctctgagttaggagacaagtaaagaaatgttgccaacactcatagatatgaataacaacgtaatttaaggcatgttgcaaaacataaacttttaatatatccctctataaattcttacttttagtattcttaattctcagatattactccttttcatatgattgcatttatattcttgtttaattctctcttttttctacttatatgatttcctccccactgacttctgctcctccttcctgcttatagaaagaatgttgacctcaaatgtctattattttttcattcaatgaactacagtaaagttgatgtgtaggtgacaattagtgtaggcaaaaggtagagtaatgttgctttccaggtatcttccaactctaatattctgtggacttatatacttgagagtattcattctgcgtgtaagatctcacacttctatagctgatacattataatctgcctatgtctctttttatctgatctatagaaaaaatattattttcatatcttcatatgtttttgggttaccttaggctattaaaagaaaaataatgaagatgttaagatatttcaggacagtatgagtatgttggggtgtgtgtgtgtgtgtgtgtgtgtgtgtgtgtatgtgtgtgtataaaagattttactttttactcagccaacgctttagagatcttctgagtttccaagtaaatttatttgcttaagatgtgtctgtttgctttcatacagccattccacatcttccaagaaatgacttcaagaacatctgcttcagtactcataaacatcctatctgctcatcattttcattcttttacaacactcccactttcaaatcacatccaaaatggcaaaaagaacccaaagctaacatgattttagatgtcaattgtgtcctctctgtgaatgttttccatatttgaaatggctgtggaattatcttgcctctacccacagtaattgagaatgacaggaattggaaaagggtcatttcctctgtctcctgggattctgaaagctgtgttttcttttatacctgatcaggtctgccagttgcaaagctatacaatgtagtggagaactgcatacggttaattatgacaattacaatcagttctttacaatctctgctgctgttatgggatttaaataccataatgtatgtcaaaaggacaaaataatgttcctatgttttctgcttacagctgcttttatgattgggttttgctcataaacaggtggttataaagttgcaatccttccatgaattcctttatctttcctgtctcctaacctggcttccctggtgtgtcattgaacacaagtgttgagattcctagcatctctgaggtgatctcagatcctagacagtgtcccttgaatatgctgcaataaaaatgaaaccacttatggtcagcagaagtaggtagatgaatttagttaattctcaaagtctcccttgctacttcagacctctgtggtttgccttcccactgcgtcctgcaccttctctctattttctacctttgcttaatccctactttttcaattttatctcagtgaaacactgtgcctagtttcttctcaccattttggtctccagctcatagcatgttgtgaagactattgcatgcggacttgaatttatgtgctgttgatacttgggtacttgtctctgatgttacaagttaatccatacagtgcacatgtggtccctcactgttgctcaaggcagctggaaaataggtaaggtaatctttttctttcagcacaccttccgtctctgcagctcttacctctacctgaaaggtaggtataaagagaattatggccaatgaaactccatatgagagccctcccctcctccccagagtatatcttgcttaaacaacacatttacggttaatgaccatctggtaaaggtgacagcctttagtcctcctaattcttaactgtctgaaaaaatgtgcccaacctgccacggcttgtgactgaattataaaccatgaagcataataaagtcattaagtttcaacatgtcaaaatggactcaaattgcatcttgcccagaatttgatggcctttccccagcacttaagagagcagggctgtgtactgttcaaaaagcactttgtcatttctcgaagtactcttagctttgtgtggctgtctggacacaagcatcagcatctccaggagaaggaggaaatcgagtgaagtgagagcatggaggggccagtatgccacttcctagggaaaggcaaaggcatttcttctcaggaaaagagcagagaatgatgctgtacctcatttggttattgctcaccctcctgaatatatgattcattttacagtgggaaaattttggataaaagcttgtgctttacaattccgattacccttccccttttatcccccactatcaaaaataatcatattctataaacgtcagtggaaagtggtgagagtgcaactacgttttggagaaccaggtgtcagctctgtcagatttctatgaataggcacatctatatacactttttcaaagaaagaaaggtcactcgccaccctacttgtaaaactgtcagaggatttaggaaagaactaagttaggctgtcttttcacatgggaaaggaaatctggttctcaagatatttggggcattgcagtgaataagggatattaatagaattccacccccggcctctggctaagaacttatctgcctagaatctgaggaggaaaggaatctaagagttacccaaggctcagtctcactgcaataggaggggataacactgaacatggtggggcagatgtgggctttggtatctgttgctagtttatcctcccttcacccaccagcgcagtactgccatttcttctttcccctggaattctctatgtttagtgagcgagtttaagaatggaggatgctcagggatcttcttctcttatatagagactgggataatttgagtgttccatgttctgacacaggtggcatggatgaaggggtgtcactgaagaagctttggcaaaagctgatttacctttccaaaggctctgtgtcaggtgctggataaccgttaaaagaaaggaaagcaagccctctggcggctggcatgcagaaatgcacctgctaagccaatgagccattacaggccgtgccttcagattagagaaggacatgtcaaattagttggagagttttagaatactttatttattccagcttgtacatgaagttatcgatgcatctgctactccaagcatgttcagatgaaataatagaagaaagtctttaaggtattaaggttcatcttctgaaattgttcaacacttcttaaactgcagcaggcccagttgggcactgatagcaacttaagttgtcattactttgtgggattcagatctcgagaatatttatttagtgagagggagccagcaatttgtttctgtaggcaaaaggagattacagaagagagaccccctttgttgctgaattgagtagctgggaggagttgctggaagtgatgaatttaccccaagccatgaaggatgggtaagattagaacagataaaggaaatgaaagtgaacgtttgaaatataggggccacgggagcaggagtgggtttgtttttgaagtcagtagcaagcaagagttgagagtcagtggtaagtaattatgcacagagaaaacttggcaaatagataagaaaaaatcacattaatatttaaagtggtttaatatcaattgaatcacaaggacatcttaggtattcattatgaagctagagacagtatagcctctggacttaaggagtgggtctgtattcaaatcgtagttctgacacttctgagagtcctcaggcaagttagttagcttctctttgaccatttttcccaatctgttcacttgggatgagaagataatgtatctttagactcagatacacaaacattatctaaatccaggatgtagaagttgagtgcaaggaaagtctcagttgtccccaggctgcatatcattcaactggtgagtttccagctgctggtgtgcacaaacagaagctgaaggaccaatggcaggagaattacaaggcaagtttatgaatcagatggatatttggaccagatgacacccaggggccctccaacctagaggtctggtagttctaaaaattccatgatgtcccacaagagctaactgagatgtggggataataatgacataagtttacatcttacgctaaaaatgttgtttaaatttagttcaaaatgttctgttctatgtgaaaaaaatactatcattttatttaatgcaacctatcactgaaatgactatctcaagctgtttctctctatctcgtggagggaaggagtggaattgggggtagggtgcagggtggaaagaaaggagaggtaatactgttacccagagccaacatgttgctcttcaaaggggcttcagaaaatagaacaaagattccagcctgaatgagaaaggaggtggagagtttgaggaacacaaagctttaagtggaatttaccccatctaattatttgcgaaggaaagggtggaaagaaatgttgacagcaaagatttcatggagaacaggaacaataagaccctgtgccagagcactgtattctttgatgtaccacatatggagaagggatatagaacttgagttcagcaaggtttaaaaggcaaaatgtaatcacttccctttaattaactcaaacaatgcacggcaggttatgttaatgtgcctgtagctgagatagaggcagtaggctgccactaatacctgagagagagacagagagagagagaggaagagggagagaaagagaaagagaaagagagaggctcctgtaatgccagagcaggaagggcctagaaaccttatagactaattttacagatgcgagaacaagcctagcaaaattacagaactcacccaaggttatatggtctctcagtgacaaagtgaccataatacctcaggcctttaccaagttagtattctctctaagacactgcatgacggagtccatagtgatttcaagttagcccaggggttaaaactaaccatagtacatttgaatacggattaacatttggtgtgtcctttgaacaaaaggttaaatagaaaggtaaaatgtagaaaggtatctacacgtattcacttcagtcaagctttacttttaaagttgctttagaatattcttattaaaaccagtggtgattttcatgcagctgttttaattaaaatgttgtatgttttttataaacaaagtgatgaaaatttctggttatagccttgtagaagactgagcagggaaaccatcagaattgcaagtggagcaaaaatgttataatttagatcatgtgaccgaaataccaccaccgctgggtagaatctgcttaaactgcagctttggatttttcaggggtaaacaaacctcttatgaaaaagaaagccatgcattaaaattataaaggcacatgaaatattacaggaaagaatgagaggaagtaaagaaaactaacattcttctgttttactgctttcagggaagagttttatgaacagtttccaaaagtgttcttaagcggttgtaggttttattttgctttacaatttgacagtattttaagattctgtatttattctctttttgagctgaattatgcaggactaaacagatatcttttgtaaaaccttttatttccctgacagttaggagaaatatgaagtaggaaattctttggtaattgttggaggttggtatagtgcagtagataatgtccctttactgaatttattatcaaaatacacaagtcagagggaaggagatcaaaatatagcttctatttggtgatatactggtaaatgtttaattttcttccttttagaagagaggagactgatttatagtgttgacatatttttacggtataaatactccctccctggtgaaattcaagatgccaatgggatgtcactgaacttgaaattgggcagaggttcatatatttggctcttgcaagccagtgcaaacagtcttgggacagcactgcctgagtgcatcactcgtaaaggctgtgttagagagtgtggcctagatctcatagattagcagacttgttttaatacatcacttcagaatcagtcaaccttcaaccacaggtcttttcttctttggatgcctgtaccggtaaaactttcagcaagaaggagcaaagcaaaaagtgtgcttaccacaggcaggctggcagccaggagagttagtcgtctcccagactctaccaatctgatgaattcacaatctgaatcaagctggggaggccaggcatgtcactcagatggaaggaaacaacgaaagtgagaaataaatgttaactcttagcagcatcagaattcagaatgattcttagaaaaatgttacagggtttgtgtcaacaagaaggtcagaggcagaactgtattttaaatatccaacattttggcatatagctattctagcaaaagcatctttgaggctgtcatgtggcaagaattgtggttatcagaaaaaaaaataggagtttttaggttacacttaaaatataaagaccttaatagacctttattttatagaaagatatggaagaataaatttatattcagttccttcaaattaaattattttttcaactgggtgtaactgaaataaatagggcagccatagtaattttacttaagcaacttcattgcctcagagagcagatgatgaactattttagtgaatatatgaaatgatatctggcaagagaaaaatacttgatcatctcacttccttctagttgatgttcaagagtccctgcatccagatttacagctctttgcttacacatccatcattgttaatatgccaataccctgacgaagcaagcctggtattggctgcatgagtcagtttttcctggtagagagtggtttattattcttgttgctgctgttgtagtattaacatctgacaatttgataattaacaatgattataaattagcttattactataatgacatgagtctaagtggacatttgatatagcttatttttgagtgtaaaaattctggttctaagtcaggtgtctggaagtgttttgttattatcaccgtgctagaagataaaatctgagttctgaatcaacctactttcttattctgttgcctgtgacattgaatctcatgttcatatgttcatgtgttttatgttcatatgtttttacatttgcttccctttgttagaatttctggttaggtgtgacccaaaactcttaagtcaggtggaggagcattttaggactggctctgccatttaacttaaataataagttattaagttattataacttaaataataagttaatgaatctttccaaatctgagctttctcatatataaaataagaatgctaatgcatctacctcctaggcaccagtaaagattaagtggaatcatgtatatagtgtgtaacacattttgtgtgtgtgtggttagtttctttttttttttttgagtttgttttaatttttagctttctcaaataagagaacatgtgaagtttgtctttctgtgcctggcttatttcacttaacataatgacccccagttccatccatattgatgcaaatgacagaatctcattcatttttatggctgaatagtactccattgtatacatgtatcatacggttttttttactattatactttaagttttagggtacacatgcacaacgtgcaggtttgttacatatgtatacatgtgccatgttggtgtgctgcacccattaactcatcatttacatgaggtatatctcctaatgctatccctcacctcttcccctaccccacaacaggccccggtgtgtgatgttccccttcctctgtccaagagttctcattgttcaattcctacctatgagtgagaacatgcggtgtttggttttttgtccttgtgatagtttactgagaatgatatcatacattctttattcattcatctgttgatggacacatagtttgcaggggtacatgtgcaggtttgttgcatagctaaatatgtgttatgggagtttgttgtcagattatttcatcacccaggtattaagcctagtacccattagttatacagtaatttcttaatacatattataacatttgttaattgtataagttaaaaattttattactataatatttgttaattttataaattttgtatgataaaatacgtgtattacattcaatgcatggctacaattagtccacgtttaaggactgactcactttctagaatttggcaatactatgtctctcaaagttttcctaatgaaataagctatttatctttccaacccacagctcttcaggttcacatctatttctttgctttctcactgccctgacttctacccttccctttttgtctccctagtacccaaagtcctcttccccactgcacctgccattcttctccaggtgaaagtctgatttaggaaaagtgtatgagaaactctcataataaagagtgcatttgtattcttaaagcattacagcagagctaaagcctaagagtataatttcaatattcaggctgtgggtaagagaggtatttgctcagccgtagattccttttgatgcctctgaaatcactgtcatatctgtaactatctattgtacagtccatatggcaacctttaattatacctgttggaataatccacttagccaaagtcaagcatcctctgattacgtgttctcttgttatttcctagttgtcatatatccttggcagctgtcatcagccgaatttggtgtttctaatttttagtagctgtcatcctgtcccaagtttctgtaacacatgcttcggccttgccaaacatgatttgctttaacagttagtcataattttttgggccttaccttggcgggctagtggtcacattttactgtaggtgatctttacaagtgacttcagctccctcttctagctttacctttttttttaattgcacaaaattctatgtagcatgtcaatcgataggcaaaaaaagatctgttagcctccattacccaagagtgggccatatttcagtggtaggtaaatttggtccaatagttatgtttgaaatgccaacaatgaataaattaaattaaaatttattgagcacctacagtgttatagttatttgcttgctaatttgattttaagtgtgtgtataagtatatgcatgtgtgtgagtgtgtataatagaggctattcttttcaaggtcatacagctactaagtggaaaagctatgaattaaatgaaaagtttcctggctaagaagtccttgctttgtcctcaaaataggtttttgctaagcctacattagttagaatgggaaatatatatagagatatatgggctgggcacggtggctcacacctgtaatcccagcaatttgggaggccaaggtgggtggatcacgaggtcaagaaatcgagaccatccagggaatattgtcactgaggtggagtaaattaagcgtatataaaaatacaggttgagtaaggttatgatagctactgagtaaggttatgatagctggccaacatggtgaaaccccgtctctactaaaaatacaaaaattagctgagtgtggtggcacacacctgtagtcccagctactcgggaggctggggcaggagaatcacttgaacctgggaggccgaggttgcagtgatccgagatcacgctgctgcactccagcttggggacagagcgagactgcatctcaaaaaaaaaaaaacatacaaaaaaggtatatatgactatagccctttttcttcataaggtttatagtcttcaacgatagagtgacttttatgtttttctaccagaagattcgaagttttgtagagacaaatgtttatgacattattactttggtaaagttcagtaaagcaaacaaacaagatgaaaacctgcctgctgagggttggttaatctcttctgaaaaaggtacactttggtataatgattcataaaaagcatgtggacactttacagctttacatttagaataaaacctgtaatcccaatgcctgttctatgtgttatacctgtgttttcctgaattatatgtctgtgtacctcctctttatacagtgtttcatctaaaagggtggcatttactgctagaatttgagatcatgaaaaggaatgattttagcacaaaaaaaactaaacctgttttctatcaaattctaagaacccagaggcaatgaatgctactgtcaaaaataatttgaagaaagtgtatctgacagtatttttcaaatttagctacaattttggttttactttggggtattgctccagtggagattcgttcatgattgtataccttcctagaatatacagatttttcttattaggcattctaaggagagcttgttactgacattctgcagaactttacagtcatagtatttcatctgtaatattatcttatagaatataaagattttcctgtaaaaatggaagtgtccccaagcctgtgtttctagtcatgtttcaatcactaagtagctttctgacctggtcaagccactttaccatctttctgggtcttctttcctcattggtaccaagaaagggtcagagtatttgaaccttaatgtctcttcttagttccaccatgttgctatgcacaaccctcatccactgcttatgactgctgtgtaaaacactccaacctcagtatgcctacaggcattccacaggaggtctatgaagcttttcacagttgcaaagtcatttttcccctttggaaactggacttcaataccattttggttcaacatgtgttttcttacactgataacaagaatgggggctcctaaaagcatagatgttctttatgacatcaacctcgaaaatgtaaaggatatattcaaaatataactcctctaaagtaagtaaccatttatccaaaaatttagagggtatattcaaaatataactccccaaaaataagtaaccatttataaagtaactaatgtaaatacttctggattctaaaatgtatattgggttcttgggaacttgaaatagcaattattttataaatcctttgtaatagtcaatagcaaagtaagatcattgatgtgtgtttactccttgttgtctcttcttatacgtttttccagaggatgaagttcagtacagtaataaagtaaaattaaaaaaaagctaatgtatttgtagacttctaaagtcttcaaatatttattctgccctgttgagtgtcttatggataggtaatattatctttaaaggtgatgctcaactttcatgctgttttatttgtttttttcttgagacagagtctcagtcattctgttgcccaggccggagtgcaatggtgtgatcttggctttctgcaacctctgcctcccaggttcaagtgattctcctgccttggcctcccgagtagctgggattacaggcgtgtgtcacaatgccaagctaatttttgtatttttgtagaaacatggtttcaccatgttggccaggctggcctcaaactcctcacctcaagtaatctgcctgcctcagcctcccaaagtgctgggattacaggcacgagacaccacacctggcctgtgctgtactatttatttttttatcccatggttacatatgttatgcaatgaaaatgttttcatgctacacatcaagtataaaactcttcaggccagactcctatacagattaagatggcatatatgaattgttttttttttctttctcccaaaggcataggttaggcatatttactgtctttgccaggccttttctcactttttaagacatccgaatgtgtagatttccttccttttcaacatttacattggaagatgaacatatttagaatgagccaaaagaaaaaatgctgcataaagcagtgttgaaggaagttattctggcagtcttagggttgaaattcgcaatccattacaagcatggaagctgtagagccttggatgaggctctacaaggattgggatttgtagaaatttgatgcgtccaaactctgtaattaccttaaagaaatccaagctttctgcaattaaaaatgtgtaattaaaaagtcatccagtgtgtgtgtgtttgtgtgtgcgtgtaatttatatccataaatatgcatctactatgtgaaacatctcttaagggatatgaatgtatgctgaaataattcagctagtgtaaagagggaaggaaaaaataatttatattactgggggaaggcagtcagatgaatataaatggggaagcaccatccccagcagagataataggttgagaaggagctataaatagggaaaatctgggtgtgtatggaaaaagtgacttcaacatatgattaattagaggtggtggggaaaacaatcaaagaaatatcaatgtgtagtaagtaaaaaatgtggaagggtggtgggtagaggagcaaagtatagtggaggttactgaatgcacagaaaaataattaaactcttaggttatacccttatccaagattctgaattagtttcttctactcagcttttccggggatggttagggcttctacagataggaagtagaatgctgtgaaaagaaggtacacttacgaaggaaagtttctgaaaataaaccagaaaactaatttgctaggggagttccctagtggcagagagtttacaccatgtgttgccctttctctctgcacttccaggaattccatctgcagaaggtgagtgacaggccggtggtgctggtaaagtctgtgctgaggcagtaggagagctgatgtcaatgacaaggcaacccttgactgcagccctgacacctgtctggggaatttagactttagtgacaatccttgacctgccatgcaaatctggagctataccattgaattattgcccgtgattgggtgtggaaatggagagctttgtgggccaggaagcaggcagtttgtaatgtgtggatttttagcccggcaagctagatgttctaccttcactagagtaattttaattcattctcttctgaagaaagaggtaaagatgaaggttgtctagggaggaggaatctcaatatttttcttcattaggacagttataatgttgagaccaaaaagatgtaagtaaaggtaattaacaaagggcaatctacttcctttggagcttataaattcctcaactacttagaaatgctactctgtctcaccctgacatttgatctttgtacttcagataggatttgacgtacgtttaagttctcagtggactcaggtttccggaggacttttttgttaactgctgattgaacctttattctgctccacatgattcctttgccagcttgtttgaagtgtttgttcctggtggaaccacaacaaatatgtgagctcattttctttctattaggtaaggtctttagagtttgggatttcaagtattcagtgtttcatgccttcagtgttcttttagaaatctgtatgtattcctacatttttcacaggcagtaatccagagaatctgatatggtttggctgtatcccccacccaaatctcacctcaaattgtaatccctgttatccctatgtgtcaagggcaggaccaggtggaggtaattaaatcacaggggggcggtttcccccatgctgttctcatcatagtgagttctcacaaaatctgatggttttataagtgtctggcatttcccctgtttgcaatcactttattctgccaccccatgaataaggtgcctgcttctcttttgccttccaccatgattgtaagtttcctgaggcctccccagccttgaggaactatgagtcaattaaacctctctcctttgtaaattacccagtcttgggtactccttcatagcggtgtgagaatggaccaacactggatcaaatctggcttatgtaaatctggaataaagagtaataaaaccaaccagatgctaataatatgacgccacctcttttctcccatccaagatgtgattctctagattttccagtctgatgatgttgtggagctcgcagttgacctgtatcttcttgatataagttccatgtggttgagcttggcgtttataacagaacagcaaaaaatgggatccctttcatcagaattcccctctttgcccccacactttgtagcaattccctgtttgccactttcaactctttgttgatctaattattggtatgtctacccaagaaaatcttaagcttatttggggactgtggtcttgttatatatatcatctcccgagatactagaatagcttaagtacccaattattattcagtaagtgcctgtttactgttggactttcttgaaaattcatatagaataccttcattttcttcacactttggtctgtaaacagtgtggaagtagtgaagaagacacaaagtcactttagacatgtttattactctcacttttatcctctcccctccatcagtgaagactcctacttgccatctttcctctaaagatccttagtccctgagaagcaagagctactgaagattatatcctaataagtttctaaaactcaaaagttttggtaggaaagaacatgtaggcttaattcctttctctttgacagtttggcccaattggatgctcaggtgtaatatgctattattagccctgagatgaaaatttcagggccaaaattattagtaaaacacttaacatttattaaatttttacagagtatttaatgtgtaaatatttactgcactgggtaccttatatgcattgttacatttaattctcattataatgatttattagctattacataggtatttttactatcatccttatctatacggagagtgaggcttgatgggatcaagtaatttgccagtgtctactagctcttagatagtaaattcagcattcaagttcatgcttaaattctaccctctatgccctccatcttatataaaccttaactccaggaaaaacttacctgtcttgtactaactgtcatatatttggtaggagaggcaaggagacatttttctaatcacattctttcagtatgtgttgggataaatttcaggggttggaatttccatcaagtgcacatgtacacctcttagaattgtcactttaggttatgacaactaggatgcattttttaaataaaagaagtgtattttgtatatgtattatatactgtattcttacaataaagtgagctaaagaaaagaaaatgttattaagaaaatattaggaaatattaagaaaatgttattaagaaagagaaaatatatttactattattacctgaaagtggatcatcataaaggtcttcatcatcattgtcttcatgttgagcaggttgaggaggaggaagagagaagttagtcttgctgtctcaggcatggcagaggtggaagatatggaggaggtggaaggagaggcgaaggaggcagtatattcagtgtgagctttattgaaaaaaatacacatatgagtggacctacacagctcaaatgcatgttattcaggggtcgactgtaccttgataataacatcactgccattaccgtattctgagttggtggtataaatggcatttttctaggtgatcgttatatatgtgtatcatgtatattaccaggtatagtcctgtaatagttccacctttctgcataaaagtcttcacaaagctaaactgagagttatagtaactgtaattatggaaggtaatcacaacaggaaatatgttatatgaaatacaacttttacaagttgttttacagtttgtgttatatgaaataacaattataggctttgttattctgaacattaatttgcattagccaaacaggagattcattttaggaatatttgtatctgtctactctttctattatctatatataccaataaacattgacaaacatttaagcattagaatttttgtctcaattgaatgaagctttcaaagatgctttttcttttttcttggaatcctgttgaatttccttgaaaaataaataagagttcacaccttctcagagtttcctctgaggtgttttgatactgttaacatgagcatcaaagtaataccaactcttaaaacacacataattacttaactatcagtgtatttctaagaaccctgtcatatgcacccttcttattttatgctcatgttgtaaatagacatacatgatgctgtgctgtcatagagaaaccatccatgttcactgcttaaagaagtgagtgtgagtttgagtgtgagtctgtgatgtatgtttagtctgtaataacaattctattaattcaatactgttttaaacatgcactcacatcctgtcatcagtaaaaccaagtgtcagttatccacacaattaatcaagttctcactcaggctttctagtaattcaactagtttcccatttccttatttcttctaggtgacatagttgcttctccatctgtaaagccagtataggatattttaattatttagttagcaatgtttttattaggcactcttttaggcactgacgatattaaagtgaacaagacagataagtccctgtttccatgtgaactagagtttacattccagttgtactagtaaacaactaaaacctctacataaggcagtttaatattgaagaatgtcctgaggaatatgaatcagaacaatgtggtagtggtgtggtatacacatactatttacttagggagacctttctagttggtgacttgaacttacacatgaatgagaagtagctagtcacaagaatatctataacaagattgttataaatagcaaagatagatagatagatagatagataaatagatagatagatggaaaaagccctaaagtatgaatgagcttggcagatttgaaaaatagattgactagtagagagtggatatttgcgaagatttattactaatgatagatctttaaatatccacatagctttaagggagcagtaaatttagcttaaggttagtaaaatgttcagtaccagcaggatatccctataagattttttaggattacagaacttggataaatggtaaattggatcaacatcatgccaattaaatttgttgtatggtctgttttattaaatctctaattcgtatttatataatgtataattataacttgctgcttatacagaatggttacccgtttagtattttatctgttcaacaaccatttactaatgtcctatcatatgcaagatagagtactaggggctgagtatacaaaaataaataagaccactctgtcatgaaaacatgtacaaaaaagtagataacacaggatttaaatatatttagtgggaaatatgttttctcagtttaaacatataaaaattataaagtggaatttcagatgagagtggcattgatagatataagtaggcatagctgatgcagagaatgttaaaatataattttgcaggtctgaaaaaccatttgacatttccttgtaattctggattaatgcttatatgattatctctgccacagtggaaaagtttataaatttaaattaatggaaattgctgttgatgaaaccctctagaggataatacatttctgatatgcctatagggctccgtatttaagctaaactcctgcccaagatgcaggatgatgaagtcctttatttcggccatcagacctattaaaaccacgagtatccctgtgagtccacaagtcaggctacaatacaacatcctcaatctgacaagaaaatcaactgatttactgaatttatatgaaccaattcttatatgcatgacagccaaaaaagttccaaaaagaaaacaaattttgcattagtatgagattttgaggttaggagcctacgtttagaggtttatcagttcagcccccgtatggagctatccagggtgctgaacgtgctctgcaactcagtccccttagtctctgggcttgacctattttttccattgttgtttcttatcttcaccttttattccctacccatactgcctgctctgattgctctttgtatgatctcatcaatcatatgtgacagatttttgtcccgacccttgctatgccctacattctaacctagtacattcttcaacccatgtttagccaaatttcaattaaaatttatacctacagccttcccaacaagtgccttgactctcaattttgtttcttgaagcaatgagatcattgatttgatctctaattataaagtaattaaaaacaattttatttcagtccacaaatacataaatattctaaaaaggagcctttaattcatttaataatccataaaaataaactgaaaaatcaagcgtggacttctttgtcactttcctctttttcattgtgaccttctctctcctcccacttctccttcctcctcatcatcattataaattcaatgagtcagaatggtttaattgaaattcttcatttaaaaagtaggatcttggtaaaatgtaggttcaaagacaattttacaatagtttaaccttagtagatgaaaaatagtaaaagtataaacaactcctgtgaacatattgtctttgaaattggtaaaataaataaaattgagatcacttcttactgtacatctccagcttattttaggatgtatctcttcctttctgactggaagactcaaaatacatttagagagttggagctggtgttgacagtcaatgattagggcaaaagttttgcatgtacttcacctctgtatttctccctaatttcatccattgtaatttaagaagaaggacatgcctgaattgaaaagttcaacaagtgaacttttgaataaacagtgtagatttttatcttaggtccaccaatccctaaccatgtaatcttgggtaaatctttaactctatggatctatattttttaaatttgcaaattgagaataataaaacatcctcacactgaagattcctgccagaattatatgagataatgcatatccaaagtttagggcagaaactgaaacctagccaacattttaaaaatgtgaattattgtcattaacttatcctttcggtgcttcacctctccatacattttaagatactctggtcattatgagtacttgccacaagtatataggagataaaagatttattttcccacccattattaggttcatagctgaggtatcctgtaataagagacagattaacaggaaaaaaagcatacaaattaatataatttttatgtgacattggagcctttgaagggaagacccaaagaaacagggaatcctgtgtattttagactttggtttcataaagagtggacagtcttggggaagtatggctggacaaaagtgggcatggcctgatggtaataagctgggggaaacttagcaaggcctattgttcagattcttcctggtgtctctgtgtgttcagctgctttcctctagttctagagagaatacctctgaatgaaggtctttatgatttgctttagatgaaagtcagaggattattttatggtctgcttcaggggagaagagtgagagaaagtcaaagagatctttctgcttctgctgctttctcaaatgccaagttgctgtattttggggtagtatgtcctgaaccccatcaggtacttgacatttcatgaaggtaagctgatcaatctttcatccatggcactcattaatgtctcaatttgaaatgttgtgagctatgaaaaaaagacaaggaaggtagtgcttatctactcatgaacaaccattattaactcactattaatcattgattacaattgatctattggccatggtattgttgtgaactttgaaatatattgtattaacatttctatgaaaatggtggttgaaattctgcaggcagataatgcagtgttaacataataagtaaaataattaatgatagtgaagttgtaaaagtaagaaggttcaatgtgcttgaaagtcacagaattttgaaaaatgcaagagataaggaaaactgatgaacaaaatgtgacaacttgagactggctatgcatactgaaatgaaccagtgacttttaaactagaattcttagagtgtacagcctacagaaatgtaaatatggctaatacaggtaactttctaatttaaatacctatcaaagcttctgttggaagaaaactagatttatacattgtgacatgctcaaaatccttgtcttctccaacaccatctccagtaaaatactcctagcataaaatttattaaagtgaatatctctgaaattaggttcttttggaattaaacaaaagagaccatggttttccaggcattgttgtagatgtcactttataataagacagataaggcagtcagtatacagaggtttggttttatggccagaactaacatttattcaatcaatgagagagatcaattagagcagcattacttctacagtgggaaaatttcagagcccctgaaatagaacattattgttaaattatcaaatatgttacagttgttgctagtataatgaccctttctctttatcagaatcagggaagaaaaaagccaaatggtgactaatttatcaccaggttcataactaagttaccaaaagactgaaactaatcaggtctgattttcaaaataagcaataacatttaaagcatatttgaatatacagatgtttggatcactgatatcctaagaattctatagtctctgctgattttaaagtcgagattagattgttcttgtatacccagagaagcatagctctaaagggaaggtgttctggggaaagaaaagaaaaaaatgacgttttcatcatcacactgaaaaagtgccaacaaatcctaagtaattttgtgttgattatactaaattagaatagtgatggctataatcatttgatccctgaggcattaatgaaaaatcagcattattttgtgtggaatatgtattattatccttgagcttaggaatgattattagtaagtctgattaaatctggaagcagtgacacaagctatctttaacccaccaatgacagggctatattgtaaatttatgatgaatgaacacagtttagcatttttagcacttgttggggaaaataagaagtctgcattcattttcttgattagactgcaaagtagtacagagaagctcataaaaaattcttcataatgaaatagtgttcctactgatagattaacctatcatagcttccaaaattcacaggactggttatccttgtatgatcaaagatattattcagcaacattctggagatcatgaattcctagatacagaagtataaacaataaaaatactaccatgttgcatgcatgtattaccttcatctttttttttttttttttttttgagatggagtcttgctttgttgcccaggctggagtacagtggcacggtctcggctcgttgtaacctccgcctcccaggttcaagcgattctcctgcttcagcctcccaagcagctgagactacaggcacacaccaccatgcccggctaattttttgtatttttagtagagatggggtttcaccatgttggccaggatggtctcgatctcttgaccttgtgatccacctgcctcagcctctcaaagtcctgggattacaggcgtgggccaccgcacctggcagtattacccttatatttttaaatgctttcacatttactttatggtattcttatcatagtaacttaagtgagttagactttttaccacctgctctatcagtaagaaaactgtagcacaatccagtggaggtatttgctaaaatcacacaggttgtcagaaataccagtattggaaccccagggtcttggtttcaagtctaatatattttctgggcctcagtttagccattaattttataattacagacaatgtttttgctaacatcttgaattctttctttttaaaaagatgtctattctgtattcatagaaaatattagagattcttactgatcaaatggatcacagcaattgtttaattttaattttcagtgctaggtaatggagctcagaacacactgactcaaaatttggcatttgaggaatcagcagaaggaggccgtagaaacttgaaaggaatctacttgccccttcttccctgaagcagtcatgaaagctaactgaattttcccagaaaataggtcataagactattatatcagaggcgttcttcctgtacctggaggaaaagaatgtccttatctctgaaaacatagggacactgaaaagaatctgaacaagtaggccttgccgtgttacccccagtttattaacattagattgtactcttttgtcctccaattatacttccatgcacgactgtccactctttatcaaacctaagcataaaaatacccagatttccctgtgtcttcgggccttcatttctgaaggctcctgtgtataagttttatataaataaatatatgcttctttatgaatgaatataaattttacttaatataaatttatgtaaatttaatatttttataattataaaattacaaaaatgattgtaattttaaatcatatataaatttattataaatttatatataaattttaatataaaatatacttaattttacttaatataaatttacttaatataaattattaagtaaatttgttttctcttataaatctgtctttattacaggagccttatccaggaaccttgtgatgtatgagtaatctttctcccctgtataggcaaaattgtttctaaaatccccatataatttagggcaagttctgatccttgcatagtagcatctgacactcagtagtaacttgattaaatattagttccttttttcctaattcccaccccaaatgctgtgaccctctctgcactcaaaagacaaaatctttaaaattcttagttgatctgaaatttgtgttgatggcctacattattttattgttaaaactatgattacaggtgactagtcagtaacaaaacataaaaattgtgaaagtacagccaaaccctgttttaaatgctagatggagttagtgttttgtttccatcaaagccacaatatttctacttgaaacataggccagggcagtggctcacgtctgtaatctcagcactttgggaggccgaggtgggtggatcacctgaggtcaggagtttgagaccagcctgaccaacatggagaaaccccatctctactaaaaatacaaaaaattagccaggcatgttggtgcatgcctgtaatcccagctactcaggagcctaaggcaggagaatcacttgaacctgggaggaggaggttgtggtgagccgagattgcaccattgcactccagccagggcaaaaaaagcgaaactccatctcaaaaaaataaaataaaataaaataaaataaaaaagaaacatagctttgcaactgaatggcatcccattcacttagcatcataatggaattctgttgaatagcttaaatttagggcaatcagagccaaagactcagttacggagtaactgtaggtcccgcttggcatgtgacagattagattccttggagaagttaaatccagaaatgagtcattttaataaagcaaaacacataatataaagggtatggataagaagctatgaaaatgcctaggatagacaaaaagaaagatatcctgggatagggaaagggacatttgaacatcaaattaagcaaagccatgaagtttggaatttttcttggcattttcttcccgtaccctgcaaatattaaatcaattgtcaatcaattgtcaattttacctttaaccatttctcttcttcatgtctttctccacacgatcactgatctagggtgagctcttactatctttacttataataggctagtttattcgctatttctatttccaggcatatcactctcaaaaccatcatccagattatttaaaaccttaaatctaatcacatctcccacttgcttgaaaccattcaaagtcttctagttgcctacaagataagatctaaacttatgtttctctgtggtctggcttctccttacctgtgccacctcctctcatgatgagccattctgtgatggtgcttcagcctgtaaaattgtttgtggtttcaaaaatattgcacttcatttcatgcctccataccttttcctcttcttgtaatgccttttcatattcatctccaacagggtaagttctgcacataattcagtgtcccttttccagtttgatgttgcagctcttccttcatctcaaatatccactggattaggtacatctgtgtgtacttcatcttatccatcctgttaaagaaaaaattatagaaggacaattgttaaagcatggtagggaaagttttatttaggaccatcatgataaatatatgggccactgcaatggaattgtttgcagtgtaggagagagaatgggctcaactctgtatatagcatgaacaagtgagaatttttaaccaaggaacagagtagaggtcagcagacagacaatgactaagaggtaacatcaggagtaatgggaattctggctaaactgacctaacagaattcttgctgaagacaaaccaatgtgatcaggtatcacctgggagttggtggagaatgaagaacttaatcaggtatcaagagtaatcagatatctaaagtggggcagttcttactaaactgacttagcacacttcttgctaaaaccagattttacaaggaagtgcacagatgagcctaggagaaggtagaggggtctgactaaagttttgatcaagtaaaaaagtctttatcaatcttggtatttcccgttaagcacaatgcttggaacataatagttgctcaacaaatgttggctgatctgattataagaataacatggatagatcatcctttgtaatctataagttttttaaaagtttatttttaattattatgaatacattccagttgtacatatttatggggtatatgtgatattttgatacaaacctgccatgtgtaatgatcaaatcagggtaattggggtatccatcacctcaagcatttatcattttttttgtgttaggaacattatacttctgctcttttagttattttgaaatatacaaataaattattgttaactgttattaccctgtaggtgttactgaacgctagatcttattccttctatctaactgtgttttcgtgccttttaacaatccccctttttatgttcccctcccccactacccatcccagtctctggtagccatcattctactctccatctccatgagttcaatattatttttagctcccacatattattgagagtatgcaatatttgtatttctgtgcctggcttacttcttaacataatgtgcttcattccattatttcttaacataatatgctttaattccatctacgttgttccaaatgacaggatttcagtttcttagtagctgaataatatttcattttgtatatgtactttattttctttatccattcatctactgatggattcttgggttgatttcatatcttgtctattgtaaatagtgctgtaataaacatgggagtgcagatatctctttgatatactgatttcctttcttttggatatatacccagaagtggcattactagatcatatggtagttctatttttagttttctgaggaatactccgtgctgttctctatagtggctgtactaatttattcccaccagcacactagagttcctctttttccgtatcctcatcagcattcattattgcctgtcttttggataaaagccattttaactggggtgagatgacgtcttatcgtagttttgatttgcatttctctgatgacaatctacaagttaatatgtctgaaaatctctcagtcatcctatcatgtttctactcttcaatgggaaaaattaatttatcaagccagattgtcatcttttcttaaaaaattacatgatatgaaattcacagctttcctattcaagtgagtttttcttatgtccagctagaatcccctttgggttaatataagtctttagtgtacgaatttgaatctttgcctgaggtgctacactgttggttctcttaaaaatttgtggcattatttaattcagtaaaatttgtgtggattgatttgtatcctttgaatagttagtattatataaatatctcagtctataagactcatccaaaactttggaattggaagtccaatctcctctccattagaagtcttgtcttggacatccagtctctatttaatccaatgatatgctccctgatttatctactcagactttttattgttagttaggtttattctttattttaaactgagatccgtcatcacaaaagccattcccatttacctgttgtcctttggctgtattgccctggttatatattactgggttttgctaaatgtttcctatcttttctttcaagttaaatctttatgtctctgttagattatcacatataaatgtgtaaaaacatagatattcctgcaaagcttacaaggaaacaataaaacagaaaagacttgatctaactcctccccacctcaatccagagctattactttcactcttttagttgtttcttctgattttacttccatatttccaaacaatgtggttatggtgctatttttattttgatgtctttacattcaatacatcaatgttgattttaggttttattttataaatatcctcaattttatcttccaattcttttgttgaataaatctttgctaataaatatgtatatacatatatttattatatatgtatatatatttacatataaataaatatatatacatattttaatatatatattttattttctaagggctttatgttgtattatttcttattttgatagcattcagattgcagtttttaaaagatacaaatcatttcttttatcatattaatgatgaggcttttaaaatcagttttctattctctgcattgtatctcttttttattccattttctttctttcttttctcctatgtaccttagtctcttgtttcatatttctattagagcctatcctacattgtctagttaatcttggctgtttgttgtcacttaataataaaactctaacaaaccattagaaactgtataattatagcaattttcaaaattattattagtgggtgaaattcactaaatctaaataggtggggatctacccattttattaagagaccaccctccaaaatgtcagatcttttctctcaagtcatttttttttagtaattcagtttctgaagtcttagttttctctctgtgcgttttctgcatttaggtggatagcatcttcataacagaggagaaaagggagtctgttaggcagattggtctcaggggtcagtatataaatttacacataatcctactatttttcttataacttcgcactgctgtcacagcctgagcctcttcaagtcagattccaatgctcttcttaaacagattctctgagtgtgtttgctgatttttgctgcagtggagagggtatttctcagttgatgtgatccttatataggcttttagtcactccatctgttttcagccccactgctggctctgccttcagaaatatgtgatgcctccaagttctctaactttatagggttctacagcaaaatatccttgtttactactggcttctttctctgtaaaaacttagctttccacttttttctgtcctactgtcaattaccacacatctatacacttttcatcttccaaatcttgttgacatttctcctctgctattgtcttttcatccagtctcttttgctactgcgaactatacagcctttatttttttcacaaccattttagtaggattttgaaagaaaatacagatagaaagcttgtgtttagtccaccatacttagtgagaagttgccataacatttttgaagattgaatgtacagtatggaatatgttcattatctcagtaccatgtttgggctcataaaaataaaaatagcagacatgagtgtggcctttattcatttgttcaacaggcttttactgcttgcctatcatgggaatggcaagaaacatcatttcagttaactgaaaggacaaatacaatattcttagtgatctccttccttcagttccccacaggaaatttgaggttgataaaacagcagcaaaagcatatttttagaagataaagagatggttcgtatgatgtacagaagtctacttgctactcaaagtgtgatcagtggtctagcagcatgcatccctgggagcttattggaagtacagattcttagtctcctctctgacctactggaacacaatctacgttttaatgaggtccccagggtagtcttaaaattggtccaagggaaaggattttattagaaaaaaagtgaaccttcttttatcccacctagggttaatgcataggaattttatctgtagtcaagatcataggcaccatgtgaagtgattttcttttctttctttttttttttttttgagacaatgtctcactgtgacccaggctgaagtgcagtggcacgatctcagctcactgcaacctctgcctcccaggttcaagtggttctcctgcctcagcctcgtgagtagctgggattacaggaatgcaccaccatgtccggctaatttttgtatttttagtagagataggatatcaccatgttggccaggctggtcttgaactcttgacctcaagtgatccacttgccttggactcccgaagttctgggattacaggcgtgagccactgtgcctggcatgaagtgattttcaaacatagttgatcataagaaccttgaaggggattatttgtttaaatgtagattcttctttcttttacattgtcgtaagtaatgtaatcaatgtggaatagggctgtaaacctattttaagggcttctgagatgctaatcagtcagatttgggaactatcagggaaaattttcaacccttttcatcatgatgtctcagggaccaaatatcttccatttgctacccaccacttcctgcaactcctaccagccatcactacagatgtatcatatcagatcctattttcttcatctttgccttctcctcaaatcatgtatagtcttgagactcatctgttcagttggcagagtgtcttccttctcccaagacaacatcctcgttttcatttttcccattcactctgtgccactgcttacctccatgcccaaatctccagctctctctttgctggcaggtgtcatgttctgacactgatttggggtcaagtctggggttctgaatcaggagcctgtgtttgatggggagtagatgccagaaggcattgacaagtggcaccatgcaggcgaataatgcaagaagagtcaccttgtgggaaaattgatgcctgataatctgtcccaccagggtgtcaagtccgagagtgagaatccatcaattaaactgtgggacggactttagagaggacagacttgagcacaggggtgtggagaattggttatggaagaaattcccaagcgaaatgaatatagttggaggaaatgtgaagagggtggggagtttcctgggcctctgctggaagagcagaatgtaagagttgagaatgttaaaccagcttgcataacgttttgctgaacagtttaattcagaagccaattgagatatctgttattcctgacaaactttaaaaggttctagaactggcaaaacaactaggtctgagcaaagtgaaaagacatagtgtgaccagctgggacaggaacgctgcaaacttgctaattagtctggaggaagccaattgcccacatttttatgtactgctaattactaaagtagcagcttgctataaagacaaaaataacagcatgatagtttcttgaatataggataaagtggcctttgggatgtaggctccatcaactttaaaaatattctgtagtttttaaacttaaagcatacagtgccgtaataaaaatacactttggaagtcagttattcacttttttccataggctgttagatgagaaattatagaatatatggtaccctgttgggaatttatactaaaggattttgttttaaagataccaactctccatttgaataccatttctcagctcattttaaacatttacccaattaaaaaagctaaataagtgattttaaaatgtgttttattttaaatacacagtgtttttttctgaaaatgctttctcaacccagttatatctgtgaaaagagaatgtcctttaggaatttaccaacttttcacgcagttgtagcattcattgtgggtgttcagtaaatatttgcagaaagaatgagtgaatgagcaaaggaataaatacacaaaaccttgtgtgcatgagaacgataggatttcacacttctaaggaacaactgagaacaactactccccttgtattcttttgaggatgaggaaatttaggcagaggacaagtaactcctctggggcctcacagctggttaggggcaaaactgggtctgggccccatttcttatgtctatcagcccagcagtcttttcattttaagcttatttgtattccctttaagagaataatgagttatttctgcagggctaattctgacctgaatcatattaaatcagcaaagcctggttttcttacactttcaaatgcagaatgacaaaagtaaagcatcttttaaaacaaaacaaagccaaagcaattggagtatttggttttattgaggagtgatgttttcaaaggcagagaagggagaaaaatggaaactctgtgccatggacttaacttgaaagctaaatgtcagacttgatgtaaaggaggaaaaccagccctgaggacctataactgcataaaagaaaaaaagcagatttctattgattgcagcaaatcaatagaagttcatgtatttgcggatttatttattgcttgcattggtcactgaaacctctaattagattcatagtgtacttagtgtattgtaattatatgtggcagagcacgtttgatgaaggtggatataagtagatgaatatttagacccagcaataccactaatgactcacatgccaggtaacatttctttacttgtaggacttattaagaagtggctgtgaattgtcttcttaattaaaggtttggttacatgaccaaagagttgttaataatggtgcagtcacttatcaaatgtgtgatcccacctaacttatttataattctgaacctagtgtttctcatatgtacagataggttcctaatgacacttaccacatggggttgttgtgaggattaaataagagcatgcaagtaaggttttacatagtgcattccacataaaaagcactcaataaatgttagctattattactgttttcagtcactccaggcgagctatattgtaaaaaaccatacttccattgcttcttcactagagcctagcaaatcattgttttctactggtctactatttgtggatatttctaccccaagatcctttcccaagaggacaatgcaatatagttgaaagattcttcttcacttggtgttcagaatatttcattcaaattcaacattcacaagtgcaatttgtactcgatattgtagactttccagaaaggtgaggttcattcattcaattgcttcttggctgagcaaatttatattctcttaaatcttgataagtcagttaatcttctctaaaattgaggaagttatactcattccactggggtgctatgaggatcggatgaaggtatatagcaaaagtgcttatttgtaaacatcatgttgttgaatgaatattggttattgatattttctgaaggtccccattccatgcctttttcagggccccgtgtaaagccatcccttctctgaagctttccctgacttctctaccttccatctagatgtcaactctcctccttttcactctcactccatttcagttgatcttccttggaattcaaaatacatactgccttgtagagcagtgatttgtatttatttcattccttcttctacactttcagaaggaagtgtctacatctcattgacctcattgtcccacacagtgcataacacagtatcttgcctgtaataatgctcaacaaatatttgattaatgaatagacaggcttttatgaatccatgtgtaatgttaagttctatgaattatgtagaaatagtaaaagcaaataaagactcaattacaattttaactcttcaacaagatgatcaaatccttgaggattagaaattaattaaaaatgaactcatcctttattcattcatcccattatttaataaataaacataaatcgagcaccttccaggtgccagatactatgttggattcgaggaatttaatgcaattaaaataaatagtttcatcccatagaggttgcagtttgtaagtaataagaaataaggaaataattccaaacttgcttttgcaggatgaatatttagaactttctttattaaaagaggtcagtaaaacattcttaactgctttttctatccattattaattccaataatttggtcactgttcattagtgagattaaatttggctactgagagtaggtcatgcaaatcatctttctggttaaaaaaaggcctgtagctactgggtgaaatttgctttgaattatttttcataatcacaagtaattgggcatgtcgtactcagttataaataaatatacaaaagtacactgatctactttccttaataatgagtttgaaaaccatcgctatgttacttaaacttacttttcttcactatttaaaaagtccagagggcacaagtaaccttcagagaatctttccacattacaaggcaaaattatttaataaaatttctgaacatacattttaattgaaaagtcataagcaattctacactgatggggaaccagccaatgtgatgcaaaatgaatttctcagtaactgttttgtgtgtaggtaattttaagtgaaagaaattttttttctattgtacaaaccaagactaatttattcattgttgttccaaagcagcagaagccaccagaatgtcacattttatttttaattcacaaaattaaatatacttatggtgtacaatattgagttttgaaatatgtatacactagaatagtggactcaagctaacatatgtattacctcaaatactgatttttttgttgtgagaacaattaaactctctctttgcaattttcaagtataaaatacattgttattaactgtagtcattatattgtacaatggatttcttgaacttattgttccatctaactggaattttgtaccctttggtcaaacatctctctaatcccacccgcctacaccacctcagcacctggtaaccaccattctactctctcctgctatgagtttgttttttttttagatttcatatataagcgaggtcgtgcagtatttgtcttcctgagcatggcttattttacttaacataatatcctcaagatttgtccatgttgttacaaattaggagatttttatctttttaaaggctcaataatattggttgtgtacatataccatgttttctttttccatttccatttatgtgtcgatgaacacttaggttgattccgtatgtttagccaaggtgaataatgctgcagtgaatgttggactgcagatatctctttgtcattctgaattcttttcctttggatatataccctgtatcaggatcactggatcgtatggtaattctattttaattttttgaggaacttccatactatttttcataatggctacatgatatatccccaacagcagtataccagggttcccttttctctacatccttgctaatacttatcttttatctttatgataacaactaatctatagtaatagctaatctatagctaggtataaggtgatatttcgttgtggttttaatttgcatttccctgataattagtgatgttgaacattttttaatgtacttgttagccgtctgtatgtctccctgtaggaaatgtctatttagatcctttgcttattttttaattgggttatttgtttacttgctatgaagttgtttgaattctttatatattttagatattaaccccttatcatagaatgacgcattttaagacaaggaatgaatcttgtgaaagcttaattccctgtcctaattcctcaccctttacacctccttgcactagacacactcatttacaaactctatacttctactgtattcctatgactggagggtgtttatgagaaaagcaggtgagccttagagtaccagtatatcaatttttttccacagtaggttaagggattcatggagggaccccccctgccccccaaattgatttgccttttgcattagtcaaggttctggcaggaaaactggtgacactctcaaatgggggtaataatataagaattgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaagaattgacccatttacaatagtataggcagggtaagtctgttgtcagggaagccaataaaggatggagaagcacctttttacccattacctctcttaggcttgaagggggaaagggagtgaatatttattggaacaaagagccagagatgtggctgtaactgggagagggcctcccaataggatctgaaaagttcagtagtgaaatgcaagcactgcaacccgaggcctggcagggaggagaccaaagaaactgatatcccaatctcacttttcccactccctggctttctgccaatgactcccatttgatgcagtccagaaagatgggcttcctagagagcagagtagggtggaaaatggattcagagggccatgaagagtatcagagtatcaagaatacctgttacattataaggaatatatatgtatatatgtatttattcatatggtacatgtgcttacaagcaggaagctattgtgtatatataagtgttatgtatttacgcatatggtacatgtgcctacaagcagaaagctattaatcctttcaagaacctttacaggcattattcatttaatattgataaaaccatttcaaatgagctgataatggtttggctgtgtccccacccaaatcacatcttgaattatagttcccataatccccatgtatcatgggagggacccagtgagaagtaattaaatcacgggggcaattacccttatgctgttctcatgatagtgagtgagttctcacaagatttgatggtttcataaggggattttcccccttttgcttggcatttctccttcctgctgtcatgtgaagaaggatgtgtttgcttccccttccaccatgattgtaagtttcctgaggcctccccagtcatgtgaaactgtaagtcagttaaacctcttgctttataaattacccagtcctgggtatttcttcatgtcaggctgagaatggactaatacagtaaattggcaccaggtagtgggatactgctgtaaagatgcctgaaaatgtagaagcacctttggaactgggtaacatacagaggatggaacagtttggagggctcagaagaagagaggaagatggggaaagtttggaacttcctggatacttgttgaatggctttgaccaaaatgctgatactgacatggacaatgaagtccaaactgaggtggtctcagatggagatgaggaacttgttgggaactggagtaaaggtgactcttgctatgctctaaaaaagagactggtggcattttgcccctgctctagagatctgtggaactttgaacttgagagagatgatttagggtatctagtagaagaaatttctaagcagcaaagtgttcaagacgtgacttgggtgctgtaaaaagcattcaattttatatattcacaaagatagaatttggaattggaaattgtttaaatgagaagcagagcataaaagtttggaaaatttgtagcttgctgatgtgccagaaaagaaaaacccattttctgaagagaaattcaagccagctgcagaaatttgcataagtaatgaaccaaatgttaatcaccatgataatggggaaaatgtctccagggcatgtcagagaccacaacagtccctcccatcacaaacctggaggcctaggagggaaaaatggtttcctgggccaggtccagggctcccctgctgtgtgcaacttgagtcccagctgctccagccatggctaaaatgtgccaaggtacagctcaggatattgtttcaaaaggtgtaagcccccattcttggcagcttccacatagtgttgggcctgtgattgtatagaagacaagaattgagtttggtgaacttctgcctagatttcagaggatgtatggaaacacctggatgtccaggcagaagtctgctgcaggggcagagccctcatggagaagctctactagggcagtgcagaagggaaatgtggggttggagcccccacacggagtccctactggggtactgactagtagaactgtgagaagagggccactgtcctccagaacccagaatggtagatccactgacagcttgcattatgtggctggaaaagctgcagacactcaacagcagccatgaaagcagccaggaggggcactgtaccctacaaagccacaggggcagtgctgtccaagccatgggagcccacctcttgcatcagcatgccctggatgtgagacatgtagtctaaggagatagttttggaactttaaggtttaatgactgccctattggattacttgcatgaggcctgtagcctctttgttttggccaatttctcccatttggaatgggtatatttacccaatgcctatacccccattttatctaggaagtaactaacttcttttattttacagtctcataggtggaaaggacttgccttgtctcggatgagactttggacttggacttttgagttaatgctggaataagttaagaatttgggggactgttgaaagggcgtgatcatgttttgaattgtgagggcatgagatttgtgaggggccaggggcagaataatatggtttggctatgtttgcacctaaatctcatcttgaattttagttcccataatccccatgtgttatgggagggacccagtgggaggtacttgaatcatgggagtggttaccctcatgctgttctcatgatagtgagtgagttctcacaagagctgatgattttataaggaggttttcccccttttgctcagcacttctccctggtgccaccatgtgaagaaggacatgtttgcttccccttctgccatgattgtaagtttcctgaggcctttccagccctggtgaactggagtccatgaaagatctttcctttataaattacccagtctcaggtatttcttcatagcagtgtgagaataaactaatatataagccttattattctcatgtgatataacaaaatatattaatgtagatgtgtttacagacatcttctttattccagctcaacagcccaaattcttttcaccttctgtaaagaagagtgactggaagagagactaagttaattgagataattaataagtgagtgagagaataaatgaattatagaggaggaaccaaaagcacagagctggaagtggaacaggaggttctcagcaattttaaaagtgaaggcaccgtagcagtggaagtatataaagggagtaaagtcaggctgggaaaacagaaggcaaaaatagtgttcatctagactgtgtgtcagattacttctaatatccttcaaggtacttgagtgaggaataatttcctcttatgtttctattggtattgggttgtccttttggatgaggctcagctcagagactgaaccatgtgatgtctgtgtattttagggttgcactcactttgcattaattttaactgagagttaaaggggttaagtgccttgcctaagatcacatactcagaaaatgcagagagcttactccagcccaggtttgttcatttcagatacattagtctcaattcagctttggttgaagtcacctgtgatgaatttgttgcatgatatagttttctgggggaaagatttcttttaatacatggtaagtatatagtaccccttttatagttggatagattagttctttaaatttcttttgtaaagaggatagattagtaatggtcaagtgtcattgagtgattcagacgaatagttccatgattaaatcttgtttcctttactttttgtataatgctaatgtatcccttaaaataaaaactccatttagttttcttcagttcatttaatcatggcattgttactgtaagaaagttcttctcctaatggtttctaattgctcttaaaatcttgtttgaatcccagaacaaatctctgtgttatatgtcaccagtgacccacccttactttctctcatttactgcctttcataagcagaaagcatttattttttgggtatttttgcttattttttaaaaataaataacattgatttttaatcctgggatatggaagatagtttaaagaaaacagcagtgtcggtggatagcaattaccaccaacaaaatatcttctgggtatttgatctatgaactttgtttgcactcctgcccacatcagtttttgtaacccttccaacttcctcctaagggcaaactcactgacatttccacaactgttcacctttctgatcctgataggattactatatattttgtttaggtttctagatatgataagactatctacctatccaacttggatctgtggcactttattttcctattaattttaaattcaggatttaaaaaagatacttacatagtgataaaatgagttgactcacaccctgcattattctaaaccaaaattaagttatattaatacattctctttaatcaagggtaaattcacatgccccattgtggttagtgaagtggtgaagggaaagttgaagccaaacagcctatgtcttaattctaactcagccactaactagctgtgcaatcttggacaaggccctgaaactctctgggtctcagttttctcatttctactaaaaggacaataatagtacctattacctagagttaggaagatgaagttaacaaagtgatagtgtattaaagcgtacctgacacataggaaacattcagtatatattgtctgctattattaaagctcctacacttattaggtaggtgaacttaatcagattatttgactttaataaacagcaatgatcatatttataaagtagggattgtaaaatataatgcagtgagtttacaagtgtcataatgtgaaatatataaatataaattacatatataaaatatataaatataaattacatatgtaaaatatataaatatacattatataaattatgtatgtaaaatatataaatataaattacatatgtaaaaagtacatagccatgttttgactcataaagagcattcattaaatgtggttacaatttttagaagacattatcagtaatattatcagtaatagaataagacctacaaaaaagggtaggggagagagtttcatgttgtataaggggagtgttgatttaaaagccttagattaaaatctgcaaatgaaactaaattaaaggtgttttgaagtgattttaaccgccaaacaaattgcatttaatacataataattactttattctcccattaaaataattatttttaagtgaataacagcttctttgaccaccctacctgtagttgcagtaacagtctaccagttgtctttccaaatttgtatgatgtcatcagcagcttaatagagcattagatgagaatgtctgagcattactatgctgactttgtaaaattgtaatccaaaagcaaagaatcttgacagcttagacagttggtttgatcttattattaatgaacagaagatatatcttaggctattttaaaagtgaatttataataagatttctacttcctatgttagctagagtaaacactagctaataaaccaccctcctaaacctcagcaaactagcccaagaaaagagtttaattttggtattagtattgctcactcacataaagcccaagcaattaggagcagaggaagggatgtgagggtttgctctatagagtcatagaggatccaaggtgacagagcctctgtcatcttccacacaggccttccaagatggttctagccaaatccagctagccaacatctctggaaatgacaagcatcacttttggtcatatttcattggtcagaagttagtcagagggtacctagttgcaagggaagctgggaaatgtagtctggctggcattgctttgttgcactaactcagtcctgtggaaaaggagcacaaatatttggtggacagtaaatgatctgtgtcatatccttattactcagatccatagtaataatgtctgtttttatctccttttctaattcctagtaaagaagcaatcaaataaaaagaaataaaaacactgaacagtatgtgttcatttgtctcatccattattgtatatagtgcctgatacagagttcagtatatattcagtatatatagtacctgatacagagttcatgatattcaataaatatcatgagtgatcaaacacatattctctgccttcttctcttcctcccttccttttttctctttttcttgcttcttttatatctctttctttttttctgatcccaaacactttagagtctttaatttgagctagattctatgataagtgattgaagaatcaaagacatatttaaccttggggaaagtcataatgggaataaaggaaaaaacattaatataaagtattagtaaacatttctaaattactgatttcattaaaatatttaacagtcttatgaaagactaaagaatcattttgagttcatctactaggcatggacaagccacttcaggaagtttaatatccttctttgtgcctttgggtttaatctgtgctagtgataccccagccttgacagaattgctgccccaatggcccaggctgtgggattctgcacaggaaagaccacttcatggtgaaaattctctaaagttttgctgtgaatcataccataacctaagatctgtgttatggtaaactggatactgtagtggtggaggatgtctaacttcgttttgtgtttcacagagtttcaagagttttcctgtaagcctctttagtctttgtatatttaatgtgctccaatcctacttacatctcaactgtgttctttctgatggcgatggtgatgatagtgccaatcatttatttagcactaacaactgtgtgctcgacactgtaccaatattattagaactattatttcttttactcatcacatcagccctattagatatttagagatttggaaaattatgttcagatagatttggtaacttgtctaaggtcagacatgttaggaaaaggcagagctagaattcaaatacagttttgactgagctcaaagcttgtgtaatcaccacttaggctgatgatttgtttaggctattgagagagaaagattattttatctttctttttttttctggaaagagggatgtatacagatcttttagtagtaaaattttgccactacattcagtgacaaaaacaggagttacttttgcaccaacctgataactcttcaaaatgtttggtgaggctggactcaaacataagtgcatggatgcctgatttttttcccccagtattcaagaacctcagggttttcctgaatgtgctatagacattccagggacctcctaagttttgaacattgcattattatgaagattaggtccataagttttatcagattttctaaaatacgagtaaacattttttaaacccaaggtttgctgccaacttctctcctctacagatcctggaaagaagaaagaaatggcttctaacaaaaagaaggggaggatttccagctcatttctaattcaggctcattggagaaggaagtggcatgggtgacgataagcagcagtttttatgtctgaaggaaactgaaaacagcatctcactggggtggccaggagctcttctgctgaagtctctgtgtatccagaatgcctgggattggattcttgtcctgttgcctctgacttcctagaagtggcctctgggccgtctttatttattaaatcatctgggtatgatctggctctgatattttggcattcgggagtggcagaccaagctcaaattgcaatagtcctttaaaaagatgtttctaaaagccagatatgcactgacatttcagaaagaacatttgtgcctaatttccagctgccaagttatagttcatcattcagcttcatattggaggccttcaggctttgatttatttaggaaacattggtgaacaatgggatcatgatctgcaacatgacagatgtaggaagtccatgtcccctaaaggaggttttctggagactcctaacaattaagagaatctgttctgtttctaagttgacagcaaattattgaattctgagtatccagaatgagtttggggagtaagagttgtgaagggcagacattaactgcttatttaagacataatacctgtcctttggaaacttatggtttgttagggggtagtgtcctagaaacaatgtaagacaatttgttaccaaatgataaatagaactttaaaacaaaaattttcctactgtcagggaaactaagttttccttttctttgaaggcatggagaagtgccgagcagtgtgttacttttcctctattccctggttcgttcctcacccacgtcagtttttcttcatatttgtctttattggaacccacaaagtttattcaaagttattatcagtttcttcccttttgtgaagaaaattcaatttttatgaattagatttttaagatggcttgtaatgtacccatacagccaggtataagaaattacctggtagcttcactgatgcagatgacagatacctgtggggacttacagtctagttgggagagtaatcacacacatacacacacacacacacacacacaccccagatttggcatgagaagaacaacgctgaagtcgatatctgcctattttgtttataatggtgtgaccttgggcaagtcacttaatttttcaatgtattttctcatctataagatgggagatatcttatatcctaaggctattgattatgtcagatggaatctcatctgagaaaataccttagaaattgtacagtatgataaaaatattgacttttattttctaaatcatacatagcaagatgcaggactagtttaattgttgtcacttttagaatccgattttcacatcatcattccatttcttatgatatttaacatgacaagcaaaagaccttgttcaaaggggaagaacaaataagattaattctctgtaaatcctttaaaattttattatccatctcttcactggggaaatgtctagatacattttcctaagtggttccatctttctgtaaatggctattgacctgctgagtgcagttttgctttcagagaagcattgcacttggtgtgtgatttgagtttgggatcatgaccttatttcctttgcacttgattgctttacttcaccaactgcatccctgattttgatattatctgtggctagctcctttcatgattttgggaatggctacctctcagttttctgaatattttttagtacttgctgttacaatgtagacattgcaataatgttctaaaattatatgtacatttacttactcaacacaaatttaaagagtacctgataagagctggtactctgagtactgagcactgagtacctggtagaatcattaatacagaagacaaagctctggcctcaaggattctgcagtacagcagcagggaggtaaaacacacataccacatttgtttactgcaagtgtgggaggtagataggtgtcccctaaaaacatgtgttcccagaacctgtgacgtgaccttacttggaaaaagggtctttgcagatgtttaagttaataatcttgtgatgagatcatcctggattgtacaggtgggccctaaatccagtgaaaactatctttgtaagagacagatgaggagaagacgtagagacttgtgaaacagaaggccatgtgaagacagaggcagagattggagggatataaccagaaagaatgcccataggcagcagaaattggaagaggtaagaattggattgttgcctaaagccttcagaaggagtgtgaccctgtcagcatttggatctccgactctggcctttaaaactgagagagaaaaaaatttctgttgttttaagccagtgagtttgtggtaattttttaatggcagccatgagaaacgaatacaacaaggaacaggataatctacaaaatacatgaattatacaagagcatcagaagtttgtggaaatttagtataaaaaacacctcttattgaaagtgtgattgttactatacagtcagtccagaagcactgaattatgaaaatatcattgcctggtatgtgtcagttatgtttataataatataaataatctaagcacacattgtgtcctgtaattttaattttactctaacatcccatgcaaaggtttaactgtaggtggccatttcatgaaacaaatgccaatttctcatggaccaatgttctcccagcagaggaaatatatcttcctgcccacactgggctacaacatcactaaaattacaagcagaaaggaggtctgcatttctatagcctcttcttttcttatctagtagtaaatggttataaacttgacattttccagttacaaacataagtaataatattgtaataacaaaagggaaggtccaatcctatagatcccactgatggtgatagagtaaatcaaggaatttggaagaagtggtatctagtttcacaagttgaaaaaccagaattatcttcaggcattcataatttcagtgtcatgggttaaggtgtttgggggcaaaatgagtttctggctgtgggatggatttgagtggtgttagcaatcattcaataacagaagccactgaagcagccttcgtctccctaatcaaaatgctgccatcataccattttgctcccaaaatatgctaaaagtaaggcaccaacggtaataagtagtataggtaatttttaagtaccataaaagtttacaatattaacagttacatttgttaattttgtctggcttagttggtggtgacttcagatggtaactgggtggaataagacttctaagcccacataagacaggatggtgtgatctttctgggagggtgccacgtctgtccaatattgatacaatagtgcaccagtggcagcttcttggttgggccaagtaagccttctcaatgtatttactccttcagtatttataacaatcaggaagctgtaattattgtccatattttactaatgaagtaactaaaacttagagaagataagcaatttgtctgaggtcatgctctagtagtgagcagagccagaatctgaactctggcatgatgactatagcgtctgtgtttttatgcattactgataggtatgggtggtatactggagacttagtgagtatttaggtgtgagtaacgtctacagtgacgtcagggagctcactgtacatccatgacatgagaaataaaattcccacgcttccctgtcttgaagctgaggcaatatattacatgggttaactgacaattcagacagagtgagagattcattatattcaccacaaatgaacacagatggacactcttcaaataaagcttcctattgaattttaatagtgctcttctgcagaacacatttgaaaaatggatcatagcatattcatattttcctttagcttgccaaatgtgagatgattaagaaacctgcttaaactttaaatattcttaccatacacatgcatttttcaaatgtatgcgtctgcaataaatatttgttaaatgaatatgaatgtatatacacaaacatacatgaagcaataggcgcacacacatttaatttgataaatatttgttgagtatctactgaatataaacttgggctgaagagttatggaaatacaaagacagaattcttttctgttcccaagaagctttataaggggaagtgagacatgctcagtcttgttctggtggcagctctcaaagtgtggtctctggctcggcagtgttggcatcacttggggacttgttagaaatggaaatgcttgtgccccaccatacacctgctaaatgagaaactgtggctgggggtctagcaatttatggttgtaaaagtcctccagggaactctgatgcacgttaaaatttcagaaccactgggcacaggaacgctttaatgtgctaaaggatgctaaatattactttcacgtggagacatctgagaaggcttgaagaaagagattgtatttgagcagagtcttggagaacaggtagattttggctgatagaaacagagaagggaaataaagtcaaagagaagagaggaagtcaacttagctcgtttgagttggcagataggctgcccatggatgaaaacccagattaaaatcaggcagtggaaatccctgagcaacacgcttgtgagtttagacattgttctgaaagacattggcagtcattgaaggtttctgagtggggaagaagtgtgatcaaaactaccttccttttttttttttcttacccagtgaatgtaattcagcacttgtactgagttcatattaacagaacttgatggttgtaaatcagtcttttcttcctcattaaaatcacttcaccattaagaattatctataggttatggctggaatcatgttatctctgctctttcttgactattctgacacagcaggcaacttaatttcaacaactcggtaatgcccccatcttctgtgtgtgtgtgtgtgtgtgtgtgtgtgtgtgtgtgtggtgtttgctaagaaggagtcacacggctgcttttgaattcagctgggctttaggaagctgcataaaaacaaagaaaaaatgttgctgcttgctagtgcattctttgttatgtagcaatcagaaggatgactgtgctctgaagtggtgcaggtggcctcttctgatactaattccagcgtctcaactagttcagcatcaaaagggagttctctggaagggaaataattctgtccctacccctgattgctcctatttgcccagcattgtgggcacctgcttggccacccaccttccttttctttgccatccacttgcgtcatctttctcttcccctgggtcagcctgtatatttcaatctatccacaccctgcgcaagctcattcattcatgggctttctctctgcaattttcattgtgcctccctttgttggcataattgattccctgctttgcaagagcaggtggatgagttggtttattcctttaaaaaattcctcctcttttctctttcattgctctgatctttagtcaatctttggttcagccagcttgttctccttctattgactaatctctctctgtatctttcataatggtggtgggagagtccatgccgaatctcctgttggttgaagaaggtgaaagtcaattggtaaagtcactgtgatttataatgttcaaactggggagggattgagtcgtgaagaccagaagtactgataatcatttagcttatttgctggaaggctccactagaccctaatgaaacaatctcatttatcttccccacatcctaatggaattgcagaattaatagtaaaaccattaagccttcttgagcatgtctcatctaacactccaggatctttgttacacatttttatttttctcaattttggattttttgagggtgcgaatttacttagctgagaaatttagaagtcctttattcagtctagtataaagtgtccagataaaaacataccttagagatattgtgggtgcagttccagaccaccacaataaagcagataccacaataaagcaagcatataaattgtttggtttcccagtgcatataaaagttatttttactctatagtctattaagtatgcaatagaatgatgtctaaaataaaatgtacataccctaattataagtattgtgttgctaaaaattgctgatgataatctgagcatacagtgggtcataatcttcttacttgtgaagggtcttgccttgatattgacggctgctcactgatcagggtagtggttgctgaaggaggttagggtggctgtagcaatttcctaaaataagacaacaatgaagtttgctttatcaattaactcttgcttttatgaaagatatctttgtagcatacgatgctgtttgatagcattttacccacagtagaacttctttcaaaattagaatgaattcactcaaaacttgcaggtgctttatcaactgaatttatggaatattctaaatcctttgtagtcatttcaacaatgttcacagcatctttaccaggagaaaattccattttaagaaactactttctttgctcatctatagaagcaactcttaaaatccattccagttttatcatgagatggcagcaattcagtcacagcttcagtttctacctctagttctagttctcttgctacttccaccacatctgcatctactttctccactgatgttttgaacccttcagccatccatgaagattggaatcttttccaaactcctgttaatgttgatatttcaaacttctcccatgaatcacgaatgttctttatggcatttacaatgttaaatcattttcaaaaaattttccatttgctttatccatatctatcagaggaatcaccatgtcagttctagccttacaaagtgtattttttaaataataagacttgaaagttgaaattattccttgattcatgggctagagaatggatgttacgttagcagacatgaaagccacattaatcttcttgtactcccatcaaagttctggagtgactaggtgcattgtcaatgaatagtaacattttgaaaaaaaaaaaaatcttttttttttccttagcagtagttctcaatagtaggcttaaagtattcagtaaaccattttgtaaatagatgtactgtcatccaggctttgttgttccatttacagagcacaggcagagtagattttgctaaattctggggccctaggattttttgaatggtatataagcattggcttcaacttaaagtcaccagctgccttagcccccaacaatatagtcagcccgccctttgaagtcaggtattgatgtctcctctgtagctataaaggtcctaggtggcatctttttcctatataaagctgtttcatctacagtaaaaatctcttgcttggtgtagtcaccttcatcaattatcttagctggatgtaacggataacttgctgcagcgtctacataagcacttgccgctttaccttgtgcttttatgttatagagatgatttctctccttaaacctcatgaaccaatatcttctagctttaaacttttttctgcatcttcctcacctctcttagccttcatagaattggaaatagtttgggccttgctctgggttaggctttggcttaagggaatgttgtggctggtttgatcttcaatccagaccactacaactttctccatataagcaataagcttgtttaactttcttatcatctgtgtgttcactggagtagcacttttaatttccttcaagaacttttcctttgcattcacaactaggttaactgtttggcacaagaagcctagatctcagcctatctcagttttcaacatgcctcactgagcttaatcatttctagcttttgatttgaagttagagatatgagactcttcctttcatttgaatacttaggcctttgtgggagtattaattggcctaatttctatattattgtgtctcagggaatagggaggcccaaggagaggaagaaaaatgtgagaatggccagtaagttgagcggtcagaagacacacaacatttattaagttggccatcttatatggacatgatttgtgttgccttcaaagaattacaataatgacatcaaagatcactcatcaaagatcaccatctcagatataataataatgaaaaagttttacgtgttgagagaattaccaaaatgtgatgtagtgacatgaatcaggcacatgcagttagaaaaatggtgtggattgacttgctcaaccaacggttgccccaaaccatcaatttgtttttaaaaatgcaattgttgtaaaatgcaaaaaagtgaagcacaaaaaaactaggtatgcttgtgataggtttctctcctattctttgaagaggcttttaaatagagttgattgcatggcattgcctagtaaaatcattttaaactaatatgaaattatataagctctgaacagggcatttgatgtccactagggaaagtaaaacatattttttatttcagcataagaagcttatctcttccatcttgtaaaataatataataataatagaattagttaaacatggtgattactattacgtattttatgattccaataattcaagcacagacactatcttgaatgcgtcctagtatattcagctccacaatgatgcctagggtttcatgttgaaggctgtgaagttaacaaaggaaaatggagatctgattactagcttccagagattggttgagaattgagggagaagagagatcaacattatatatttcacatggcagagggtaataggagcttttatagagaggcaaaatgcattggtagaaagagaagagagagcctaattccacttgctaaaaatctatggaagccacctaaaggaagaatgaaaaattgaatgtttatcaataagttggaaagaggagaggaacattatgggcagagcaaacagcatagaaatagaataatacatggagtatttgttagcattcagagggaatggagatgacgggaaatggtagaacatagttagaaaagtaaattgggcagaattggtgacaggggattcaatttggtaagcagtgggtaaccattcatggctttgagcagagtttggcaaactatgatttgtggaccaaatccatcccattgtctgatcttgtaaagaaagttttatttaaatacagtcatactcattcacttatgtattgtctgtggctgctttcatgctacaatggcagcattgaatagtggtgacagagactgcctacaagctgaaaatatttgatatatgactttttacagaaattttaccgatgtcaggattcactttaataaagtgtttcataaagtgtttgtttgtgccgtgatgggccatccaagattgtaatgggcgatcattggaaacaaagatgcttatagagcagcatcttgcatgtcacaaatatttgaatgaatgaaaaaatgcatatttctgttaagacatcacagtaacagtaggagatattgctttttttttctttctttttttttgacaagaccaatgtgaaaataatcagagagtggttctctggaccacatcctgttcttcaggggagagacattgaaaaacatcaggaaaagcttatccctagaattgattcagaggacaaagctacagttatgagaaaggccactttggagaaatgttggataagatgtccagtgaggcacagaatggggtgacactgggagtgacaggatcttgatggactctggccatggcacttctcaaacgtttttggcagtcctatttctattttcacagactcctccacctccactctgtcctggccagcacccagttctcaagcattacacatttatcccaagtaatgcgtagggagcttcctttcttgcacctataaattattcactagtttcagattggggtgaaaagaggaaaacataattaatccagaattatttcacatgtataaattccttgcttggttttgtttcatcatcagggcttccttggccttccatggatggcatataccttattaatttatgcttagcaatcttttgaaaataatttttacatgggtaactcactgaaacatcatggcatttatctcacatcatgtagttttgtcagttttgatgttagagaacgtattctgccttacttttatgtagcaatgtgaccaggaaatctcatgtaaaatctatgcctccctaatatgcaaaaatactgaaaatgagcacctcttctcccttccttcttttttaataaatctagtaataatagctggaataatcacaggatttctaaatggagtcagcatggcaaaggaaaatgttggtgatatatttattaagtccatagaagttaaacttccggagagctcccaagctaattggtaccccttgttcaggactggggactattaactgagagaattcattgggtgttttaatatctagccttttaaaatctattttaaacaaggactttgaaggatgactgaaatgtggttaaatttccacagagaacttacaactccagcaatgggaactccccaggtacagtgatgatacgaattgtgttggatttcttgaatttcatcttcaaagcacaagaatgagaaaagaaaggagacaggaaccatttacattaagcagagatgcataagtttcttaagtggtgctttccagagcacagctgggtttcgtgtgtgtgtgtgtgtgtgtgtgtgtgtgtgtgtgtgtgtgtgtgtgtctgatatatcaagctgtcggttatattccatagattcatagtattttcctcctctctatattccatctctactttttgtttataacaagttatttactttgcccatctatcttttaagcaaattatcttgattggaaataactggaatgcttgataattatataagaaacttaaatacttggcctattcatttatcctagagttttagggaacatcttggtctagcataggcattctcaaccatcatattgaaaaaaattgtggagcattatagcacaaatgattttacaaaataaaatgattgttaaaaattagaataggttcatagtagcctcacgctctgggttccatcatgcttcttgggagagagagaaagagcagactggctggtcagaaccctggctttgactgaagaacacattctgcctgtaagcataatttctcagctctgagccagagaaaagcagtgggactcttttctctaggaaatacagtctgcatagatagaatgaagcagaattggagacacataggaaaacaattatccctttgtattagtttatctaatcctctgctttgggaaaacaggaagagagaaaaagaagagggaggagagggagggagctaaaaacaaaggaaaacacttcacaagggtttgccctcccccaaaaattcaagacatgaaatagaatctatcacatatgattgggagccttgtgttctggttttctccaatcctaagcccaagaatttgttcctcctgatgctgtagatagtttcacctgagaagattttactcacctctgcgtcccattatgagatgggaaacctggcttctgccacgtgggcacagagtagatacccactagattttgttgttttgtgtgtatggttgccagggatgatcagtgccccaatattcttgccccatcaatattcttcttagtgagatttgcaaccttttaagcattgggaacttaagggttattatgaatacctgtcattttaagctaatatacattctttacagaataaatgcaaaatgttcacattcatgagaaaaaggaagaaacttttagctgacacataccattttgcatgttatataaatgtattctgctcagtacaaacatttttgtgaacttaaaaaaaatctcttaaatgtttctataaaagtactacttcttgaagtttatatttgaatgaaaatacctcaaattcttttctaccctgacttagaactatataactttaactctctttttcatttttaaagatgtgatattcctctgatgagataacgtggagctttcctctaaaattttcttgtgttcagaccttttttttctcttccttctggtcttcaaaaagctataggaatctgacctaggaacactgtttcctcaataattggcattttctattttcactttggttttccccaacttaattgatgagatatataatctttctccatccaaagaaactacaatgactgacactaacatttttgaacccatctatgcccatttccatttttagttctacaaatgttctgacaccattttttaaaaaatcacaacaccccaaacagtgggttctatttttttttctattgttatagatgagtaaactgacacctaaagagggcccttagcttgtggctggcatctcaggaccaaaatgcctgcgtttgaagcccctgggaatttggcctttggagcctttagcagcttctaagcctagtgagtttgtggcttcaggtcctgtttaggtcctgtttctcatttgtggagaggttggtcttgttttgaaggcagcaacctccttcattttttttcttttttttttttcactatctatcattactacgtttggtgccaagttggggcctcaaattttgaacttaaaacatgacatgcctggaaatccttttctctctcttcttctgaagggtgtccataaagtctgggatgcagacaaatatatgtaatgtcattaaaatttttacaaatctgtaaaaaataaaatagtattatcaatgttttcataccttacagatgcccttcactttaaataaagatttcctgagaactaaaaataaaaataccatgtcctcaagtttggattagtccagggagtagggagaagggctgagaaagagaagggtaaaattatctattcttgacatcactgtaataaattgattgaactgtactgcatattgaatgcttgctcttactagggtctcttcataaatcatctcattattcctcaaaataagtcagcctgctaggtttgatgagcccatttgacagatacacaagtccaaggacatcaaatgactcgcccaacatcactagggcatgtgggctgaatgaggatgttcagtctggtcacatcaaaagccctagctcttttccctataagctagaaataatattccatcccttttctcacctacctcccagcaaaaacaaatgacataaaaatatttttttctatctgcttctgctcatgatacctttaaaatgccttattcatcaattcattccccatctcaggctcaggtaacccttgatgggggatttgtatctaattttctctgtatttcttgaaccatttttttttccatgtgtccatctctatggatccaacctcatgatttcctggaccatttaaattgtcttttattctttcttttttctctatcacatatcttggctctaactcacctgctttccctttgtatttctcttttaatattttacatgtatgtattaccccaactagacagtgttttcaagggagaacttaggaatttttcatttctttccaccatgacatcagacatctttctgatgtcatagcttatgaaataaaagtctataagtatgtgacctgggtaaaacataatcattttgagacttaatgatatgatctctatcaaagttattgtcaactgcagttcattctgctgttatttttatatttgatgataattcagaatttcatgtccccttctataatacctcacatgccaaacaaattaattgtgttaatgacaggtaaggaagctcctggtcactttccttccttgcttcagacccagcttcaaggtgggccagatggggcacaggctgcctcctctgtctgggttcgagttacttgtaaccatgtctgactgtcctggggtgcctcttagctccagttaatttctgaatcctcagcaagttttaaaagtctgagcaagaatttcctttcttactctgttgcttcatctttttcctttcttctctcaaatattcaggatggaggagaaacggcaggctgagccagcaatccatcttacttgaaacctatttgaaggttgtcgggtatgcaagggggctggaaatagggactgagagtttgattccagcatgaaggccaggcatcagtaccgatctaccttgtagtgtggtaaatagactttggcatcagctaaattatttctgtgagactgaagtattttgatcgaaatagacaagtgagcaaagggatttgcaaaagaattctgttttctggcacaggcatctcaatgaggccttgtgcagaatctcacatccgagcgccccctgatggcaacatatagacacgcctcactttctgtggccaaattactccatgaaaggaatagtttctatatttgactttaagaccttatttctaatttatgttttaacctgggatgtgtttggtcaccacttatgtatttgtttttcatatttgtttgatttcaaattatctgtgataacagtattagattataaagtgcattttatgaagctattttaaaataaggtattttcaaatgtcatttaatgttttcttggaaagattcaaagtagtagagtgcttgaggagaaataaaagcagaggaggaataaaaggagatgaaggaggaggaaggggaggaggagaagttataaataaagattagcccctaattctaaaacattttttcttgatctaaatatatgaacaacgaagtccaaattatttaatgtttcccattgactataggatgaaatttaatactttagcctgatgtacaaggctcttaaagatctatccttgtctaactgagtccagagccaaccctacagctgcccaccttgaattttatgctctggaaatactaaatgattacaattacctaaatataacatagttatattcaggaaatacatatattaaatattatatatatatgtataatatgtaactatgttgctcatggatctgtgactgtgcacaccatagttccctctgtctggaacatatgtactgcctcttatcctcctgcaaatctcatccttttcaaggtaattctttcatttcagataaaatgttattctctctgtgaagcttggccgtgatttccctcaactcctgctctccacaagtttccactttgtactgagctcttacattgccttggtcattccctttctcttctccctacctatgttctgaggaaataaacaatgaagtttcatcttctttttttttttttttttctgagacagagtcttgatctttcacccaggttggattgcagtggtgtgattatagctcactgcagccttgatgtcctgggctcaagagatcctcccgcctcagtctcctgagtagttgggactataggctcatgccaccacagctggttattttctttgtagagatagggtttcgccacattgcccaggctggtctcaaactcttgggctcaagggatctgcctgcctcagtctcccaaagtgcttggattacaggtgtgagccactgcgtctgactgaagtttcatctttctagtccagcttagcacaatacttggtgcaggtgcgtaagacatatgtgttaaattgcatacttcccatttcctgaatggaggtgaaataaaggaaacaaaagttaaatacatttttcaggagatacagaaatttgtaactcgctgaaaaagtagctttttattaggactttgccttttaaatcattacacactttagtctttcctcttaaactaaattactatttattattgactttacagaagaagaaactcgtgtcatacttatatgactttttggaccctggtgacatgtgactaataggtaaaaagaacatacaatgctgggagcaatttgtccagtggcccaattttatatgatgcctcaaatgaagtgctgtttatgcaatgaagtgcgtttcttgctttgttagtagtcattgagcctctgcacacgtaaatgtgtagggaatgaccattgagagacaaagtgtttgtgatgttacccatttatagggtatatcaatagttcacatttacggcacactcctttgaggccaggcactttacacacactgtcacaccttatcctcaccatcacagtatgacattaggacaattatgtctatttgcagatgaaactgtgactcatagagatcaggcgatatgtcaagattattcagatagtaaaaggcaggcttgggttcaaaatcaggcagtctggtttacagagcctggccattttttagggcagttgttctcaaccaggggcaatttttcttcttgggatatttggtaatatcagaagacatcattttgattgtcacaactgggagagagggtgttgctggcatctagtggtagagtccaaggatgctgctaaatatctcagagtacacaagacagtcaccacaactgagaattgtccagcccaacatgtcaataatgccgaggttgaaaagacctgttttatgataataagccaggtagaattcatgacaattgagtttatacaccaaccagtccttagcctttgctgttttccgcctgttgcatttctttaagtgtcatttattttcatggctttgactattaactctatagagatgatttccaaaaatcaaatacagatgatttctagagagaacctcaacctctccctcgaattctagcttcttattttcaactctcaggaggccatttttatttgaatgatttgctgaccgttccagtaaattcaaagtaactgttgctcctaatttctccctctgtggctttgtcctttttatcctagatactgttattcttttcgttagccaggaatgaaactctgatttatttcctcttctcttttccatagttctcctgacttcctcgtctccaatcagttactgaatatgaatgacctttccctacacggcttttcatagtatattcctattttcccttccacaatgctgacctaggtctttttcacctaccatgtggtattactgtaatcatgttccagctaatcttctgactccattattttcctctttcaacatgatcctgcacaaccacccagttaatctcctgaactaactctttggccatgtatccttttgtagtgcctttctgccattgagttcagtgtggattgcatcttgtgtttaatattcttcaggatttggcctgcaccctgtcatcttcagttgagccaactccttgcattctctgaagtgtactgtgcctatttctgcctcctttcctttgcccagcctgtgttctacagaggatcaccctagctactccacacctacacaaaaatatcatattcttaagacctgatcttgaccatttaccttcactttagttcttcctgtttactgcgccattcaccctggtcctaagtcatatgttctttctttgtatttttatttgaatattttataggaacatactttgtcatcccaactggacagttagtttttgcaaaggataactaatacattttcattttctttctcagcacctgatatcataacttttttgaataaaagtctaactgtttgatcttggtaaatgtaatcattttgagagtttatcatgtataaaatgataaaagttgtaatgttgctgttctacaaagcctattaatattttaccaatttgcaaaggagaactaatacatttttcattttctttcccagcacctaatgtcatagcttttttgaataaaagtctaactgtttgatcttggtaaggtaaaatgtaatcattttgatggtttataatgtataaaatgataaaaaatgttatgttactcttctacaaagcatattaatattttcccaatttgaaagataatccataatctgtcgagtttctagagaatacatgaaaatactaaaactaaagtggatagagtttatgtgagtattatattcagaatcagtattaggggattaccaaaatcgttacttaaaccaagataaacaaaattaaagaacatacgatttggtggaatagaaaattgtaagtttaagggcagtggctaaaactggaataatttatgttctataaggggaatggctaaataaaattaaaaacacatttttaatgttattgatagaaaattaacccataaaaattggtgcattggtcattatttagactaatctgttaaagttgattatcgcacaatcatattttctcttagataaaagatttatgatacttagtaaaaatggagcagagatttcaccattatattatataattataatttcagtgaatcaactgcaaattcatcaaaggctatttacattctgcttcacttaaattttccagttttattttccagaatttttctttacactgtgccctgcactccaactagactgaatgaactaccactactttcttcccatgatttcccatatctacttcctctgttatttcttctacccagactgcccttcccaatagttttctctgtgtctacacaccttcctgacaccactcaaatatcatctccaccaccaacttgccttgatccctagaaataatcagacccttttctgaacacccttaaccatttattactattttgtggcacttatttcactcccacatccaatctgtgtgaatgggcatgacataacttttctaccaaacaatatttctttggggaaagaattgtctccagttatctttttttccctgatcctaggcaagcaaggccattgcaattgccgcacaaagggtggaaattgagctggtttcaaagaccagattcggaaacttgaattcattttctctgtttggtttcttctttcatacttgcttttcccacttggctggagctggggcctaggtagattcaggcttacatatagccatatgaacagaagggaaagaaaaggttttttttttctgccaaaacttttctattttagaaaaatagggaagggctttgttaactgtgacttggggcatgtgctcatttctggagcaataactgcagccaacagaatatggtaaaataattcgctcaatctgggctgagatacactccttaaagtcaaggactcctgtctgttaccgaagtagggaaaacagtgctgggcagacaaagaaactaccccataaaagtagaagatatctttcagagtctcaacacatataattattggcagtttctttaattatttttttctatttatttactattgaaattggattgcatattaaattttggatttagttttcttacttatcattatagtcagctttgttgcatggtcttatacattcttcttaacatgtgtggtgctcttcataaacatatgaggtgctttggaatagtatctcctgaacacgtcaagatatcaccaggaaacaaatttgactttaggtcacatggccacttttctgtctccatcacaccggttttctagctggtcagagtggggatagagtctaaaggggaaattaagtatcatgtgagctttgaattatgtaatgttaacaaatgtttaacattactattttctagagtggatttttgtaggaacactttccaacttgtatgcatgtttcccattccacatagagttcaaaatgtgactacttacagactgctttccagttagtatatttaagataaagaagcctacattacacaccttaagaatgtaggccatgtctacataataagaagaacatattttttaacttttaagtccaggggcataagtgtaagtttgttatgtaggtaaacttgtgtcatgggggtttgttgtaccgattattttatcacccagatattaagcctaatacccattaattattttttctgattctcttcctcctcccaccctccaccctctgaaaggacccagtgtgtgttcttcccctctatgtgtccatgcgttctcatcatttaactcccacttataagagagaacatgtggtatttggttttctgttcctgcattagtttgctaaggataatggcctccagctccacccatgtccctgcaaaagacaagatcttgttctttttttatggctgcatagtattccatggtgtatatgtaccacattttccttatccattctatcattgatggacatttaggttgattccatgtctttgttattgtgaacagtgctgcagtgaacgtaagtgtgcatctgtcttttgataagaaataacatcatacatgcaaacagctgctagcatgtctttgttaacactttttgtggcttaacatctttactaatatttatgattaaattcaatcctcttatttatttcccattatagaaacaagtagtgtagagttgtacgagactcctgaatttatttagtccaatgtttcaagcttttcagaggtttattttacaaacccatagtagtcagtcatgatactttggtttaaatacatctgatcctatcttcatcttgctatggggaactttctgtctcaccagtcagctttttccattgttaggtatttctgattgttggaacttcctcctcccaccagtctttttcagaatctactgtcaaatctgttctcatagcaattataatttttctttcagaattataattttaaaaatttgcacatttctgagaggtcttcaaaaagttcctggaaaatgtgcattatgaaaaaaactgggcatcacttaaaaaaatttcaccaagataaacttgtactaacttcttgtaacatgtctgaacaggatctagtttgagacactaagaaggataagacattggtttgaatagaggccctatcagagcaacatgaattctattaaaattgcagcaagaacaaacatcaaatttatggtgaggcttgggtagaagaatggtgagatcattgattctttatgaaaagaatggggacaatgccccaaagaaattagcagtttataagtagaaaactcattttaaggaggaacaagaagatcttaaagatgaagcctactatggcagaccatccacatccacttgtgaagaaaacattcatcttgttcatttcctaattgaaaagcctaggttattaacagcggaaacagtagctaacaccacagacatctcaactggttcagcctacacaattcttactgaaaaatttaagttgagcacactttctagttgatgggtgccaaaaccgtcgtacctagatcagctgcagacaaaagcagaactttcaatgaaaattttaaacaagcgggatcaaaatcctaaaacatttcttagaagagttgtgacaggagatgaaacatggctttaccagcatgtaccatcctgaagacaaagtacaatcaaagcaatggctaccaagagcaggaagtggtccaatcaaagcaaaagcagactggtcaagagcaaaggtcattgcaacagttttttgggctgctcaaggcattttgcttgttgactttctgaacgtccaaataagaatagcatctgctaatttagtacagtgttttgagaaagccaaatttttagcagaaaaatgcccaagaaagcttcaatagcaagatctttttcattatgacaatgttccttcttgttcttctcatcaaacaagggcaattatgtgagagttttggtggcaaattattaagcattcaccttgccatcctgatttgacttcttctgacttcttattgtttccttgtcttaaaaaaatctttaaagggaatccatttttttcaattaataatgtagaagagattacattgatatggttaaattcccaggaccctcaattctttagggatagactaaatggctggtatcatctctgacaaaagtgtcttgcacttgatggaacttatgttgagaacaaagtgtgtatttttaatttttatctacttgcccatgaagttcatggagtgcttttagatctgtctttttctctgtctgtttatctatctatttatctgtcaatctgtctacacacccatgcatctactatccacctacctaccaatcatttattcatataaatttgtttaaacacctggaaaaatgattatatctccctcttgccttctctttacgtattgctaactatactcagatatttgagtcattcttagtatgatagttttcttactgttgtccattcctgtcttattttttaatgttctggttcttttagaaatatgttatccaaagtaaacccactgttcttgctgtaggagagagttcactgggcctttccatgctgtggtgtggacttttacttccattgtagatatagcagaaagagctcagtgaccgagagcctgactgcttggatttatactctgcctccacctctcactggcaatgtagctttgggcaagtcacatatcctctgtatataatttttctcatttgtggggtgcagatataagtggtggctatcttggagggttgcaaagaagagcacttccttggccaatagtgtgccctctgtcatgaatatttccctgctatcattgtaacttaacttttgttgctattttaacaaccaaatcatgactatttgttatcacttctgggcctttaaagttgctgcttttcccacctagagcattttcccccaagatagtcacagggctggcaacctctaatcttttagcagcttgaatgtcattcctcaaaaaagcctccctgactgctggttctgcccttgccctggtcactctctagccctgggctttatttcattttctttatggatcctatcaccatctgaaattcttcactaatttgcttgattattagctttctccctctgctgaaatgtaacacatgtgagaccagagcctccttagtctcatttaccaatgttaacagcaaccagaatcgtgcctagcatatagcaagtgcaccagaaactttgttgaaaaaatgttttgggtccatgaaaacttccaaacatgtttcagatgttcagatgactttttctttttaacttgctctcctccaccccatatcaatgcaatggatatttgaaaactaaatccagaacctgaatttatcctcaataaatttgacttttcatattccattcagagttctggtattcctatattgttttcaatttaatgctagactttatattaattaagataattttatggtaacaataacattatgcatgcattgagtgtttgctacatatgaagcacttataaatttttacatataatctcatttaatttttaaaacaaccctatgaaatacataacatttttattcccatttttataaatgagaaagctgaggtacaatgagggctggtaattgggcaaagtcccacagctagtaagttatagagttgggatttgaacccaggccttcagatatcatcaactgaataattcatcagtgtcatgaggaattttctgaactttgtatgacttgaaactttgtgatgttttgtctgtatctatatacaagtcatgataagatgcctcataataataccaagcctctgtgatattccagtactttttattctggttactactgaaccaagaattattatattttagtcatattgtcaatgagttcactacccacagagctgaggacataaggctgctgtggaaaagggagtaaacacttattaaaagccaggataggcaatgtggcattcctgtaaagcactaattagtattttcagcagaaatatgttttaccaaacctattttgctgtcatttgaaagcatgttattttctgcatgttcacatttcaccttgcttcccagagtgtttacagcaacttgccacagtaacacatactaaaataatggtatgatacacaagtaagaataaaaaatgtgatctagagaaaaataagagttaaacacaagaccctagggtggaggatggtctgagagagagataaatatttaggccttaaggaaccacacacagttcccctggttgagccacaaattggtatgtttttttccttatgtacaggttttttttttattatactttaagttttagggtacatgtgcacaacgtgcaggtttgttacatatgtatacatgtgccatgttggtgtgctgcacccattaactcgtcatttagcattaggtatatctcctaatgctatccctccccctgccccccatcccacaacagtccccggtgtgtgatgttccccttcctgtgtccatgtgttctcattgttcaattcccacctatgagtgagaacatgtggtgtttggttttttgttcttgcgatagtttgctgagaatgatggtttccagcttcatccatgtccctacaaaggacatgaactcatctctattcttttattagccaccaggaagctttaaaaaaaatacccagaacaaattggtatttttttttaaagcttcctggtggctaacaaaagaatagagaagcaatcagttcttactgtcagttagaaaaagctatcccagttattcaagagaaacacagtatagcttgagactatatgtctccataggcctttttgtaagaagtattcagtgatataatttcccctatagcagacctacaatgaactgcttagtttcatgtcactgctgctcatattgtcctttgctaaaagctgagaatatgacactaaaacgagattcaaggaaagaaaatctgtaaaggatggaaaacgcagatagtatgttcaaaaggttagatagaacttggaggatcatttattcttcttacatcctccataaatacatagcttacctgggattttgaataaatgtgggcagcagaccattcaaagtaagattatctggaaagtgcttggagtttctgagtggtttgctgttggatccatttgttttagaaaatgaatgagaatacatggaggattatagccttttctggaaattaaggacctaaccaagttttttgttttttgaattaaagggccctgtccatatctatatataagtgagaaactgactttattggatgtctctagtgtttattcattccttgttccttcgtttattccttcaacaaatatttattcagcccctactatgccctagatacctaagctatagcagtgaaaaagacaggtatgatctctccttcaatagagtatacattttaagaggcaaggcaaacactaaacaagatactaattatacagttacaatcttgataagatctactaaagacaagtacaggtcggaaagtaagcacaaaaatgagaaactcaattccatttttacagcttccttacattatagatgatgttacctctaagatttttttcttttttcttttcctttcttttctttctttctttctttctttctttcttttttttttttttttttttttttgagacagagtcttgctgtgttgctaggctggagtgtagtggcgcaatctcagtccactgcaacctccacctcccgggtttaagcgattctcctgcctcagcctcctgagtagctgagactacaggtgtgcaccaccatgcccagctaatttttgtatttttagtagagatggggtttcaccacgttggccaggatggtctcgatctcttgactttgtgatctgcctgcctcggcctcccaaagtgctgggattatagatgtgagccaccgcggccggccacctctaagatattaacagccttctaatcactaaatccaatgtcctcttctaatctttagaaatgttcatattcgttggcatgggaatataaccatgaggtttaaagtttctgcttgtgcctttgtttgtagcagataaaatcttttgtttaaaagaaataaagcctacttgaagtccataaagagaaaacagatgaaatctggactgctttgtttggagatgcctcatgggaaggtgggagctctggctttccccacacttggtaatctcaggatcgtcttttcttgatccccatggtgctagtttggaagccactattctagaattctcattattatcagctatttatgtattggctccctggcagccctaaagactctgcctggactgacacatcccagtcctattcccagttctgtgccggagtctctgaacacttcttgaactgatctgagccaagaaagaaacttggacatctttggatttgtgaaatccaaactggaccctcttcatttgctgtgatttcccacccatgattacagttcacactctacttactaccaggtctccaaccaacacctcatttattagtccatctcctgtgtgtgcatggattggtgagggaaattagaaggaaaggaagatgattgcatccatcaattgaatcaatgtattctgggctccaaatatgtgctaagcattgtccaaggaagctgagggtataactatgaacaaaagaaacaaaaatacctgcactcttggaacatacattctaatggaggatatagacagtaaatacatcagaaattaaaattgtataacaggtggtgataagttcgttggggagaaaataaccaaagaaaaaggatagggtatgtcagggtgaggaggaccaaggtttactactttaacgaatgatgtaaaagattgcctgagtgagaaggtggcatttgaggaaagatgggtaggaatgagtgatacaggtgtctgcaggaaaagcattgcaaacagaggaagcagaaagtataatggagcttagttaggagcctggtatgtttgagaaacaacaaagaggtcgtgtggctaaagcaaagtaagagatgagactagaaaagtggcagaggagcagatcctgaattgtcctgtaggccattttgaggactttgggttctactctcaggaataactgggaagaagagtgacacgatctgtcttcagttttgaaaagatcaccctggctactgtgtggaaaatggaatgaagggggcaacgggaggtgcaggaacatcatttgggagtggttgacacaaaacaagcaagcaataaggggaaggaggggggataatttgttcaagtaagcctctttctctgttccatttgattggaacaaatggtacaacttagcagaatgtccagtaatagaggagaaagcaaataaaaattcaaagatattgagatagtacctgagtggtaatttaattaatggaaaaggaaatctcagaaagagatgtttttgcctaagggctagttgtgaaagatgaccctgaggctcaataaattgccttccattgtcagtggtatgtgcgtgtgtagataattaaagaggtgagaataaaaatagagggaaaagtcaaggattgagttttcaattttagagtttctatatatggagtactgtgtggtttataaaacactggtatttaatatattttattactatataaatgaatgaactacgtttcccaaacatctttctacgtgtgaagcaaaaaaaaaaaaaaaaaaaaaaaaaaaccacacagaaaaaaaacaagcaagcaaacaaaaacagagggaacaagagtttagagaagtcaaagaaatagtattcaattttctgtttagtaccatttattcagtgttcagtgtcaatgaggttatgagaaatattctagatactggagatacaaatataaatgaaacacagttcttgcccttaagaagcccacagtcaaatggaaaatatatagaaataaatagcactgtaatgtgataggcagacaggattgcttaattctcactgaaagattcagatcagagttaccctctgtgcagcttcttgatggatgatggggagggccagcatctggggttggagaaaagaaaggtgggtctcagggaagaaattccatgtgccaagatacagaggggtaaaattatgtggccttttcagtatatgaaagcagtgattcacagaacttagatgatacaccttgacaagatactcaagactcccaagacaagacactcaagagagtgtcttgaaaatagagtctttaaggagtaattcaattaaaattatggcattagtgcagactgtaattcaatacgactggtgtctttgtaagaagagaatgtccctataagaagatactcaagaattccaagataagacactcttgtgtcttgggagaaattctcatcttgggagtcttgagtgtcttgtccaggtgtatcatctagtacagaaaatagctcaaaaattgtgatagccttgagaatatattttacattacttactgtcgaaactgggactgtttttatcacaaaaaggggcactattaataattacactggaatgggtataaattaaagcagtctggggaaacccaaacatatggtcaacctaatgatacctgttttcctgcataaaggggttataattgtactaatttatggtgcaaactgggtgctaaagctagtgatgagtttctctgctagaaaaatgttccaaagaaataaaccaagacagttaatgcagagttttggtagaagggataactacttttagatggtaggtcacagaagcttgtccgaggtgaggactttgggctgagtcctgaatacaaacagccagctatgggaagctccatggcaggagtgctccagggagagggaatcccaaaagccctttgtgggagtccttctgttagagaagacctgtttggatggagaatacaaaaccaggggggcttgggagatgaggtccgagacataaggagaggctagttcatgttcagccatgtacatgtggtggggaatttgagttttattctaattggtggaagcacagcaggtgatagagcatacctcacgtactagtttacaagggctgccttcacaaagtaccctggactgggtgacttaaacaatagaaatttatttcctcgcagttctgcagggtggacctcccaaatcaaggtcctggctgagttggtgccttttgagggctgtgagagaaggatctgttccagaactttcttcttggcttttagatggctgtcttctccctgtttctttacattgtcttcctgctgaacatgtctgtgtccaagtttcctcttcttataaggacgccagtcatattggactagggtccgccctcatgccataattttaattgaattacttcttaaagaccctatcttcaaatatggtaagcctctgtggtattggggtttagatttcaacatacgagtgtttggagggacagaattcagcccacaacacctcattaagcctggaagagaccgtaagaatattcgattaactggataagaagcacttaaacccaatttctaagaaaagagggataaaaaggtatactgtttccaggtatagtatgaaggtcatgatataaaacagaaagaagctttttagaagggaacaaaaaacactggggcttacttcaggagggatggtagaaggagaaagaggagcagaaaaaataactattggatactagggttattaccttggtgattaactgatctgtgcaacaaatcctatgataggagttcacctatacaacagacctgcacatgtacccttaaaccgaaaattaaagttaaaaaaaggaaagaagccttatacagaggactatatatagccttatataaaggactatattaagaattcttgtgagaagtcattatttaggtgtcaggcatctatagccatttaaacagagtctgtgtgtaacagtcttgagctgctgatgaaagaaggtgtagaagagtgttggtgccaagatctggagtggagtggtaggatcctgacctggagcacccaggaatgactgtcctttgtgcacaggtgatagacaaaactgggggaatgaggagttgaacatggaggtatatgaggaaggctcatccgctcttcagaaatccagaaacctaagtgtgaaaacacagatttgagggcctccacctgacttggtgggatgctcttcataggagatattctcctaatgtacattacaaagtcaatctaggagtaatgtaaaagtgatagttatcttaaacaacctgaatattttctagatatgtgattttgcaaaaataaaaaaaataaaaaaataaaaaaatgaaaaaaaaaaaaaaaggccaggcatggtagctcacgcctgtaatcccagcactttgggaggccaaggcaggcagatcacctgaggtggagagttcaagacaagcctgacaaacatggagaaacctcgtctctactaaaaatacaaaattagccgggcgtggtggcgcatgcccgtaatcccagctattcaggaggctgaggcgggagaatcgcttgaacctgggaggcagaggttgcagtaggccgagatcacgccattgcactccagcgtgggcaacaagagcgaaactccatctcaaaaaaaaaaaaaaaaaaaaaagagagagagagagaaaagaaatatctgtgttaggaaaaaagctaggaaaagctaaattctggtcatttcataataaaacgaataatgaaacaaacagaaaaatattttatgtggaagaacagaacagagaccttgggcagaagtaaccatgacacgttggggtttgtataagtaataaacgctgagatatatgccttaaactttagactgtctgagatcagtttaaggcaaagatagaatattatgactaaagagcgtaaaatgaactgctgagcatgcaagtaccataaaaaggcccttccttcagaattgagctgatccatattttttctcttgatttcattttctacttaggaactcagttcttgacaggccacatatacaatgaatgtcccaaagattgcaatactgtatttttactgtatattttttatgtgtaggtacacaaatatttactattgtgtaacagttgcctgcagtattcagtacaatcacaagctgcacaggtttgtagcctaggagcataccatatagttcaggtgtgtagaggttacaccatccaggtttgtgtaagtatgctctataatgttcacacaaagatgaaatcacccaatgatgcatttcttagaatatttcctcatcgttacgtgaagcatgactatgtaagcattgagaatatgaatacacatgatttccaccaagagaaagcatgtgatcccaaatataattggtaaactagtattaaaattttttatatgtctttctcaatatctgttatatgagacacacttgtttcacatagaacagatgaactatttgttttccatcactagaatatttttcttctaaaacttttgacctatttgggattgaaataaatgacttctaaatttccatccattgctaatatctgtaattctgtgtattacagataattggctaattacctgagtatggtgttgcttttttcaatttataacagtttagaccttttaggatacagttgttgaaatatggcaccaaaacactaagcatcttatattgatcgtgtgtcaatttacctaaccttggcaattattttcaatatctattttccaaggaaagaaatgagtagttattatcaaattacacaagtggagaagaattggagtttaggtaaatattttgttctaaaatatcaaatggtcatttaagctgaattgggataaaacaacccctatgaattttgctggatggacaccataaatgacagcaaccctgttcttctgttttcatcatagtcaaaaaatgctttagagtttactacttctacatatctcatttagttttcataatggagattttctaatgcatgttttatagatgagcaaacaaattgaagatgttaagtgacttgttcaaagtcatatatgtgaacacatattgaacataacttatttggccttattactataatggtcattagaatatctttaaaaatataattttttaatcaattgacattacacaatttttatttgaagctttcaaaattaacagtaataatgttattttattaagcacttattatatttcagtcacagtgctaagcacgtcacagtcatcatctaatttactcaatctgaaggtatgccattctctgaaaatggcaatatacgcttacaattatttgtagcatagcattctacactaaaaagatgaaataaagaagttgaaattttctttatcaattaggatagctaatgatcttctgtggcaacaatcagcatgtcttacagcttaaaacaacaacgtttacttctcatccaccttacatcctatctttggtgtacctggagctctgtctcatgtcgtccccactcagagactcacgctgatggagcagccacaatctagagcctggcctgccacagtggtagaggaaaagacagactggtgaactgtgcagtgatccctaacacttctgcccagaggtgatgccagtcaccttgatcgaagcaagtcaatggctacatcaaatatcaaaaaagtgggaagtgaaatcttaaaacaccccggaaaatactggaaatttttattttagttttacttgaaaaaagtataaattttgattttctgtattaaatcacttattcaaacaatgatttattcaacagaaagcattgaacactgtatttcttttctgacaaccacttctccaattctctgacaccaactgggtgcccaacaattttattcaattctgatactacctggagttagcacagatcccccaggttaaggactcagtctcacaagacttctgctactctagacaccagacactgtacatggagtgctcgggctacccacagttttgtgcagctgaccacaaattgggggttctcatgaccccctccacccctcagtttccataattcagtagagccactcacagaaccacgacatgttctttatttgcaattattggtttattataaaggattcaacttaggaacagccaaattgaagagatgtattggacaaaacatgaggaagaggacccagagcatagatgccctctcctggcacactgccctgccagcatgatgatatgttcaccaatctggaagatcctcaaaccccatcttttagagttttgtgtccaggattcattaaggtagacatgattgattatacattgcccattggtgattgaactcaatctccagcccttctctccaacccagatgtcagggacggggaccttcagttctgttcctctaatccagtagtttttaatgtaatcagtcctcatcctaaagcaaaaagctacccttttctcccccatgagttatttcattagggatcttaaatagaagactattccttcagaagattttaggagctttgtgccaggaagctgggagaaagatttttttgttgttgttacactacacacagccatatgctgagcttggtgcaaggcacgggggatacagtggttaatggagcagacacagtccttgtcctcatgaaacttcaagttaggcaaactcattgaaatgaagatcagtctagagaagttagtaaaactgaaacaaagataaataaaacatgaacttgattcacagaaacacttacctccatatatgaataacatcaattagtaaactgggaggaggaaggaggtgctgggtgtggaatggacgggaaaaatggagaagtcaacactgaatttctaatcacctaaatcactttaagtctcatctttttgacatggtgatggtcaaagattggcacattattcttatcaaagcacaggatagggtgctaggtggaggaaccaggaaagattagtcagagaagatgccttgaaattctatgttagattgtcatctaggttatacagctcatggacaaaaatacatgcataaaatgatgcccacatggattaatggatacatgaaattttaaattcctagacaaacatataaatcaatgaattattaagtttatactagttgtatatgggactatttgatattgcttactttgttctttgaattttgcatttaggagatttgtagtatgagtttcttgcagaaatcttaacatttccttaaaaaaccacttccctaaaataatccttgaggaaacatatttgtcagaaatgttcacatcatattccttttgttctggtttatctcatcctccttgacttctccacatctctaagtaggaagttatttattgctgctgaagttgtaaccctggtgatttcgctatcaacttacaaatcacttcctttccatatgactacagcatgtaagaatgctgaggttttcttttctccaaataaggcagaatgcttcaagaatattttatcgtcctatatggatattctatacctttagagtgaacactttcctctattaaaacattaacagtcataatgagattcagtccaactggaccgagcttgtgaataaaacaagatgctccagtctgtggttcaaacattttgaacttcccagaatataattaggtatagaatatagttcttatctttctttgagaactttttgaattattgttatagtttctaaaatatcttttctattttgagggtaaggtcacaaaacagaaaaaaatgtgtatcagagtatgttgaatatggctgtttgtcagatcaagtttacgctgtgtatgggccttcgtccaatttagatgcagatggtataagggactttgaatatgctatattattattcagctgacttctccagtaaataatagtgttcttcaggaacagaaaaccaaacgccacatgttctcactcataaatgggagctgaacaatgagaacacatggacacagggaggggaacatcacatacactggggcctgtaggtggaggggagcagggggagggagagcatcaggataaatagctaatgcatgtggggcttaatacctaggtgatgggttgataggtgcagcacatcaccatggcacatgtttacctatgtaacaaacctgcatgtcctgtacatgtatcccagaccccaaaataaaattaaaaaaataataatagtgttctttagcgtctttcatgtgaatggaagttttgcagacattgtcacagcagcattttttcccgtgggtttccactaagtggtgccttcgccttgggggaaaggtgtctcagtcttattccagtctgcttcatttactgttgatgtgatgattgctgcctatgtagtatgtgactttctagggacaggcggtcaggtttttctggacccctctttctctgaggatctcttcaaaggaatagcctttggccttgagtgctgcctcgagcccacaagcaccttctcatggttgagcacaccctattgcttgactcagtgaaatacattgaatatcctgccaacactttttgttgtacatctctttgccctcaggctagctacagaaagaaaaagagagagagaatacatttttacatttcctgttcttcatgttgaatgaggcagtttatcttctgaacagctgctttgaaggtttgagtatgttcgatgcactaaacataacagcatagaaatgaaaaaaggaggttggcaaactaccttcttatcttcttttaaggcttttgaaggatttaagttgtttcaccttttagtggcatcacagagaggttgagatttcacttagagagaatggctttgatgtgctattttgtatattagtgaacaggttcacaaagatgccattctctaatcaatgctcctgctcccacaagacagaagagaattgaggaattaaggaaatgccaagaggtagaacatccagtatctttggtggagatcttgctttgctatgtttccttccttcaagttatttgatctgtgcgtgtgcctgagcatttattgtacaacagatactgtgctaaggcttttataagctttgtattgcttaatgttcatggcagccttgggaagaaggtactgttagagtaggaatgctactataatcttccaactgggttgacattaattccttaacctgctctttttgacttttcttcttcaacccattgataatctaattgtcctatatttctgtaaggttattctaaggtattttttgagattccttattaagaccattaatacggctgggcatggtggctcatgcctataatcccagcactttgggaggctgaggcgggtggatcacctgaggccaggagttcgagaccagcctgaccaatatggtgaaacaccatctctaccaaatacaaaaaattagcagggcgtggtggcacacgcctataatcccagctacttgggaggctgaggcaggagaatcacttgaaccctggaggtggaggttgcagtgagccgagatcgtgccattgcactccagcctgggcactctgtctcaaaaaacaaacaaacaaaaaaactttaatacgtgtgagtatagtagtgaacaattattatgggcttagtaagtgccaggttttatcttaagtagtttatgtgcaaacccgataacacccaaacaaccatgtaaaatagatatcataagccctattgtattttaaatgaagaagagatgataagagacatccctaagctcccactgacataaaatacagacaccaggatttgaactgggcccatcttactacagagcctcaggatttaacccccactcttccagttttcttcatggcctattgtcagagtagaaacattatttctattctgaacatgggctgtgctcaataaattattgcttcatctccttgatgataacaaaccattgcctttcttaaaagtcttttctaaaaaattttagcctagtaatttcaaaaaaaagtaaagcagtaaaatacgtcatcctgtaaagtctaaagatttgaaatttaaaagttttcaggctagagaacagaacttgatgtaatttctagaagtgaaataactcttgttaaaatcagatgctgctggtacgcaatccaaaagggattgtttagaccctagaagcttcaaataaattgagtctcagaaataggggggaattgagtcacacagttctgattgtttttgtcaacctactgaagaggaacaggagcacccttccgaaagagttcagagctgagtgtgagtattcacaagcaagaacctctggcacatcttcatctttataattccaatagcaatggcaaacaagaagactcaatgtttaacttcagatttcattagacggagagccgtgtttacaatcagctgactcatttgagcgttctgacaagctctcaatcctatctggatctgttaggttgtcttttaaaagaggaaatatttcaacagagataatattcctataagctgtgaaagtctgtctagaaatcaattgttaagcaacctatagagtttagagcagaaaaagctacaaaatgaagtaaatttttatagtggtttctagtgagaaacaatgtatgccctaggtgcagtgggccatggagaacatttattacattcttcttgtatgaacactgatatacgaagaaaataaaagctcagcttttgccttataacactacacttgccatggtacacttcaaaattcacacatgcatagggagattatttacacatgtgcaaaactaggaaaataaaataatgtgaaaacatactagttaaatgtgattgtgcagctcttttacttctattctggattggtgtttttgccaaaccctccctatgtcaacacaggtgacccctctgaaaggaacgtgccaattatagttgacaaaggggcttggtgcactgaatcttgagaaatgatcttgaatgacctccaggatttaaatatagttattgaaaggggccgaaccaatgagatgattcacagcttccgcatggagccatctctatatgctaagtacgaggccagtcctcataaaaacccgccaaggagggcagtagcaccattgttaccagcacagactcctccctttcctagctgtgtgaccttaaggagaaatatacactccagaaatctgctgcttcttctctgaaaagggcacaacaatagtcgcccattgtagagaggattaatgggataattatattatgtaaaactcactgaagtattttgtttacatagggactattcaataaacataaaaattataattattacagttgttataattccccttttacagctgaggaaactcccaagaccacagaataagtggaaaagttgaaattggaacctacctctttttgactccaaatgaagtgttctttttaataggtacagtagttcccacctattcatgagagataccttccaagacccccagtggaagcctgaaaccacagccagcaccaaaccctatatacactgtgtttttcctacatatacctatgataaagtttaatttataaattaggcagagtaagagttcaacaacagtaattaaaaaaatagaacaactgtaaaaataatcctgtaatgaaagttatgtgaatgtggtctttctctcttatatatttctggaatattccatttaatatttttggactgaaactgtggaaagcaaaacagtgaataaatactgtaattagtgttcattgataacataattttggccaagtgcagtggctcacacctgtaatgccagcactttgagaggccaaggtaggttcatcacttgagcccaagagttcaagaccagcctgggcaacatggtgaaaccttgtctctaaaaataaaataaaatacaaaattatatatatatatataatgtatatttatatataatatatatttatatataatatatatatttattatatatataattatatattatgtaatatatataaaatatatattatatattatataattatatataatataaaatatatattatatattatatatatattatatatattatatatataaaatatattatatattatatatttatatatattatatattatatataatttatataaatatataatatattatatatataatatatatataatatataatatatttatatatatatataatatatataatatatatataatatataatatatttatatatatatataatatatataatatatatataatatataatatatttttatatatatatataatatatatatgccaaatgtggtgatgcactcctgtagtctcagctactctggaggctgaagtgggaggatctcttgagcccaggaggttgaggcttcagtgagtcgtgattgtgccactgcactccggcctaagtgttggagtgagaccctcaaaaaaaaaaaaaaagtttttttcagaattccgactatatgccaagcactctgttgggtgctgatcaacaaggtagactaagtctttccttatggagcccacattccagctgcctctgacaatgcttttccccatggcactcagaatcctgattcctgagtcctacagaacattctgtaacttggtaattctgaggctgccttggggaacaagcgtaaggaggagggtttcctcagagcagaaaggagggaatgtttttcctgcaattagagagtgcagtgacagtggcaaccacagtagcctcatagagcaccagggatgacagggaagaaagtgaatgctgacctcggctgaaacagcgctggcagcttcagcagatatattacatggtacttaccattacttcatacagtgttgagagttttggctcttgagcagaatttctgggtctgtattttacctatgctgctcatgcattttatgatcctatgtgggttatttaagctttttgtgcctcatctataagattgagaccattatgatattgatttcataggtactttgcaggcaggattacctatctgagagaaacttgatttatttctttgatgcatgcaaacttaagcttgccaatgctcatatttgtgcatttttccccacacaggacagtgcagtcgttaaggcaccatggttagtgtcatctctacatgcctcagcctatctcaaggtctcctttggacagtttgcaaatgagtgcctgcctgagtctctatatctgagggagtcctctgcctgggggagcttatctgcccatgctcaagacatgagggctagaatttgtagataaatacaacagcttccttgtcccttggagatgattctcagacatattccacaatctctcagaggctccctggtggtaccaaatcccagttgtccacagcaatagtggggttgttaaccagctttcctcccttctctgtctcactgccccacttcctcaatttgctctctgggatcttcccccaaataaatgacatgctcccaaatccttgtctcaaggtcttgttttaggaggaaccccaggcaaaggtagttacagattttagagcaggacttcctcctgcaaattctgacttcattacttacagggattttttttttaatactttaagttttagggtacatgtgcacaatgtgcaggtttgttacatatgtatacatgtgccatgttggtgtgccgcacccagtaactcgtcatttaacattaggtatatctcctaattctatccctcccccttactcccaccccacaacaggccctggtgtgtgatgttccccttcctgtgtccatgtgttctcattgttcaattccaacctgtgagtgagaacatgcggtgtttggttttttgtccttgcgatagtttgctcagaatgatggtttccagcttcatccatgtccctacaaaggacatgaactcatccttttttatggctgcatagtattccatggtgtttgtgtgccacattttctgaatccagtctatcattgttggacatttgggttggttccaagtctttgctattgtgaattagtgcctcaataaacatacgtgtgcatgtgtctttatagtagcatgatttataatcctttgggtatatacccagtaatgggattgctgggtcaaatggtatttttagttctagattgaggaattgccacactgtcttccacaatggttgaactagtttacactcccaccaacagtgtaaaagcattcctatctctccacatcctctccagcatctgttatttcctgaatttttaatgatctccattctaactggtatgagatggtatctcactgtggtcttgatttgcatttctctgatgcccagtgatgacgagcattttttcatgtgttttttggctgcataaatgtcttcttttgagaagtgtctgttcatatccttcgcccactttttgaagtggttgtttgattttttcttgtaaatttgtttaagttctttgtagattctggatattagccctttatttaatttttattttgagttcaggggtacatgtgcatgttttttatatagataaacttatgtcatggaggtttgttatacagattatttcatcacccaataattaagcctagtacccattagttatttttcctgatcctcttcctcctcccaccctctaccctccaaaaggccccagtgtgtgttgttcccctctatttattcatatgttcacataatttagctcccacttataagtgagaacatgcagtattcagttttctgttcctgcattagtttgctaaggataatggcctctagctccatccatgatcctgtaaaggacacgatctcattcttttttatggctgcatagtattccatggtgcatatgctttatcaagtctatcgttaatgggcatttgggttgattccatgactttgctatcgtacagtgcttcagtgaacatacacatgcatgtgtctttataataggatgatttatattcctttgggtatatatccagtaatgggattgctagatcaaatggtattcagacaagcaaatgctaaggaaatttgttaccacaagaccttccttataagggaagcattaaatatggagagaaaagaccattatttacagtttttaaattaaggaaatgattaaacacttcattatttcaattttctcatgtctaaggaaggtatgatgataaaagctacatgatattttttgtgaagcttagctgaaacagtacctgtcaagtgcttctagaccattgcaagttttcaataaatgttagcttttattattattattattaatgtcagcctaccttaaaacttctttaaatagatggcatgaacagctgtagataactgcagggtgtaaaaattctggcagctttttttatacctgtttaaactctttgagcttaacgctcttcaagttccctgctggcctgtaagtaatagaccaatgtcagtggaggagacatgtagatgttaagaatgaactaagtttgtaaggtaaaaagccaggcttcctatatgcctcagcagatggtctgataaggacgctgagagagagtatcatgaaatagaagtgaagtggattaacaagaaaatccatgttcctggcacactaaggtgataagtaaatggttttctgtggctttgctaaaattttgaaaaattcagttagcagcaccgttgcctaaacatagtatggtatgttaagaaggaggattctaacaagcacttgttaagtgcctattgtaattaagacaaatatgatttggtttgtgctctcaagtctggtgggagagataggcatgtaaacagatgaattacagcacgaagtgctactgctgcaccaagacaggcaaataattcacttaagctaaggcagggaagaaagaaggaaggggatttttatatacttttatctgcgctgaaggtggctttacagatgaggaacccgaaactcaaagaatgtatgtcaattcattaaggcatgcagctgctaagtggggagccagcatttgaatcaaactttctttccccaaggttgtctccatcatgccaggctgtagtggtgacaggtggaaaggtgtagtgagccatcttctaggtatatctatccctgagagcaacaaatcctggtggttctctctgtatatagtcacagagctccagggcatgtagtacttagaattttgtttttgctcattgcacaggaaatggtatgaaactgaggtaattcatacacacataatttgaatataaagaagaaaatgatagaggcatctggatgacctgatatttaatatagtaaaaggaaaatgttttcctaagcaaaatgagtggtatacaatgaataagttgtggtcaggaaccatgtccccagagttttggcttttatcctttcattgattcacaacatgaatttttttttcctaaatatccttcactagaaggcagaattaatcaacctttgtaatttaacagattatttggatacaaaactaatgatatttttattcaaacatgtcaagaccttggggatatagcatgggatttggggagcaggttggttgttgggggcagtcgtctaaagaatcagtaacatttgagtgcctaaaatattaattattgtcctaccagcaatactgttctctgtccttaatgatgaattaagagattagaaaatagtaaaaaaataaaaacaaggacataatttccatgcgataatgataggactttgtgatatcacatttaaaaagtaggtgacttttatgagagaggaagtgaggaaaagaagccagcatttattgaatgcttgctgcaggcttctgtgccatgggtattaatagtcccattttacagatgaggaccctgagaatcatatatttagtgtcaaatgctttacctaaaagggcaaaagtataactagaacaaaagttcaatgcttaactctgaaaaaatctgttctctttgctacagaccatgccatcttggtgaaaatatcccaaaagatctggggttgagttacagtgccaaaggggagaggaatgtaatattgcaattagatgatgagagattgtcttaggaacactgaagtacactggcaaattttgggaagcagagataaattatgttgctaaaagccaaggaaggctgggcgcggtggctcacacctgtaatcccattactttgagaggccgaggcaggtggatcacctgagatcaggagttcgagaccagtccggccaacgtggcaaaaccctgtctctactacaaaattagctgggcatggtggcaggcacccataatcccagctactcaggaggctgaggcaggagaatctcttgaacccgggagatggaggttgcagtaagccaagattgcgccattgcactccagcctgggagacagagcaagactccatctctaaattaattaattaattaattaatttttttaaaaagccaaggaaatcatttggctagagagtgtgagcttgagaattggatagaagtaggggaagttaggctctgtggcactgggtggtggaaagtctgcagtcagcactttgatcaggtcaaacccagtaatatttttgaactcttatttttctctgtcaggtgccagcaagcaaaactgagtaaggaaataatagtttatggccttatattttagttagtttgagtacctgttgacaggtggtccaatttttgtgtttaatttagaagaaattctgaaggatgaggtttaataatcacaattgaagtagtggatatgggatcagagtctgattgcattggatacaatattccaagatcactgaatgatacaactcctgcaaaaaggatgctatgacaatataagcataaagccgcagggaagtggacagaggtcttaagggttggaaaaaggagtgggcacatttgtgaaatgtagcagagctatgggatttggactttgcaatgtacttgtacagtaggactaaagcagacaagcatagaatgcatgccattaattcttagccttgaggcataccttctcaataattaggagaatgaaaagaggtgttttttatatatccttccacctttatatatattttttattgttcaatgaagtagaaccctgtataaagaggagttcagggaatctattaaaaatccagggtaccttctatgtcctagtcagagttcttggagttgttgaattataaaaatatgacatcccaacacacactgtagggatcaaaacctaggtgtgtggcaggaagatagctcataggcaattccaatatttgcagttgaaatttggcatgaaacactgacaatttgcatcgtctgtccatccttcatgagctgatgatgcccaatgcttgtctcacatggcaggtctcacttcgtactgaaatgatgaagttacttctctgcctccaacactagattgtgtgttgcctgagggcaggagcaatgtcatcctttttgactttctggcacttaaaacagaatgtggctcatagttggaggtcagtacatatttgaatggaagaatgcatgaaaatataaacgttagactcttcccttatggttattgttttagtttataaagtagatgtaaatatagcccaagataacatagcaatttggcaattctccatgaattttctgtaatagaatatttcagtaagcacagtatacttcctgttttaactttgtggctaactgatctttagttatttgacagatatttttctggcaggcaatgcgctaaacattgggggttctctgcaactgttttttattttaagtggtaaagttgctcttttaattcaaatttgttttttaattgacttataaacttgtatgtatttatagtgtacaacatgatgcttcgaagtgtcaataatcaaatggttaaatctagctaatttaatcataatttaaatagctagatctaaccattttgttattgacacttcaaaacacacaaacacacataatgaaatggtcaaatctagctaattaacaaatacattacctcacatagttatcatctttatggtgagaacatttcacatccactctctgagcatttttgaaaaatacagtatatcatcattaactatagtctctagactgtataatagatctcttgaaattatttctcctaactaactgaaaatatgtatgccttggaccaacatctccccactccccacccccaaccaccccagcttctggtacccacccatcttcagctgtttgtaaatacctacggttgatgaggaaatgcatttgttgaaatatactgaagcctgtggattattgtaataatccttttatgctatcaaagatttactgctctttgagcttaccttagttgggtcttgtaaattgagtgttatttgagaacagaacacaggagggcaccagaggacaagaaaacgacaaccaaaaaaaaaaaaaaaaaaaccccaaaaccaaagcactgaacttctggctctagaatagagaccctgctaaatgtatcatctctcagcagtccatttctattaagtcttattctttaaaggccatgaggtatttgtaaacacgagagctttccaaactttcattaaaggaaagtgtccctttcccagacaatgcttccagctcagtcagatgcccaagcatgaccagaaggagacatggatgaagagaacccagggggtgtctttgcacacatgatgctctaaagcattttcagatctcctctatgggcccagcaagagtgctgtttctgaggaagaaggcagattgctggacggattcacaaaccacggcagctccaactctcctaccgatgcctttactccaggtgcctcagccagtagcaacaggtctccctgttggtgatacccaagggcaccatttaagaagaaataaaaaatgatgagttcatgtcctttgtagggacatggatgaagctagaaaccatcattctcagcaaactatcacaaggagaaaaaaccaaacactgcatgttctcactcataggtgggaattgaacagtgagaacacatggacacaggaaggggaacatcacacactgggcactgttgtggggtggggggagtggggagggatagcattaggagatatacctaatgctaaatgatgagttaatgggtgcagcacaccaacatggcacatgtatacatatgtaacagacctacacgttgtgcacatgtaccctaaaacttaaagtgtaataataataataataataataataaaagaagaaatagacaatgggcttaagtgttcactcacctcctgtgcttccctgggcctacggttatggctcctaggcatatgggagaggttgagtcagtcactgtggcttagaggctgcagtgccttatcaatttctggcattgaattatgactagaatttgaaaaacatcaaacatggcttccatgacatcatagtctcagctcagtatgtcactgagaggttgtagtagtttgcagatgacagtgatcaatgaaaacccaatttatttgactcaaagggctgtggatatatgtacgtgaaaatgtattctacagccctaacctgctgcatctggctctggaattccaggtccacatttctgagtatctgctagtcatttccatgtatagagccatcccttggtatctccaggggactggttccagaacttcaaaggaactcaaatttgaggatgctcaaatccctgacaaaatggcatagtatttgcatgtaacctatgcccaccctctcacatactgtaaaatcatctctagattacttgtaataaataatacaatgaaaatgctatgtacacagttgttactgtttcgagaatattgacaaggaaaaagttctgcgtgtgtttagtacagaggcaaggttttgagaatattttaaatccagagctggtcgaatccacagatgtggacccctcagatatgaaggatcatctgtttatcccaccatctcatactcaggatgtttaaaatagagctaatagctgtttctttctcaaacccagctcttcttttctttgtttcatctaaattaagtagcaagaccaagttttccaggctggaaaagtgtaagtgatcctcaactttgtccccccaccttccattcctatcattcagggggtcacctcaaccatctcttctatttatacctttcattcatttcactctgctatagagcattttgaattcaggatttatttacctcctttctaagtaagttgaatggcctttctgtgctttttctgttctggtcttcacgtaatccgcttcacattctttttaaattcacctttcccaagattcatcattgcttacaggacaatgtccaattccttagcattacatgcagtccatctatctttcctaccttagctctcacttcacagctcataatccctctcctccccaatgtacacaaacacacccacctttccactgtggttcatcttctggctattggttatattttgccttcaattacctctgctggatatggaatagcatagaagttatgcacatgggccctagaactaaactaggggtctgcaaactacaatcagcaggacaaatattccccaccacctcttttcataaataaccatttattggaactcaccaaggaactatggagaaacaaggaagaatttcactataaaagacgccagaggaaaaaagagtacatattgtatggttacatttatataaatctaaaaaatgcaaactaatctctagtgacagaaaacagaaccctggctgctagaggagcagggagaggaagggagtacaaagagccatgagaaaacttttgaggataatgtatatgttgcttatcttgattgtgttgatgttttaatgggtctactcatatatcaaaacttataaaattgtacaccttaaatatgtgcagtgtatcatgtgtccattatacttcaatttaaaagaaaacatggaaaacattcagcatccagtgtccccatagcctcagccacagttagcccgaagagttgcttgtgtcttgatagagagaccactgaagtaatttccacagttcagggttatcattccattgctagttctaagaatcttacccttttcatgcctttggtctctcatcaaagatgtaggatggctggacttactaatcttcaaggcacttttcaaatttctagagtctctctgtggggcaaagtggctcacgcctgtaatcccagcactttgggaggctgaggtgggtggatgacctgagatcaggagttggaaactagcctggccaacatagtgaaaccccgtctttactaaaaatacaaaaaattagccaggtgtggtggcaggcacccgtaatcccagctactcgggaggctgaggcaggagaatcacttgaacccaagaggcgtaggttgcagtaagtccagatcgtgccattgaaaaaaaaaaaaaaaaagaaacaaagaaaagaaaagaaaaagaaaaaaatttctagtctctctgatctccatttaacatgttcagtctacaagtattttggtggtacctaaacttattcaggcagtatgtctgtggtctataaatgtacataccccacctttgctgtagttgatgcctctgctgctgaaatttgtttcttttctaagtgttgcatccctctttgaaacagcaggggctcacctggcaaaacagtcctgtaagcagtagtggagaaacttggctgctcactgttcctgttttgagtaaattacccttcttaattgaacattatatgatttggcttcccaaatttgtgttcttcttttcaaaaatctaacagtaatagagtgtatttagttaggttcaaaatcatattttttaaaaagaaatgcaggaaaaaattcaaaggatgtttaatgagaatatgatagactttgaaatggaagatatcaccaggaaattctccatttcttaggactatataagtgacactgacttcacacagtggttttaaggttgagtgtactgttacaggaatatgtaagctgcttaaaacatttcacaactcatggtcagacaatgttcctttgagaggaaaattcactggcgtttctcaaaaacctgactgcttaaaatccaagtgacccaatgctggccttgcttatttctagggaaagttgccttagcaacctactagcattaagttgcttaaaggaatgtgtgtttaacattgttataagccagaaacagagaaaacagttaacatttagacaagtgattattactggcatccaggtaggctgttggaataaccaggatatgagttgctaatcgttcatttattaatcttcatggaattaaatacagaaaggatgaatacagaggagatcctgtgctggacacattctctgtgttagttcatttattcgtcaccatatccccttgattaaagtgatgatgagtctttccattttgtaacttggagagactgaggctgagagatgtttagatgtttgtccaaggtcacacagctagtacctgctggagcagaaatttgaagccatgtctggctcattcaaaatcctatgttctttctcacaccctgctggctcactacttattgtgaggcatttgaatgatcattcagctatttcctttacctgatgtttttagtttgctggcttcagtttcttagaggcaccctattgggccacatgagagattatagaattatgttgtgatcatggtgggctattatctctgcaaactctcctgacaccatcagtgcaccaggaaggttggataatcctacgtggatgtggagaaatctcaacctttttttatttgacattaggatttttttttccctctaggtggtgttttcactgactttgtggattgcaaaaagttgagtttattttagtttaacagtcaagaatgtggttctttaggacattttctctttagtgtgcctggagcttctaaatcttatttaaaccttctttttgaaatagatgttgcatatctttggctgtaagaggaagtcaggacttgttctctctgcttccagacccactccccagccatgtagactttatatttgaaggtccagagtgatttttcttttttttttttttttgagatggagtctcgctgtcgcccaggctggagtgcagtggcgcaatctcggctcactgcaggctccgccccctggggttcacgccattctcctgcctcagcctccggagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccagagtgatttttctaaggcaataatctgaccctgtcattcccagcagcatgtagaaaatcaccttgacactccaggtacattcaagtgggctgccccagaggtcatggaacaaaaagcctcctagaccaagctaagatgtgaaattataaattgtttattaaatcaatttaaggtacactttaagcataaatcaaggggaaagtgattggttcaataaacacaggagagtgtgcaagtgggatagaaagactaccatatctcaatccttggttacacaatgttcatctaccttggttccctctctgccatattagtcttccctgctgatgaagtagttacaagaaccagagttgagattaagaaagggatacaacagctgggaaacactggtcctgttacaccattgccctcctggggagacacaagggcaagtatatctggccatagctatcacttgccaattagcctggtgactagatatatgttttatctctatgtatcaaccagagcaaatgtggggccagaatgggaccaaaatggatgtcaccaatgggttgaccagtttagggatgaaggagtcaacagagattgtctgagcttcataaatatttaaggtttactctgtactttcatccctttctatggggaagtaactctcttatttcatcctttttatctttgttcagcacacacgtgctctttttattttctctatgtctcacagctctcagagattatcaatttgctccctacgctttaatccattctataagttccatccaactttttgttgcttgctatgacaaaatcgaataatcttaaataatgcagcaaacacacgttgcagcctgtttaagatattttaagagttctttttgatctaggagataaaacacaaagttttcagtacagcaggttcttgtaagcaggttcttaaaatctcctcctggctacatctttagactcatttcctacctctcataaaaatgccctccactaccctacgacacggaagtactcgacatttgctgaacttgcatgctctcttaatctctatacgtggcagtttttaaaatctcttgtctacctggagcactagttctgcacattcattaaaaagcataagctttgctttctctaacaagtattacttgaacaccactatcttcttaaccccaaactcagacccaaatgtgcatgtatatatgcacacacacactcccaatagcttctctctttccctgtgttccttaggtataatgcaaagaactcatagtagtattaaagcacttaaaacattgtattacatttttatatcactctctactccattagactgtaagtaactttgatccagggatcaaaatatatttctccttttatctccagccactagtcaatgtccagtgtgttataaataagcagtaaatatttgatgagttgttgagttaatgagtaataacaaataaatgttattgtacaacaagttggcagatatttgttccttgaatagaatgatttttataattgtcatttacaaattcagtttagatgggatatttttctcttatttcttcccttgaacgttttcccccaactaccgtgtactcccattactagatttttttataaatcacttaaatatgtttttgtaaattattaatagcagcaagtagtgctgatctgttgggcacctaatgtgtatcaagctgtgaattagaacttgtcttccactggtcccaagagagctggatcagttcacaaccctgcataaatggtagctaggattatgattcagtaggagcatatgtagcctcaagcaggataattagttgtaataagcacataaccacattttctccctgtttctgtgttaggggatggcagtcaattcacactttgaatttcaatgtccataagctgcatttaaatacattcatataaatgcatgtcaagtaactaccatgtctaggccttggactagattctgaaaaaaataggcacaatcactggcctcgtggagttcatagccagcatcaccttaaaatcaatgagaagtagaaagtcaggttattgagaccaggatgatctacgctgcatctaactgggggatattaagttctcacagacattacaagcttatcccagtcaatataagctcactgtataatcaactacctccatatacaaatgtcccctcctccagtggcatgatctagggctggcagggattcacctttccttacccgtggtgcttctcaaaattcccctgctgcctcacccagccacccccattctcacccagtctaagtatcagttccaagaagcatttctagttcctctacccctttgttttccgcaaaccttcacatctgctccctcagaagcaccattggttatggaggtctgatctgaagttctacccatcactcacacattcatcatccatccagaaggcagttttatataaacccagataagcttggctttgcatctacttagtagctatttacccttggctgagataacttaacatccctgtttcttactgctgtcatctgtaaaatgggataaaaatgcttacttcccagtattctggggattaaatattaagctccagtacaaagtgtaacaatgactttatgcgtcattatccccgctggtctcccatagctgttctctagcacccctgtgccatctttgggattgtcgagttagccctgaagtggcaaggaccctatttcagtgctcatatttaaaaagcaccaccatcagcaaaaggggtgtagagaggaggcaccatttagaatcttggaaaatctgaaaaaacttgcttctaggccagagagtagagagaactgtgagattgtgtgctagccacagtagaccaatgttggattggagatgataggtcgtcttaatggaaagtgtgatggggagccaatgtggcacagtagctcagagtgtgggctctggagccaacataagaagagttaccctaacagaatatagaccacagagttcttcccttcaagtatggattcatcatacatccttcaaacctgccaagtacttcactttctttctctctaccaacctgcttcttaccaaccttctaaagtcctgttcttgattcaccctaggctcacctataaccttcagaagccctgtctctgactcttaactcttcctgtcttaacactgagcctctactttcagctttgggagccacaatgagtgtttcagagctgaagaatatctggagcccatatgtcagacatgaaagatttggaaaaacagaaataaaaaagttccttgaagtatttgaaatgatttattcaagtagggttgggacctaaaaatttgccaaatatatcataatgggggagtagtaccaggaacgtagagaaaggaagagaaaaattgatctcatagaaataaaacgtagaacagaggatactagaggctgaaaacaggagggggaaaatgggagacacagagagatttgataaaagacacaaaattacagctagatagaaaaaataagtgctagtgttccagagagctgcaggatacaacaatatacagtttcaaacagctagaaggagcatactacatattaaatgttccccaaacaactaatgataaatatttgagatgatggatatgctaatcaccctgatctgatcaatatatattatatgtatcaaaacatcactatgtaccctgtaaaaatgtacaattatttttcagttaaaaaaggaaaagaaacaaaaaaataaatattctgagaagatgaccttaagagagatgttggaagagagggagggttgggaaaatgggagatgtctgagaaataccctagaggaaatttgaaatagaaaaacagagctgaggaaagaaataaagatgaatcaaaaattaaattggagttatatgatggttcagggagcaacacatgtgtagagaaggaaatgagaggctggaactttggggaatcccagagttaagtaatagacaggggaagaggcagggaggggaggttgctcatgaaagttcatacatgtgggaaaaccatggacagccatgtcactgaagatgggagtggctgctgaagcctaatggtgatgaagaagactagaaaatgttccttatgcttggcgatttgcagattattagtaaccagatagaacagcagagaaaataactagctgccaaaaggttggtggggagggcttggagggcagaggaacctgggctcagcagcagtcaagggggattctgtgaagtctggggggagaagcaccctggtgggacactctaaaatgtcaaggtgaatggagaaagcaagggaaagaggcagggttatgaggagggcttctgtgagtggagtgaaatttaaggtgcctaaagaaagctaacaggaaaagtctgaaggttgagaaaagaagcaagatcactgttaaaaaaaaaaaatatatatatatatatatatatatatatatatatatatatatatatatatatatatatctcaaagaatctagaaaaaggataggaagtggagtcagaggagagtttagtcttggacaaggtggcagggtccttactctaataacagaagcaaaactgtggattaagcttataaggaagggatttcatttatttactcaacaagcatctgagtgtgtagatgcagacatgggcattttagacctggttttcaaggtgcctccaatctggttggggatatggataactgaagaattagtttgcaacagcatgagataaaccatgagggatgctgactggggtgttgaagggtgagaggatggcaggtggtgagagagacattccagagtttccttgtgagttacaggtttggttaggagggaagtggagctaactgttgaagaatagagattggccaaatctctggaatttcagaagcatcaactttgggaaacggaatttgctaatggagtggagtctgatgcagttcttcacttattttcttctggtatgcagaccaaaattatctgagaatgatcttttcacttctggctacaaaaatgcaagccaccagtagaaccacaggcaccagtttacagtgtagagagcactggactgggagtcagatctgggttgtacttatgtggtcatgggaaattccttcccctaggtgcagggactcaggattcgctttagtaaaatgaagggttattctttattgttctcagaaaggtggtttgagaatcacctgtgtggtgggctaagtattgtttcctaaaaatttgatgtctacccggaacctcagcattgtgacctgatttgtaaatagtgtctttgcacatgcaattagttaagatgaggtcacactggattatggtgctccctgattcctatgatggtgtcctcatcagaagagggtacacagagatgaagcccatgtgaagacaaacagagagtgaagtgatgcttctgtaagccaaggaatatcaaggattgcaggaaacccccagaaactaggaagggacaaaaatgattctcccctggagcctttatgacctgctcacaacttgattttagacttctcaccagaactgaaagataacatattttcgttgaaagctactaagtttgtgataatttgctacagcatccctaggaaagtaataccacctgcatccggaatatcaggaatcttattaaaatgccacttcatagtatccatcccagatcttctgaatcagaaatactgagactagagccctgagatttaaactattaacattatttatgtttcttatgaagttttaaatgtgagaaccactggcctaaatgatgccttaacagctctgaacaatctgaaagttaaaatgacaggactattttatgcatatagacgacatctcccccggtgaagtgtgttacttcccatcctataggtatcacaaacagaagtatttattttattaaatacaaaaagaaccagatcgcttccaaactacatgcttctaaacactttcataggttttgtgttctggcagcattttaaagataaaactattaagggttttattttttctggagaggtatttgtctctgagcagtttgatgaatatttaaatttcttttaatctgtgttctcccatcattttctgtatatgtttctttcttatctcattttatctggccttattttttttctctgcttttattcattttctgtgtactcagaaattaaaggcatatccattgtatgtttttatttaatagttttttactctttatcctgtacggcctgtggaaaatatttcactatgaggattagtcattgcatctctgaaccatccctgatgcatctcttggctaatggaggctgtatagtgtagtagttaaggacaaaatggaacgaggctacccaggtttagttccagcaattaggttatgcaacattgggcaattgactgaacttctttctgtgtcagttttctcaagggtaaaatgtggttgttaatgggacccatgtgttagtccgctctgctcagttatgctgcagtaacagatgcctccctggaatcctagtgacttaaatgagcagagctttatttcccaccggcattaatattcatcctagttctgctgcagtgcttcttcatgcctcttcatttctggaccctgcctgaagaggcagctctgatttgtcgcatcctggatttgtggccaagggaagagagctagcagagccatgtggtggccctcagaccttctaagtggttcacactatttctgctcacattttcttggctgtgaagcacataaggcaaaatgcctgacataagaggcagaaaatgtaaccctccagaaagggtggacctattcggaagaggctggtaggaaaagacagcaaatattgtcaaaaataatgtaatcaaccacagcaactttatgggattgacgtgagtattaagtaagttaacataggtaaagcacttagaatagtgtcttatgactattgtctggtggtctattattaacggggtcttgtgcaagtatgtgaagacattaattctttatttgagaatccaatgtaccttccaaggaaagtgctatttagagttgagaaagatacagaaatacaggtcttggtctatgccttatggaatctgtatactcctccatgaagaatgtgaagaggaacagacagttgatgacttccagatggcctgagtgcccaccagcagggtatctagtggacacctctgtacctgttcttccacatgattggtgtttatttgttcaactcccccagcagactctaagctcctttagaacagtgagtgtatctttttcatcttcgcaccccagaaactttcacaacacctgtctagtaggtcatcaacttttaaattaaacccctccttctttatacagtctgaaagtggggtggtaatttcactctcttaggtaagaacagttttcttctgcttgatgccccatgttaatgaggaactcagggtgcatggaggaggcagtcagcagtttgaagtttacatccatactgtgcccaaactgttgcacagaagtatgaagacagcgcatggaaattagtcctgtttgccaacatagtcggttttgcatgcgtcatacatggccaggcttgctgtattaagagccagctgcatttaagtcttacttaaggggaaacaaatacatttgaattgaaatacacttgatttatttttgttgatgttctagttttaattattttctctatgtgcatgtcttgcaagttttatttttgtggggactataaggatatgatatttccagggagacgaagagctataatttctcaacttttcaaacctacatacatattattttaggaaggacaaatctcatcatcttagttaacaagaaccagaatagagtgatagttctgctaatctggcctcctgggtcttgcagttgcatacaccagatgctaagaggataagacagattagccaggagtaagaccattctgtgtggcagctacctctgtccacagtgggtgatcagctaatgccatcaagctcataagctgataggccttgtaattaccatgccaaagaggctgcaaatatccctcttttcccaattttaccttatatttagtactttctattgtaggaaggagatgctgcaaacaccatggaggttgatctgaaaataccgtattcccagaactctttgtcttgggatacttctaaaatccaatgactgtatcttcatatctatacataaagtcccccatccagatgggatattcatccagaatatggcagatagaacctgaagggtctttgggtatcaagagcatatcacttagcttcttacttgaatagacttacgctatttaagaatgatcgtaacctcattcttggcagtagagtgaattagacaaattaacaaattagagttcccaaaagtcctccatggttcagagtgaagagctatgtgattgtgcttagagacctgtgctacttcctcacaaccccaggagtctggtcagtttttggtaatttacaaccatggtccctcagcctgccctgagtgctgacagcagactactgccttctgtactctgtgggcttcatggactctaggtgggtatttaggttaatgggaagtgatctatctgtggagtcaggacaggcagctatctaggttaatgggaagcaatctatctgtggaatcagaaagactggattctttatttaatttcacaattcaatagcttgtgagcttgtgcaggtcacttaacctcttaatctcatcctaggtaattgacgttacctacctcatgcggttgctgtaacatttgagttactgcatgggacatgattgagtgctatgtaggttttatcttagtttgagttcccttgagagcaaagcctgagacaaagacttgggtgagatagtttttctggagtggtccccaaaagcagaagtgaaggagcagggagagtaagcagtgcagaaagaaacaccagtatgagtgtccactgtcaagattcctgctctaagcactgcataggtgggagagatgaaggtgttgccatgaatgcctcccaggattttctgcttaaaacataggaggttggagtatttattcattggctcccttcccctccccattctttgatatttacccctagggtattcttgccctcactcccatttcttggttgctctttcttgcaggcagggcaggcaccctagctttagagaaggcccaagggctggccatgcttgaagtgggggaccatcaaactgtctgagctcacaataactgtcacctgctgcagtggctgaaatctgacattggctgagggaatatgatgccaggcggcacgtgatgcagggtctgctggaagcgcatacaaatatgatatttttcatactcactttcatttacaatatacacatttaacttttttttttttttttttttttttgctttattaataggttctgtatgctaggcctgtaccctggtcttacaaatactttaaagaaagcccaggttatactcttcattatcctcctagaattagattttctgtttcataattagcaatagtctcccatatcctccatgccctttacccagcctcaccctagtcctctttcagtcctgagacaggacaactcagggatgtaaacatggagaaactgtgagaacaaaccagagaggaaggatttttcagacaggctgactagggtttgagtcccacagctgtatgaccttgacaggtcacagagctttgctctgtctcttgattcctaaagctggggtatagtagatcagctgcatgctacaaaactaaatgagaccacgtatgcaaagcaactggtacttctttatatatggtactttcattcccctatcacttccccaaaaagctgcattttttctggccaggaagaatatatattaaaaggaaaagtagtgacttcatttatatctatctgctgcctgatatctttcagctccaaatttgtcaaattcactctactgccaagttccttctgctcctcttccttctccccctctaccctccataaatttactctcctttaatttattcatccatttctatgtattcacttattaattcaattatatgtatttactactatatggaatgctttcctgaatcggttcaatctgtcctattgctaaaatacagtctgcagctctcttcagctccccctccatttcttctctccccctcaacccatccactcatttgtttatttaatttattcagttttatttatttgctcactagtttttttccaatacattgaacaccctcttggtgcaatgtgccatgcttagttgttggggattacaaaggtagaatattctacctcaaagggcatagaagtgaatttttttttttaaaaaaaaactacaatacaaggaatagagtggtcatttgcaaaataaaatttttattgaattgctgaagcagtaaactctcagctgggagggtcagggaaggctgaggagggatggctgcagatagaaaggttataaaagtaatagagggagacaaatgtaagctgtattttgcattccttgattcctatttaaagcaaaatattaattaatattaatgtactagacctttaaattcataattggatatatatttttttctgcatgctagggcaaaaaggtcaattcacaagaatacagacttaaattagaaatgtattaggggatggtaggcagcaggtcttatggcatatcctcgttagaatctctttagctcaatcacattcagcttcaaaatctgtgactttagtgataaacagtaagatcacacgatcagactcaaaagcactataatacctaaaaatcattgtaagaaatctaatttgtattaatcataccattagaaaagtggagaaagtttcagtatctgttataaagtttttttaaaaacaagagtagaatcaatatccacaaaaggatcttcctgcctatccctgagaaaattgcccttatctcttgaaaagtggtttcatggagagagattatcgcaagaaagcttgagcctgtccccagcttaccactgctgagcactgctgtaaatttatggcttgaggtagaggtttggcaatacattggggacaatattctttttcatcttctgaggagccatttgtttctttggaggtatatctgctccagattcattccatttcaaaattgagatgctccattctctcagccaagatgaatgggttcattttacactgtgatcacaatttagagatgctattgaatgggctgccagtgtttgctttgtaatgttaggggcactcttttttctagtcttaaggcataggttacagcacataacagaaaccatgcaggaaagacaaaaagaagaaagagagggagggaaggaaggaaggaagaaaaaagaaggaaagaaggaaggaaggaaaaaaggaaggaaggaagggaacgagggaggtgggtgggcaaatagcaacacccaacaatcctgtatcatcaatagatagttgtggcctgaggtataaattaacactattctaagaaaaatcaggcaagcagtgaactttgattcatacgtctcagcagcaggaagctgccgggagctggttatcaagtgtgactcataggagagacacaataccagaagtagccttctctggctagtaggatcaatcatgtcttacttttttctggaatctttcccttttcagtgaggctgttttcatctacccagtttgtcagagcaaaccctaggaatcaacactgatttctctctttacttctcctactaccaattcacctcccaaaccaatctccaagtcctgttgactccacctctaaaatacatcccaaattttacaactttcatttctactgtctcctagttttagcctaaatcattttcatctcttttctttaatagcttcctaatagatcttgtttccattatttcacttttggtctaatatacctacagcaaccagagtgattctcaaaatttaattgagattatataatctccttacttaaaaccttccaagagcttccagtatgtgttgaagagctttcaggtttgtaccatgtcattaggacttcatgtgatctggactctgcctacatcaccagctttgcatgattggctccttcctaaatgcaccttctcagagaagccttctctgatcatctcatttagtatctttctacccaaccaactgctcaggacaagagtagagaagtcacctcaaagaggccttcctggaacattctacaaagtagccagtcctcagtcctcactccctacccccaactgcttttcatcgtattaccctgccttattttagatagggttgacagaactcaaccctatctaaaattatctcatgttccttaatttgtgtattgtctatcagattttctcaccccaaagtagactgtaaaccatgtaaggcaggacccgttctgtcttgtttatctttttatcctccacaatgaggatcagaatgagcatcagaatgtgaccacagtgcctggttgccttctgatgctcaattagcatttgtgaaagatgtgaatagatagtcttgcaaaaccttggcagaagtgagtaacagtattctattaataccctgggaggctgaagtagaggatgaggcacggagaaagaggtgagtagtccatcgttgaacttgttatatgtggcagtctcaatggtatgtttgcttattaaatcctgataaatattggtggcatttttagtaggttttaactagaagcaggggctcctggagggtgctcaggctgaatagctgggtcacttgtctttctcacacctccctgggagacttctctgtagaagacttcaagaaaaatccctgcaccttccacacctgttgtaggaggtatggcagctattcctgagccttaagtactccagtaagaatgaaatgaactatttgaggtgttctgccaaacgggctctaaaaataattatgatttaaaatgttttttttttccagtgaatatgaacgctttaaaactaagtttgtaaaaacaaaacaaaacaaacaaaacacctcctcaatctctgttgggttagacacccaaagaaagcaaccagaagctgaaattttgtggacagaacataaaacgcctttttcctacttctctgtcctcctcttcttccttcagtcctgttctttttccttatcatccctgcttttacttgcctgatctgttttgtctggggaggatgcctaatacaatgtgtgatgctatgggcttagtgaaatgcttgtcacagctcagctagcctagccaaaggggctggtggaagcaaaggtaagttttcttttttgacatatctttggtttccttcaaatctaacacagtccatcattttgagcatttattaaccatatcatttagatgtataattataggcatctttcactacgcctttctaaagagggtaattttcatatattttatgcattgtagaaattttggttcatgtgaaacatagtttgaagggaaatcaagttactgtttcatttacctctttgaataaatagaaagatgttcaggtaaaaccaagtgattatgatacagatctcaccccctccctccccaacctccacccaagcaaaagtttccaatggttccccatacacttttggaaacagagctttgtggcatatggaaggaatttctaccccctgcgtatgagcaaacccatctggtttagttggtttggccaggtcttagaaatacattgacaaacacgtgtatgtcaggggtaacttgtagtcttgctgcttatattgctcctggggggaataagaaattcatgtaatatgaacagtctagtttttaagaaaactgaaataaattaaaaataattaaaatccaaagttcaccttatgaaggtgtgtgcctttaataatgctcaaatatagatttttaacatacactctgattttctgtctgccaaaagagggaaaaatctgataatagctgagtgtcatcttcctccaagcaatcagcaatgcattatttcctaatattgctgtttgatttcattattggttctggcttcttaaagaaataagggttccatagggttactgtaggataggtcaagaaaaacaatctagtcagtgtatttcatccatgatatcttattccgtattccccattcaacagagaattaggccatcttctgtgaagcaaagccttacctcaaagagatggtgctaaatgagttttcaatgaggatagcttgtgtgagcatttgggtggtattattacccaagggattcattaaaggctctctgttctacaatagtaaacaattaaacactctatttttacaaagttctgcatcccagaaatcttttgcatctttattccaggcatgagtgtcattacctgggaaattcaactgaggagtgttaggtaatttattaacattctctacttagatccagcagtgatagtttaagcagcctcaagagaatcaaaggatttttttttgtgatcaatatttattacttaaactataaaagagggaaaaatacatgtaatacatacaactaatatgtacccagttgcagatcataactttcctagttattaaaaatgcaggaaagttaatggttttgagacgtttcttaagttctcactagtttcattttaaatttcagtgttttcttctttttgtctgaaccatcctttacttacgtgaatcactctttacattcattgcttcactgatgctacttcactgggtttttgcttgaataggccagaaaaagtcatccctagactacatcatcaagaacagttttgtatatttcaaccttcagcttgtgtctgcatcttgcattacttatcaattcacttttatgcctgggctacttattaggtttgtttctcctctctctttgccttgatttcccgctgagtgtaaacatcacttttcctctgtagaatgagttgaccttttgacttgattaaggataaatgccattgactctccacttctggaggccaagggttttacaaaatcccactgggacttatttatttattgtttgaaaatgaatatcaaatactattccatatcattttaatgagatggatgtgaatctttttttttctactttaagaataataagaattgttactgttggaggtatcaaatgtaactaaatagtagggcatgagaagcttcagttttttgggggttttttgagatggagtctcgctctgtcatccaggctggagggcagtggcgcaatctcagctcactgcaacctctgcctccctggttcactccattctcctgcctcagtctcccgagtagctgggactacaggcgcctgccaccatgcccggctagtttttttgtatttttagtagagacggggtttcactgtgttagccaggatagtctcgatctcctgacctcgtgatctgcccgcctcggcctcccaaagttctgggattacaggcgtgagccactgcacctggcctggtttttttttttttttttttttttacatttttattcattggccatcacattccaaagttttacagtcaaatggacagttaaatatttgtgtttgaatctgaccactgtgaatatctcaaggataccataagagctgatggacctccaaacgttagcatcactggactgagagaaagctcgttttatatctctataggtactgtcataccaatgaagcaatgttcccaaactactatgtttgtgttagtcattttccgcttatcttgtccccaatcataaaaattaagcgatgtacaaaaattgcctaaagaacagatgccaccttatagaagatgttttaaatagcccgtacttgtagcagttctgccttcatagctaatattctccacgtctttcttcacttttttctttcttattgaagcatttgcatgtagaataaagaggataaaaacataaaaaaacaaagacagatttgttttttctgagaacatctgttcttgttataaagaatccacatgatgtggtccattttctttcaatgccctcactgttggctgttgtgatggcaactgttacatcaatcttagacctgaacttaataagataatgaagagtagtatctaatcagttgaaaatacagggaaattctgttgtaatacatacattttatgtaatattgagacaaacatacaaagcaagataagctgagatgtaatctaaaatggtttattgtagaattactttattcctaagattcattgctctcatggcatcactacctaattttgagtgcatttggtcctttaggtttccttactaaatgttcaagattcttgtaaatttgggttgcccttgagctttgggtgcattctgaaaattattaaatataagtcatttgctgtgtacattgtaattaaaagaaaatttttcactttgaaactctgtttatttttcaagaggagagttcctccaaacttgaactactaccatagctcttataaccagcagaaaataggaatactaattactcaaaattaaaaggtgtagtttgaaattacctagagatttatattcccctgtataaaatgtcttcagtcttggagaggagggaggagtgtagctagtgacagttacataataaagctttcaaaattacttagataaaatatattgactctaattgatggttaccatagaaacagacttatatagacattgattattcaagcactcattaaagctcctactatgtacttggccctgtgctcagtatatgttggagccaagtatatggttttccaaactatttcacatatatccatagggatatattagccacttatatgttatatcattttatttcctagtcattttcaggaatggggctttccacatatagattgactaatccaaaaatatttaatcagcgtctttcttcatgagctcagctatcctcctacaaagagcaaacttggtctgtcttctgcttctatgtaatcttctttgtcttttaaatttgcatttcagatcaataacgatatacatcctaaaagaatgtgatattttcttcctttattaactggatcattttaatgcctctttgtctctcttgccatctttttcccctaagtacaattcctgttacccctgattctttatagggttcacttgaaccttagcttgagcatctggagcatggatctcttgagacaacttggtttattcctctatttagtggcactttatattagtcatgcttttgtcctgaaaagtttcagttttggaactttacatcatttcagtttttaggtatttggatccttttggaggatgatgaacaatgggaaaattctgggggccctcacattcccttcaggagcattatttatgatggggtttaaaacttgacagtattactattgtaatgcttactattgtgatttctatggtcgtgaatcctagtaggaccctgtgttaatggaaatgtcaagttaaggcatatgtgttgcaaagttcttttctcgtcctattggtggatactctctaaaagccagactggtgtatcatgccaaatggccaaattattctatagaaaaaatactatggtaaatttcctatatcttaaaggaattcgtctggattctaaaactttgagagattaatgactgctaactacagcttcctgtaaatgattgcttactgccattggcatttgaaaaccttatatctaagataaaagaaggcactatttttttcattactgtaccattatcctttatgtttgaattgagacttttgcatttggggactcctacagagaatccactggatcagtaaaattcgaatggactttgggtggaatataattccttgaatgctgctgggtcatgtgcaccagtgtggttttgacaaccctgatgcatgagcactactttcagaattgattctaactttggcacttactaccatccttaggcaaaggaccagagaccttgtatgcagggcagaagctcaatgacaacgagtggcacaccgttcgggtggtgcggagaggaaaaagccttaagttaaccgtggatgatgatgtggctgagggtgagtatgactatggtgaaattcgtctgtcttttctctcagtcctctcagtcactgagtgagcaaacagtgttttgcaaaaccttttattttgcatagtagaagtcacaaatcatgttttctgttgacaaactcaggcaaggctaagaaggtcttcctctgtattttacaataccttttcatcaatgtgcgttatggaaattacctactaactataactacatatttatgggtctctctccttaggcgtagagtatgtgtctggagaacagatgtagggttctacagatccttttattattcaatcattcaaaaatcacatgtcaatcatcctcccatatgccagttccttccatcagtgagtgaatcactctctagtagaagagatgggcaaaccagaaattcagaacattacaggtaaaagtaagtactaaaacagtgcatgatacttagaaggtgctgaataaggtttggtttaattaattacttatttaatcattattaattatctattctgcactacacaccattttacaaggcactgataatacagtggtgaacaaacaagcaaatctttggcctggtgggatttacatttagaatgtggaaagaaacattcagagctccacacaatcaataagtatttcctaagagtctgttctatgtcagcagtatgctagaattgcagaagataaaatggaaacagatgagattacctgtttcctcaaataatgaaccaattaagcagatcagataggactctggtatttgaaaacaggaccaaaatatataatgagattctaattttgatgggtgagattacaatttgtcaatcagaagagagaattacccatttgggctggagaaatcaggagtggtttataaacgtagatcttcagactgaatttgatggtggatgtaatttatgaaggctgaggtacaagaaagagggtatcatcaagtgccattttacatgctatatcttttttttctttctttcttttttttttttttaagacagtcttgctctgtcgcccaggctggagtgcagtggcgcgatcttggctcactgcaagctctgcctcccgggttcacgccattctcctgcctcagcctcccgagtagctgggactacaggtgcctgccaccacgcctggctaattttttgtatttttagtagagatggcgtttcaccgtgttagccaggatggtctccatctcctgacctcctgatccacccgcctcggcctcccaaagtgctgggattacaggcgtgagccatcgcgccaggccttacatgctatatcttataagtcttccctctctgatattctagagcaggacacatctatgaagcagaattcttatccatatgggaaagaagatttggggcagcatggggtattacatgaaacactgttgccatcagatctgggccctgacgttaacttgcaggacgttaggaaagttaacattcctgggccttgtcaaatgcagtcagtggcctaagccatctccatggtttcttctgtgaataagacagtcagtagccctgggggtctaatataatcattgccactaaaatattttatgcctttgagatagatatactaaacctctttttcctaatttcctcatttttaaaattgatattctattatttctatggcctttccagcatgaatattctgtaatttggggtcttataatttaattttatattcatgagcctgagtttctatacttctggaatcaggaaatatagtaagatatgtacgtgcatgtacaggtgtgtgtgtgtagagaaggatagcctgtggattaaggaagagcgtctaggcacatatccagtgcccagtaggcattagaaactgttagctgtgttaagcatatcagctcctttaatcttctatcattcactatagcctttaaaggtaagtgttcttaatgccatttaaaggaagcataaaactttgagagcgttgtataattaagctccaaatccatgtcagtgtgattccacaaaatcattctgcttgctgtacttcaaaatccatcataagaaaataatttatcttacaatatgggaaaaatataatggaatgggttggagtgaggtagggaatgcattagcttattaaagtctcctaagaaacttacaggaggtaggccacaacacttgacctctccctcacaaaaacaaagacaaacagaaccaccacaacaattacccaaaacacttcgattacacatagacataactcagaagcgggaggtgaagttcctggtctacgtgcctggagcataaatttgcattctgaaatgaacattttaaaagagatgtacaaatggttacactatttagcgcccgcagccaacctgaattaattattcaagaactgtatgaactgttggtgcatctggatcctgcaaaggataagtcacacatctgttgctcactcctctgggcttgtctctgaagggtgatgggattcacagccgcttctgaaaagcagccactagatggcgacctcaccctgatctctcctgacagtgagttcgtttcattttccctggaaaataaatgctccaaaagtatagtcataaagaactacagagctgagggtactataatgtgtctctctcagtcattattcttttatgaaaactttggaataaagctatttgtaaattgcactttcttttaccactaataattaaaaagcagggccaagtcacgaaatgccattatccagtaatttgattttttgaaattaatgaaacgctttcattttcagacgtgtccccccaaccccccgaacttcactgctgatggaagaaagcagccagaaggataaagaaatttgagaggggaaaagtgctgttttgcttatgagttacaatcttgggttgctttttatagtgataaggggttgggaaattttaattttagttcacagaagtcataaaatcaggcaatgaaactaaaatacccacagtcctcaagttattaagtagtatctcattggcttatttagtaatccctttaatgttctttaaggcccccctagtgtgtccaatttcagctagtttatagaaatgatgtaaagaataggtctggctcacaagaaatcaaaagcaaggatagaaatattcctcaaccttgtgtttatcatttattgtaatgtgattgtgttcttggaaaagcattaagttcgggtgacagttaataataattgattgatctatgtttctattattaagaatacattactataccaagcataacttgagttatactcctcagaattggggcctaatgctgcatgaactgcctcctctgcctagaacttcttgctagtacaaaaacttgcccttgctagtagaaaaatttgactacactggttcttgttgacttttcctgtccttacctacatagcatgtatagcaccaagctgtaaaaagtcattttgcaaaattttccatttaaaatgtatttctcatagtaatttttaaaaacttgacaaaataggattgaggagtgtgcggtcaaacaaaatgaaatggagttctttattgccaggcttattaggagactttaataagctaatgtacattgcaaatcattgataagtatgcagtatttgctaattttttttttttttttttggttccagaaactttttttactgaagtattttataccacatacttacacacttttaaaaaatgctgacattatggagaaaaggatttgggaccagtagagctagggaattatgggcaaaatatgaagattcttgactggtactctgtaagccttcgttttcttaacttctctccccacgtctaagggccatgaaaggtcaatttgcttcctctcagcgtttcccattattattcttttttgctgagctcttagttttgaccaggaacctcatgtgtggaaatggtgaggacccaaaccttgaccccaaagcaaatgtctcaaatacaagcccctccccccagaagttaggaatgctggctgtgctcagacccctctggtagccactgggggacatatagaagacacaagaggtggcctctacttaaaaagagcccacattctcacacaaaaaaagagaaaaacagtaagtgaaatgaccacaacatgattcaatcatttcggaggaagggagagaaatgaatgcagcataattagtaatagcgcacggtttaagccataggcactctattaaaaactttacgtgtgttgatacgtttaaccctgctaacttcatatccgttttacagatggggatctgaggcatagaaaaattcagtaactcccccaaggtaacccagtgaagaagtcttggaagcagaatgcaaagtcaggcagtacagccctggactctccatgctcatccactatatgctattgcttcataggaataggaagctacagcttgaacctggccagaattttccataactatatgtccttcgtcactctaagagctggtttgtagactgcttgttggccatcagtgcaatatggaagtgaatgtgtgacaaggaggcaaggcaacaatgctgctttagggagggtgctggatatattacccatgaattagatggagtgacattctgatactgggccatagggaagaagtacaaactccttagaacagcttctacatggaaatttcaccagttaaattctacctactgcttttcttgggcaatgatgtgaggaataagtaaaaccttttttccaaagacagttcattgtactagtaaagatatgggctttggaattagcacacctgagttcaatgtaggggtctaccatttaccacctgcatgaatcttgatcaaactgcttaacctctgcaagctaaatgtcctaacctctaaagcaagagaaagatacttctctacaattttattgtgataatgacatttcatagtgattatgcagtatttagcacagtgcttgccttatatggaattttcagtagtcttggttttggcttgttatctttctccccagttacttctctttcccctgaagtttgaaagaagcggctgtgaggtatgaatatatttgccccttaagtagaaaggaggttcagtttgcagacagcattcagaggagatgagtgaaaggtttccatcactactattgattaaatgacacatagattaaaaaaaaaatatttggttggtttggcacaggtttcaaactttcagcatctctcatgctttgcacaggtgcaataatatacttattttttgaagtcttcatcaacaaaggagtaaattcgtttagcacacagtgaagccaattctttttctttcctttttctttctttctttttttttgagacggactcttgctttgtcacccaggctggagtgcggtggcatgatgtcgactcactgcagcctctgcctcctgggttcaagcagttcttctgcctcagcctcccaagtagctgggactacaggcgtgtgccaccacgccaggctaatttttgtatttttagtaaagacgggttttcaccatgttagccaggatggtctcgatctcctgacctcgtgatccacccacctcgacctcccaagccaattccttttctaatttgatctcacatggccttctccccctcccctcaccaacttttagttgaggctcctgtgtgagtcatcctgaactcccagtttgtgttcctgggctaagctcctaaatccactattaacttcacttcttgtacttatccacatccacgctcagtctctctgctatctcaataaacacttttttttttgctatgaaaaattaattttctagtgagcagaatatcccaacccctcaatcctggagatcaattcatccagaatttctctgaaagttctcaacttgactttaaaattgtttcttcagattccttttggaacctcaatcttcaccagagattccccattctgacttcttagttctcatcttagattttttctttgtaaaataagaattagcatgactagcagcatcatcatagttcagtttctctgtttctgtggatattgactatgactccccctccccatcattttccagcccagctccccttcctggtaggagtagctatagccaatttgacagtagatgtttctttcagtcactttattaatttagagcatgcaaatttagattatgttgctttgtattttcacagcctgtctgatttttaacactaagcaattttatttcctagttatttgttagcagatttatgttgcattttgatttttatatttaagttaaccaacatctttttttcttatactaagagagtgatttgtcactagttgtcaaaacactgcatagaagctcataacatgtaaatctaatttttgtgcttatagggaatataagaaattttatttttatttttttagagacagcatctcgctgtgttacctaggctggagtgcagcctcaaactcctgggctccagtgatcctcctaccttagcctcctgaatagttagcactataggtacatacctctatgcctggctaatattttttttttaatttgtagagactgggtcttgctatattgcccaggctggtcttgaactcctagcctcaagtaatctttctgtctcggcctcccaaagtgctgggattacaggcatgagccactgtctccagccaattctttaaattaggtctgagttttttcccaaagagataaaaccaatattgagcacttaagggtatgatctggtttagtctcccagatactgaagtttaagagacctaagaaaatacaatcctccctttttttgtcactgtaattctgagccaatagagaaaatattgcaatgaggatggaaggcaaatatcattttaattagtaataacacacaataatattgcttacacccactgaacttcagaattagacagaactgcccacttgaatagtagttcagaactgggcagacatcctttgtggaagcaaggcttgctcctgtaacacccattctatggatgcatgcagtagaatggacatttctgaaggcagcttgctccagcaaagagaaacaggaggtgttaggggctgagctaagcatacacagcttctctttgcagatcatccttaatatttctgattatgtcacttcttcaggaaagttgttaaagaggaaataaagagatgctatcagtcttgctaatggagttttttcaatgtagaaggtaacaagagaggacaggaagaaagaattccccctctaatgcttggcagtagaacatggtttgttatgttttaacatgatttttctatataaatgttgaggaagccaatttctactctggccacattaatgatgtttttctttattttgttattaaaatttccagtctctttgtatttttttttcaagccctccttatcccctctgccctagtcactcaccacttctaggtaaaataggtaatacaagttctaaatagttcatttgtaacagctgaagatatttccgttgtgaatgtcagaaacccaactcaaacgctttaagcatgaaagggagtctattgccacacagtttgaaaaagccgggaggtgcctggcttgatccagagtctcaaaggacagcacagatgattctcttcatttggtaattgtcttctgggttgctagtcctctgatccctctgattttcttatagcctctagggactcaaagctttcttcttacccctccagcagtccttgcttgcaaagaatcctctttcctaagtgtaccagcaagagctctggaactgagtgtggccgggatggcttgggttgttgccagttctaagggtggtccctaaatcagccacaagagcatcactgtgaaacttgttagaaatgcagattctcaggcctcaccccagacttttgaattctaaactctgagggcctaagccccccaggtgattctgatacaccctaaagtgtaatgaccgctttttaagtctgtagtccaaagtctgtgacagttaggggggtaaagtacattgagtggtctaggctgagtagcttgattagggtcaactttatccagtccaggtggttgaaaggtcaagaggggtgggtagcttcctaaagaaaaattacgtgttattataagataaagtaacagttgctgggcaggtaaactcaactgataagtctataatagaatccttcccacgagtactaagtggagagttattacgagaaaaaatacttggtagtgatgcccaagacttgtgtgttgtgtctttacaagggtcagagcaacaaaggcctttcttcttatagtgtgtattagtgtccagtgattctcctgaatggagaatatcaatagttttatcctttagcctgggttactcatgacctcatatttccccttatatgatgagccgtgctgagcagctgcgtgacagcatgtaatttgggcaatgcctgattgaggccaagtaaggtatctaccatattgaatatttggttttcttgaactcacccaagaaagctgaatattctgtgtggaaacaggttacacccaaaaaatatacttgagggtgctgtgataaatgatggtaacttttctgtttgtacctcatttacaattttcacaggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtaagtagaagggatcacgacttatgttggacacctttaatctactgaagctctacgtaaaatatggacataaaaataacttgtctattctactccctaccctccattcctgacacattctcgcatcttccttgattaaatggatccataaaattattaggtctggaaaggagagaggctcatgatttaatttaaaggtcttccactaactcaacactaacagactttttcctatgaaatgtagccctttaaaactattgaagaaaagcttatttttgcaaaagagggctatgatttgtattgcatctaattcttgagtattactaactacaaccacccaatttataccaaaagatgaaacataaatattttaaatcctaccattagcccatatatgcaagtttttagaagctgccctttcctcaagacattttactaccatgtattagaaaatagtcaaaacaaaaaaccaaaacaaaaaccaaaacagattaatggttgatgatgaatttaaaagtcacccccttatgttttgtagtgtacaacctgtgctactttgactctggagagtattagtaggtagtgttaatgaagtggactcgatgagtatggaattatagtgaagcatgatagaataaaatctgactattcttgtaacctcatatcaagatttaaattattcctgcattatgccagtttagcatgggggatttgaagcccactatgtcagttacacacatatagccattaaaccacttcggggattttccaattattgtttttttttttttttcttcctaggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtaaaccttgtaaagaaatttagtttttaatagagcttttcttacaatagatagactatttccagaggcaaaccacaggttcagagtgccatgcatttttgatacatcatccatatcctgttttaacaatgttgaattatcctgtaatgcaattttttccgtttttacttagactactcatcaagaaatggttcattttctctgataacctcgggaatgtcatgctgtgggggctgagagatgacaggatgagtgtcaaagtgtgggaagggccgtaatacagaggaaggaatataggctttggaatttcagctgaatcatttaatgtctggtgtcatcagtaaactgtcttagccttgttcagcttacatttacttttctttgcaaaatgaggataataattgttagtttctgtataggtcgtgagaagttttgatggcatgtctgtatatccctcagcatattattggtaacaagcacataaaaagcactcaataaatgcttgctttgttgacaatattgttaatctttactccatctatgatgaataaatttttgagatggtatatataaaatgaatgacacataataaatattggtttcctttttttgcagggtagaaactcaggtgcttatctcatttatgctgtcccccccccccccccccagctatcttattccttatctgatgaattatctcaagtgtatcaaactagttgacatggtcaccacatcctttactcattctcttttgctaattactttcctttccaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggtacaacctatttttttcttgttaagctacagccttgttgcaagcaccaagcctctttgctgcctctgccactgcctccttcctcagttgaccagtcctgtctcattctcatttgccacgtgacattgcatcaccatcagtgttctcttgtcactggtttagtatgtcaagacatgtgccacaggctccaggaatgtatgttggcagatgttttctgagtatcacatacttgccaataaaaataaaataaaataaaaaacttccctggcattgacatcaggcttctttcaatgtgtaccttggcttccagaatggctgaaacagcactggagacttttatttatactttaatacatgatgaggggaaaaccagagattttatgtagatgtcactaattaataaaatgtttcttattttggctgatagtgactgcattatttaatgcaaatctagcaggcaataggaaaacgatgtccaaatgccatgatgatggaagggaactaacatttactaagtacttactaattatcaggcattgctaggcagttctttagtgtggtatattggaacattatgggctttgatattagaaatacctggattcagctccaggtagtagctcttgttagctatgtgacatttggaaggtgatgtaacttctgtaagctatatctttcttacctataaaacagggcaataaaacttaccttgaatgtaaggagatcagaaatacacataaaatgcctggtatgtagtaggtactcgataaatggtaggcttattgtttacaaatattattttatgtcaaacatctaataatactgcatgtctacccatgcagcacaacaaaccatgctcagcctgttcctgtagatgatccactgtctcttgagatactaaatgaattttacaggtcttcctgaatccaacaattctttgcagtgtaaacaatctagttttaaccagcagatggcagaagtgaacacattcagccttccctagtagtcttgggttggctgaaaacgtgactgttacctaacttgaaaggcaaagaagttgcctgaccaaggatctatgtaattatttcctttttttctttttgagccttttggttgagccttatggtcctgtgtttgcgcaatatattgtgtttccttgtatcagttgttaatttaccacatcaaatctgttcattccacttctgtgttcaacttcatgtatcgcttctgttcttaaacagcttccatctgggttagctcatcatcgtaaagcacacatttataaaagcttcctgtcagcttatcaggctgacttggagttatggaaattgtttccctttgcctaagagttatttttgtattttgcactagtaataggaatgttcattcctataacccactccatttttcctttatccagaaatatttcttaaattgtcttggccaaatatggtgtttgtactatgtagtgtgtgtgtgtgtgtgtgtgtgtgtgtgtgtgtgtgtgtgtataaagggacaggaggttgggaatcactaagcccttaaagcagccactttgctcctagaaatgaacaatttcattcaatcagggatttttgtctccttggcttgcttttagttcttttgtgtattaaagggcaatcctggaatagacgtagcatttggaattaaattgtatatagtgtttagaagattgtagaatggcagtaattccatttatcctggaataattaatcatatgaagtcaaatcacaatataagagcacatattagaaagcgtaagatactggtcaaatgttacagaatttttattatgccatcagttcttcagatttaaaagttaacaggaatcatccattaactctatgtcagtgttttccaatagatatatgtaacacatgcaattataaatttcctagtagctacattttaaaaaggtataaagtaacaggtcaaatttattttaattttgtattttattcaatttaactaaatatacccaaaatattatttcagaatgtaatagagataaaattatcaatattttgcactttttttcacattaagcctctaaacttgagtttgtattttatacttgcagcacacctcaacccaggggctacatgcatttaaagtgctcaatacacatgtcaatggctactgtattggtagtacaggtatacagaatacaaaaattaaggtgtaaataaataaagctatagtattggattaaaaggaggtctaagctttataaaagggtactaaaatgtataatataaagggagaatgacctcacttaagagagttttaagagaagcagtaagagcatcagcaaaaagaaattacataacgagttggggaaaatgtccctatccctatctacagctctatgtgcagtttggcattactcatcacatgcattacagagagctccgaccttcctctgagtatggttgattgttcaaagccggatattgtggcttgatggctccaccatctgaatctatggtgagtcccatgagcctaatagcactgcactctattgccatggagataattacaacggttacccactgagcattatgcctaccccgctgggtgggatgaagtggagggtgagtgctgagggaagaaagtccttgttgattgtacacaaatgacttggataattagcctaagtggccaggaaaaatggcccaaaatgggttaaggcataaattactgtcattggaagtttgtaccactgtgaataagcccttgcaagagatcccaggagcattttagggttctgtgtaagatggtggggaggtaaagggagagcaaaaaacactggagacactgcaaaaaggcatcatttttattctgaatctcttgtgtagagcatgagacccccaagaaggcctttgagcattaggtagtatgaggaccacaggaaacagaacaaatttcttaatttatcatttcttttacatagaacagtaaacaagtaggggatgaggttttataactaagaactaagaccagaatctcttcaagatatgttttattctagcaaatctagaatacacagataaacatatatatatatatatacacacacacacacagatagataagtatctgtatctatctacatttaatatatgtttccatcaaagtcattgacaatgacactttaagatccctaggtagtaaatgtgttaccttccctattatatcagacccatgacagcaggtaaaataaaaggcaaaagagtccaaaattatttttatttattttattgattgagtgagtgagtgagtgagacggagtttcgctcttgttgcccaggctggagtgcagtggcgtgatctcggctcactgcaacctccacctcccagcttcaagcgaatctgctgcctcagcctcccaagtagctgggattacaggtgcccaccaccatacctggctaatttttgtgtttttagtagagatggggttttaccatgttggccaggctggtctcgacctcttgatctcaggtgatccacccacctcggcctcccaaagtggtagcaaaattatttaaaaacttgctaatttagtactcttcagctctcaagtatgagtagcaaaaaagaaaaaaatcttgaaactagtatttgattttatgtctctgatagatgcaaagtgtataatttagatattaagtgcaatttctgggcaactcctagtcaacatttagttgtaacttgatacctctcaatttaagctagggttttaaaaaaaatcatacctgatttaatatgtggctggtaaatgtatcttcctatattgaggccagctttgctgcagaggccaaggcatgatcagctagaaatgtggtttcacaattgcagatgataaacatctgaaagaaatacacgtgctttgttttgaaactggcacgaataaataaaaatgacattagtctggtgcccttttgcctgcaactatttgggtttggatatatttttaaaattaaacaaattgagctttttggtgttcccaaatcaccgtgatccaaatgtctaattccagtgccaaattcctgggtggcatttgcaagagggcacaaggggtgcactcgagtgactctttcatgctgaactcctaatgtttagaagtatttctatgggctccatctgattgcacacacgtgtctttcagtctgaccgtgcactccctgaggttggctgtgtggatgtgagaaagctcttgttgcccttgttgcccgttgcctgtgctttgtcaagtctgatgcgcccctgccctgctctgctgacttggctctgaggaggccggctctgtccctggtctgcgcgtccccctctgccctactccccaaccccatctttgctgtctctggtgaacctgtagagcatttcaattgtctgtctgagtgatggttatgcagattgcgttttcatttctgtaatgttatcctggtttattctacctcttactaacctctggttattgttttcgctttttctgttcttttgctaacaaagttgcgttgaccaaagctgacctgcaaggtagagaaggttcttgttcccattaccactttggactgaaagatgccctgtgtaacccttggtatcttttctttagagatcttcaagctgtcacacctcttggacagcagcaattgtggggaggtggctgaaccctgtgttcttctgaaagggtgacagataacccagatcaatgcatgaaaaatagctatcaagaggagacctcatgggggaagaaacatgattccattttggggggtaccaaagaggtttgacagcatcccataccgtgactatacataaacatattaatttactctggaaatgataaatacctctccaagtagttgccatggaggggttggctcctcttaatttattcaccatacatagaaaaaagaacttggaaggaaaaaaaaggccaaggccagcccttatgccttaagttattattttctggatcagggaggtcatttcctggagcaggacatttaagtacttgggctttatgaaagagaatgtcattttctcttaactagttttaaagttttaaatatttctgggcatttgggagacactaatgtcattaaaatgtttcagagatttatattttctattggggattttggttgagcactttaatttcctgttttgtgatcgcaggaaaaaagtactcttgaggaagaagatgatctgtcattttaatcctgaataccctataaaataccacatgtgagatgttagtgaatatctattgcagaaactacttcatccactattcaaagaggcatcttacaaagtcagtaatggcccactgatcctatggtgccatgctgctatgtctcagaataacaagggaggaacaagcattttaggtgtcttttggctgattgtcaagcaggagactgagcctcatgacctctgctgagtttgcagtcagtccaaattgttagaagtagttaaggcaaaggtaacgttcaaaaaattacttttcatctaaaaagatcattgactttgctgtgactttcttgttatatgccatgtagctaaccagtacaagcgcctatctatccagaatacatccaccaatgaagactctgtcactattttaccataactttgtttttctttatcgcctcttagcagattcacatatattttaatatatatttaaattaaataaaagaatatacactagttaggacttaaagtcagaggaagctttacaatagctttcagtttcaaagtatagagggcccttgtggcaatactgttgttttagacattatgtttaattgtcaagaaagatccactatgtatttctctgtaaatggaagagagagagaagggggcaggactcaatctgaatgcaagacaatccaaggagattgaagctccttaggactggatttagcggattaaactagacaactacatctcttccctgactttactatcacgcagggtaagaactatatggattttgaattcccagagcttagcatattctctcacctagaaaatctggacatggcaaaataatctgaaagttctcatccaaaggaataatggtttgtagggagaagtgagtcattgatttctatgcctaaagtaaattgtttaccaaagcgtagatacagatttagggacatagtggtttggaatatattgatgtttccttttatggaagctgtctaggcatcaatatggttttaacattattactttattggcacgaactttcctccattcttgtaatgacttgacagtctctttgtttgtggcaggagctgctttttttttcgattatttggggccgtcttactctttccctgttttataggaaaagcttttagttttttgtttcctaacattggggtgtggactattactcacaagctggctttttcagctacaacctgtgagtatagatagtactaattaccatgaagtatgaagggtagtgaagatatatgacaaggaaatgaggcagttggaagcctagacaaaaatgtattcagaaggaaatataacaatgaggtgtaagaagtgacgtaatgagtctagatgagtcaacagcttaagtcctcttgttattgtgtggttggggtagtgttttattttttatttaaaaatttttaacttctccagtgaatgtgttgttgaatttaacaggaagttagtgtcagctatgcctgtgtatcagggactaggtactggggatgctaggatactgcagatgagatgcagtctctaacttcaaagaattccacagatgatcagccaataattacaatgcaaagtgaaaactcctatcctagagacatgcgtcctgccatgtgagcatgaaggaacacactggatcgtgtagggtcatggtggtcatggggagtgctcaggggatatcttctcagacagagtttgagctgagtctgaaggacaagtatgttttagatggatgaacgatggaagcacattcgagagcttggcttaattgggaatctacaagaagctcaatgtggctgaaataatgtgtgtggggggatatgatagcacatgaaatgggagtggtaggatagagacaggtaatgacagacttttcctgtaaggagttggactttatcccaaggatgctgtgaggaggacagagatttgggttggattttcattttatcaggatcactctgacactagaatggagaaaggatgatgcagacagaaactagaaacagagagcagattcaggagtgaagcagcatattccaagacagagggaagagacatgcccccagtgcctgttacttgacttggtcaaggaggtaaacaagtttccctttcacatgaaacctcaaagagcaagaaagaaagtgaactctttctcctgtttgctgcacacaccctctccactgctacactgttattctggttagtagcacatgtattttcacattatgacaaaagatatcaagaaagaagtttaccgactttcctggtttcaggccagaatctacatctctctaggtcaacacaggagacaggagctctccacggtactcctgtgatccacgggagggaggttgccttgctgagcagtgcagtctttgtatcagtgtaccttggacagaatgacagcttctacagaacattcagaagtaactttctaattcctttttgtttttaagaagggtattagtggaaaggaagagatttcctaaaagcctattcatggaagaaaggagctgcagaactataaaagaaatattaagattgacctgtttggtgtgaggcagatgacataaattatgagaaataaaagaataactcttttttgtattaggtgattaattagaatcttcctattccatctttaattataacttctcttagcaggttttatttctgatgtttaatgactttttttctagaaatgtaaggtgtccctctgcccagatggtgaacacgtggtcaggggatccaggatccattggatctgggtgctaagtgctggctattttgagaaagtcaatcaatgtattgggttcagatgccttggaaatctcaagattctttaaaggcattttagaacagagttagaattagtcaaacacctttagttaggtaaaggaaattttaattccccaactgtctttactatgatgaatattgtcctccacctcattttctccgaaactgaagattgtatcacattctccattgtattttttgttataaaatatagtacttgacctactataagttcctcaaaatgctttctattgtggaaaataataagagagacataaattgcagtgaacttcccattattgttcttgtgtccttttcctccacattatacgagagaggcgtacaacacaactgtgtcagtgtggcacactaccaaaatgcatcttgtttctggactcctcatcaactgtacacccaacttaagtgggaggaggaaacctgattattgtcctttctagcagaattgctgatgatctttattgagagtctccttgatgaaggcatacactaaggacttggcaggttgtatctccattgtgactacaaccttagctgatagatactgttgtctgtttcataggtgactttataggtcttgcatatgttctttcatttaatcttcacaccatatgatgcagtagaaatacatatctcccttatacagatggggacactgaggtttagagtttaatatcaccagcccaaggtcacattactagtaagtgattaaactggattttaaagcccatgacctttcgcctattatgccgtatggtgtgagtctgggtttgcttatttccaaagcagaaagagtacatagatgaccagagagtatctgagagtgtcctccatgctgactttatggtagatggttttcatatcaacaccatttcgaaaagttctagataatatttgcacaatgttagagcaaagtattttaaattacctctttttttgttgttgttgagactgggctttgaaactccttctctctctcttttaaagtatattccactgccccagcagacccctacatcagtgcctagaaaacaaggaaaagcagacagactcctcagtttacattttctaaagaatcattgacttatgagggattgtgtatcactttgaaaagagttatttgacctttgtgacccaggcatcccatgaaaatagggtgggttgaggaagaaggcttcatgctaccagccatcctctcactcttacaaataccctacctgcagcaagtatcaactcccacctctctactgtcatggaaggtgctgtgggtaaatcactttactcttaagctgtaattattctttttagatcattgaccatcaagagcagtgctgtgctagagctggcactggcacaggaatttctaggaattttgtaagccagtttacatgaggcaacatgttatggcttgaaattggctatgaggggagtactaataaaaccaacacatgttacaaatcagttttattttccttttcctggggtgctggttgttaaacatttactagtgatatatcaccaataaaaggccactggggataaagataccatgaagccatctcagtcaaccaattcccatccatggccataaccaattttatacccaacgtattatgagagggttgaagtggttgaagagaaaagggtgttagtgaaactgctccaaatgttagattttattctttgtctttttcactgatcactctaatcatgtgacctttttaaaacctctgtttgagaagaggaagccataagcatctgaacatgcttgagaagagtggttttgatgccttgcttagctttggtaaggcataggtcctgacttcaagacaaaaagcatgatcttgggaatacagccacccttaggtctctctgacaatgagattttataataagatttaggaccctattctctggcattgccttatgttctataaaatgtgacctagagtattcgcgtctcagtggattcacttgacatttttaagtgatcattgctttcttattttaaagctaaatataagtgaatttggcttcctccagttaaaatgaatagatcttatgttgtctgtaaatgactctcttcagaaaagccaaggggactcaacactgtaaatttagaaatactctgaaagctatggaagtagctttgctgaagggtccaagacatatattcagctaagtaaataggctatccttattatcaggaataccctctgtattagttagggttctccagagaggtatcatatatatcatatataggatatatgcatcttatatataatatataaaatatatattatttagatatatacatcttatatataatatattatataaaatatatattatttatatacatatgtataaaaataggaattggctcacatgattatggaggccaagaaactccacagtccgctgtctgtatgctggagaataaaacagttggattctaaagccctgggaatgggggtggcaggggcagaagtggcatgatagtgtaagttctgctctgattcgaaaagcccaagaaccaggagcacaagtgtccaatgtctgagggctagagaatatggctatctcacctcaagcaaagaaagcgaattcctccttcctctgcctttttcttctattcagaataggaccacaacagattggatgatgcctactcacactggggaccatctgctttattctcttcaccagttaaaatgctaatctcatttgtaaataccctcaaagacatacctggaaataatatttcattattattatatataatgaccaggtatctgggcatcccttacctcagtcattttgacacataaaattaaccatcacattctcctgaagactctcaactctttaatttttatattttagcagtcgagactatagattgctcaggtaggcagtaagagtctttcataatccatttgcattttcaaaaatttccctgtagggtttctatagacttatttatatgagacttatataaatacacacacatatacataaatctatgtatattcatcttttttctgtacttttttccttccacccaactactgttcactcatttttttcctataaaacaatgtaaattttaaaatgtgaaagtagaaagattaggcacttaccaggggtagaaaattaaactaaagttggaagatctctttagacagttcatggcatgtattattctgttctcatgctgctaataaaaatatacccaagactgagtaatttataaagaaaaagagacttaatgtactcatagttccatgtggctgggcaggcctcacaatcatggcagaaggcaaacgaggagcaaagtcacgtcttacatggaggcaggcaagagagaacttgtgtaggggaactcccctttataaacccatcagatctcatgagacttattcactatcgtgagaacagcatgggaaagacctacccccatgattcaattacctcccaccgggcccctcccacaacatgtgggaattaagggagctacaattcaagatgagatttgggtggggacacagccaacaatatcagcaactcttataatgctccttcccatggaagctgtggtttgttgggacaggcaaaccctttggttaacacggaattctactatgataacttcacatttaggttacaccgatagagtctaagccctttgacttaagcccttcactccttgtgattaaagttagtgaatgttgatagatcagcctcacctggtccccactcctgggtcaccagccttggccctctaaaggaatggacattgagaagacaaacttgatatggcctccaggcctgtcacttctccttttctcccttaccctctgcctgctgcaccctacatttctccacccacttcttgtctggctagaaccaggtggtgctgctttagcactatttatgaatttcaaattggggtgtttgagacataggtttggttaagtcttatttgggcaataacagagggaaagtgcattctgatactagtgttgtgagctttaggaagaaagtctatttcaaggacctacaaacaataaaaaatactctatcaactttggttttctaggccatgaagaggaattgactaaatcagtgtacacgtgctgtaagggtggattagagcagtaacaggcataaaatggttgtatcagacaattcttaatgagaagaacaatcccaccatcaagaaaaatgataggaaattttggcagccatcagaattatctgataaataaaatgataagggaatgagatgcaatttcatgttttccagcaaaccaaaagcagggctggaaattagaaaccaaagtactaacaccattgacatcttattcagtctttccagacacatttctgttgtcttgtcactttctgtagtatacaaagaaagtcaccatcttttctcaaagggatatgtgactattttcgtgagagttattcacatatcaagagcaaaaataacttataccattcctatacaggaacttcctaaggcctttggatgttttaagatattaataattaataatgacaatgataaaaaaagacttcataaatatgtaattaaacaaatttgtgctgtcttagaatgtctggaattttatgttggtttggaagagtgttttatgaaaaattatgattattaagtccccagaattgtctgtcatgcttataaacgtaacatttgatacagatttctgttcataaaattggacaaaatgagatcttcctgtttaactgaattgaaatggtatttgaaagttttccttgtaaaaaacaaaaacaaatccttacatcaagacgtcatcttttcccagttgtaggtcagaaataccttaagttactcttattaatccaatgacaccacacatgcacattccccactctggcttacacacatccgtgagaggttaggtgagtgggctgcacaattagcaagcttgggtttgagacctcaccctctcacttgccacctatggattttggggaaaattatgcaacttttctgtgtctcagtttacttttctgaagtctttgccttttgattcaatcaacattttaaaaattacttaaatttgaaattatggagatctcctatgagaaaataatttgtttctctgattctttactacttttaattatatttgcttcatcatgtgcttatgaagattaattgaattaatatcttaaaagcatttagtatagtgtctggctcataataagcactaggtaagctgtgtctattgttatatcctctttctgatttgtacaagattattttatatcaatagatgtttagtgggaagcactgttgaagcttttggtttttctcccccaagacatgtttttctaatttctttgacacactgctatgtgaaatgcatacattaaatacattgacataaaataggctctgtttaggaaaggatgtacttaaacaggttgaagtaagaataggagctcacaaaatgatcatctagaaattgttctagagtctagcccagactctcattcattcaatagttattacatactgtacttgggcttgggaataccaaagagttcttgtcagcatctggtgagtctgaaatcaaaggacacacggccaattaaataccaccaccccacccaccctaagaaaaaaatgtaaataaaaacagtttcaagtaagagattacttatgtgagctcttattggtaaattctagggataaatttttacaagaaccattttgctttaaattctaaatgaatggctttatttctttattttttctttgttatttagttctttcttttattcaataatattttgaatattttgaatagaaccctcacgctataccaaatacaatatcagaaattagagatgtaaaggtgaccaagacagacaaggcttctgcccttgagaggcttacggtccagtaggatttgaaagacagtgaggaacttaatagttctgacaaaaaacggatgcactgaccagtggaacaggatagagacccccaaaataaacttatgcattatggttaactgattttttttttaacaaaggtgccacaagtatgcaatggagaaaggatggtctcttcaataaatgatattggacaaaatggatatttacacgcagaaaaataaaattgtaccctttttataccatatacaaacatcatctcaaaacatattaaagattcaaatgttagacctgaaactataaaactactagaagaaaacgtacaggaagtgctccattgcattgtttctgggcaaggatttcttggatgtgacttcaaaaccacaggcaacataaacaaatgagattgcatgaagccaaaaaggttctgcacatcaagaaaacaattaatagagtgaagaagtaacccatagattgggagaaaatatttgtgaagtgtatatctgataaggcactattatccaaaatatataagaaacacaaacaactcaaaataagaaaacaaataccccaatcaaaaaatgagcaaagaatctaactagacacttcttaaaagaagatatgcagatggccaacatatatatgaaaaaaatgctcaacatcactcatctttgggaaaatgcaaactgaaaccatgatgagatatcaccttgcacctattaaaatagctactatcaaaaagacaaaaacaacaacaacaacaagtattggcaaaggcttggagaaaagggaacacttgtgcatttttggtgggaatgtaaattaatataaccattatggaaaacagaatggaggttcctcagaaaactaaaaatagaattaccatatgattcagcaatcctgcttctgggtttcagtccaaaataattgaaggcagtacgccaaagagatatctgcattcccatgttcattgcagcattaatcacaatagctaaaaattagaagaaacctgggtgttcatcctcagatgaatggataaagaaaatgtggtatatgtacacgatgcaatacatttgctcattttttgattggggtatttgttttcttactattgagttgtttgagtttcttacatattttagataatagtcccttaacagattgttttattcagccttaaaaaaaagtgggaaggctgggtgtggtggctcatgcctgtaatcccagcactttgggaggccgaggcaggtagatcacgaggtcaagagactgagaccatcctggccaacatggtgaaaccctatctctactaaaaatacaaaaattagccaggcatggtggtgtgtgcctgtagtaccagctacttgggaggctgaggcaggagaattgcttgaacccaggatgcagaggttgcagtgagccgagatcatgccactgcactccagcctggtgacagagcaagattccatttaaaaaaaaaaaaaaaaaagaaaaaaaaagaaaaaaaggctggaaattctcttatttgcaacaacatggatgaacccggaggatattatgccaagtgaaataagccaggcacagaaagacagataccacatgatctcacttatatgtggaatctaagaaatttgaactcatagaaatagagaatagaatagtggctataggaggcggggggaggggatggatggaaaaataagagatgttgatcaatgggtacaaagtttcaattagacaagaggaataggctttggtaatctattgcatagaatggtgactacagcaaataatagcgtattttaaatttcaaatcattagaagaatagatgttaaatgtttttaccacaaaaaagtgctaagtatgtgaggtgattgatttgttaattagcctgatttaccattccgtgttgtaagcatatattaaaacataacattgtatcccataaatataaacaactattatctttcaatttaaaagaaattaatttaattacagtccacgtaattgttattagttaagtaaataggaagacatgatgaagagtaaaagttctgctaatgggggcttccttaagtaggatagtttggagaaagctcattttgagctgaaactcaaagaataaaaatgaaacagtcatttgaatctggagaaagcacagttaaggccaagggtccagcaggaagcgcaaaggaactcgaagataggggtgggcatgaagtattaaggcagtggtccaggaatatgagcaggcatctgaaccacctggagggcttgttacaactcagattcctcaattctgcccccagtcagtaggtctgggtacagccttaaagtgtttttctcataagcttccaggagatgcagatgctgctggtttaggagcaacactctgggaatcattgtgttaggaactaaaaacaggagagggctgtagcactgtgagctagggacatatggtaagaaatgagactggagaaggaggcaggggctcctaggagctcaatcttgaaaggaggttcaaggttagttccagattgttgagaagttgaaagttctattaagtccttagtgacaatactgttgttcttggatgcttacaatgtagtcagtcttccggtactatctgattctacatggcctttgccccttaatgcaagtgaagcaaattcagtggaattgataaataacctataatccccgccctgtatttggtccctgatgaacttctgacaaatggaaaagattgcatactttgcagagtgcagacatgctcctacactcaggttttggaagcatgatatagcaaatcaagggtggttacaattcagatcaccctaacatttactggaacactttctgcatcttcacaatagacttagtgccacaaggacctaaccagagaatattacctgatttctaatagcaagcagctttcaaacttttgatgataaaatagtaaaaacataaagcaattagaggattatatgaggagaagacagtgcaatgcgtaataaagtgctaaactgaatattatatgcaaaaattaatgacgcagataataattgctatggccacaacaaagcgggagaattattgtttgaagttattgactaatgtttcatttgaagaaggcattcaggctggtccttagaaaaatggttaaaatttggcagttagagggaaggcgaaagatatggaaaaggcttcgtctttagattcaatcaacattcaaagaattattgtgttttcccagagtttttgctgttttactgccttttacagtaaaactttccataaaccttccatgtgtttctgattattgagtacaattgaattactagccaattgtatggtgagagctgtttggccagggagcccctgtggacttctcagaagcttttatcctttgaaagaagctgtcctgatttaccattgttaatgaaacttgtataacacaatgcttgagtttaagacccactgagaacatgaccacatacctcctttcatctctacatgggggaaccacatggccaataggagctgcagaaagccagcagcagtactgtaaccccagtgttagtaattgttttgaactttcttatgtcatatcctcatagcattgtcttatgagtgatggcctgtcctgcttccacccttcatgaataaatacaaaatgccttgccacccagaagacgaaccctttgtagtcgtgcatctcttttgaacatgcgtctttaggaccctgtgttctttcatttcagtattcttgcttttgtgaggcttacgttagaaactgtgaaatatgctgttattgcaatggtaatatgttttaccctgtcaagtgcttttatgcattagttcctgactaatacatttggtgagtcaaagggctcatctcgtttgctgagattctctgggaaattcatggagttatactgaatattaagatatttcctgtgagctcagataatcctaaatgtatagatttatctttaatcccaaagttaaggcagaaaatgtcagtaaaagagagagaatggttgaagagaagtgccaggcggaccgaaagagtttaatggcaatctgtaagagagagatcatcaaaaaaattttaatgcccccacatgtcagtaaaagatttggagaatgccttcaaaataggtaaatttacttgtaagttatatacatgtactattattcttatatattaacatatgaaagacacacagaaatagaaataatttagaattaattaaaagaaacacaatttctaatattttctttctatagcacaaatgattctcttttgcatgctccagcgcatgcacactccatttaagagaatccatttttagcttggtgcagtggttcacacctgtaatcccagcactttgggaggctgaggtgggcagatcacgaggtcaggagatcgagacgatcttggccaacatggtgaaaccctgtctctactaaaaatacaaaaaaattagctgagtgtagtggcgtgtgcctgtaatcccaactactcgggaggctgaggcaggagaattgcttgaagctgggaggtggagattgcagtgagccaagatcgtgccactgcactccagtctagcaacagagcgagactgtctcaaaaaaaaaaaaaaaaaaaaaaaagaattcatttttagaatacctagagcagcagtgtgctgtagtgcaacggctttcaaacttcagactgcatttgaatgtcctggaagcttgtaaaaacagatgtgtgcctccctgcaaaagtttctaattcaatgggtctggggtgagctccaagcgtttgcattcctgacacattcccaggttgtggtcgtctgagaactacacattgagaaccactggtatagtccacagcatgcgttttagagttactttacctaagttggacatcagcatccttcaattaccaaatgtgtgaccttgagtaaattactgtgtcttcccgagctcagtttcttaaaatctgtaaagtggaggtaatcataattacttacctcttagagtacctggagagctcagcaagataatgtaaatacattgtttagtacccagtactcgccccctaaaaaacatcaatacatgttggctgctaaatcctccttcttctccttctcttccttctcttcatcattatcaatatcattaaacatctttttttatgtcacgaagtagatatagggactgttggtttcaggattaaaaaaacactgtgccttaatttataagaatcatgggaatgattttttttttctgagttagcattctacattaaaaaaagctataatccaaatgagatatctttctagttgaaaggtagagatgaagctattttgcaaagtcaacccgaaggagaacagtgtgttcagccctctcccttctgtgtataactgttgatagtttgtggctaagtgtgtatttccgtcatcttttgtatatactgagttcttgttgcatgagattgagttgacaattttggtggtgtgtcttcaaatgtttgggggcatgagaatggtaaattcaggtgatttccttgaatctaatttttaacatttcttctctctctcctttttctttttttcccctcttcttgtgcattactaggacccagtaccacctgccaggaagattcatgtgccaaccagggggtctgcatgcaacaatgggagggcttcacctgtgattgttctatgacctcttattctggaaaccagtgcaatgatcgtaagtacaacaacctttcatactggaactttgtgaagatgtttggagatttggagaatcttaaaggacaatatgtaaaaggatggctcttctgaaagattcataagtaattctctcctccagaaacttgggaaataaatgactagtgctcttatgagaagagtgaagagatgtgtcttgcttaacaacactaaatattctcccacttgctcactccctgtgttttttctttagattagaatagcgactgagaaacaataaccacagcagcaaaccatttcaggcaatatttttgttgtaagggcttcagttcttcatgaattaaatcaccttatcttattgaatttaactccaaattggttaataattttgagactctccccttttgcattgcctagaattttgaggctatttaaagggtatagctgttttctcaaaaagtttgagttctctgaatttcttaggccttacaaatgacaaagacattcaagagtttattttttacaattagcaaagcttaaagcgttcttgggtatctttcagatatagggtagaaattctctctgactaaatttattggtatctggtttatatacacatagctattctgtatgtatgtgtgtatatatatgtgtgtgtgtgtgtatatatatgtatgtatgtattttctattttgtgagtatattttatatgtatatattatgtatttggtttttattggaagagagtcttgtgattgttaattgtgtccactagtgatgcttctggctcgtgggtttagttctgacttcatgaaggtgcttctagcactgatggtggagacacctcaatgctgtgggcatctataacctgtgtctccacttctttctcatgttattttcttgatgtgaccatagtaaagatgagcacacacttgaaatttctgaataaccgtggcaaagagatttgttgaaaatccctgactctgtgggtcctgctaaccttctgactttctaaatgcagcctttgttttataatccagactcatttgacctcttggttttagaaaaatgatgcatgatgttatctgagaaaatagtaaagtcacattatggtgtgaccacatgggagcagacaccaattacaatgctatgccccccagatctatgtggtttttttgattctttatttctcagctttttatctgtgtgcagctgtctgttgttgttctttttcccgttttttctcagtagttttggtcccatatgctctttcattctcttaaggtacactgaggagaaacaagtggagaagttggcaatatagagagaaaattatgtaatacgcattcatctaattacataagcatatgtctctgtatctgtcatgtgaaggatacgatgtctggagaaagttttggtataagactgctcttaccaagtcttttggtattattgaaagtcatgttgccatatttatgatgtggaaatactgtttcactctgaaacaggtagttataaacccagccagccagagaacctgaggaattatactatatgctctttctttttcctccaatttgtcagtatagcactcactaggaaggcttttttctctaaatggtggcataatgcttctttatcctcacaagtttatttcttgtcgcatatacgtccctttctgggtagaaaatggtcaggaagagactctccacacagaacaggtataaaggtaagttatcgtaacgtggtgagcacgcacaattttcagaaggtaggtatgtctttttctgtctttgacaagttcctgtctgtcacccaatgccaggcattattttctggtaaaaatcaggaaggattctttctagcattctgtgactgtttctggttttatcaagagcagattgtgtctcattctgggatgtggagtatcacactgtctgacttggggaatttgttgggatataatgaagcactagaacttacattgggaaaatgtcagctttcctttgtggcaacagcttatcacagttcaaaaacatttctagtaaatctaggtttagggcaatacattttgaattttattctgtaacaatgcagctaaatcttttcattatagcagacttgggaaactgcctctctaacaggagctacttgcctagtcccccacctggagattggaccacggcttctgtgattggatagatacatagatacatgcaaatgatgaagttcacatctatttttttttttttttttttttttttgagacggagtctcattctgctattgcccgggctggagtgcagtggcacaatctcggctcactgcaacctccacctcccaggttcaagcgattctcctgcctcagcctcctgagtagctgggattacaggtgcctgccactacgctcagctaattttttgtatttttagtagagacagggtttcatcatgttggccaggctggtcttgaactcctgacctcgtgatccgccctcctcagcctcccaaagtgctgggattacagggaagtacacatcttagttgtggagtgtgataagtatatagaattgagacatataggatgtgactgtgaagtttgaatataaacttttaatgaaatccaaccaaatatagcagaatggtagattgtttaaaattattacattggacgtttctgtttccaataattggtattcaagttatctggaagaccttctgttttggaactagcagcaaagccagtttgttctacctagaaaaagcagtctcactatatcatagaccattattttctatagcagccttgacccttagagttataattggctatttcatctcacaaacatcttcaaaatgaagttacctgcatgatattctatatgcttacctttgttgataaatttttggtggcgtagcctgtatcaggactcaagtgttaaccttcatcatcaccggcagacttgaataggctcatgcttatcatcagcaaaaagtggtgggggaaattgcaaagaaagataagctcatggaggaggaagaataatgatgaaaaggaatatagagaaaatcagaaagtgggtcttatatggaagagcacagaggtcatcagcaattgctttggtaacatgcctgccacaagtggcctgcctttgacctaaataacagaaatgggtcacagcattaaaagtcgagtgccatcaaggaaacctggcttttacctaattaattcctgcaaagagagtgttctatagaatgttgcatatagctcaaacaaattgtatccatttaaatgctatcataggaccatgcaaataggttagagatgaaatttaattgtaaaaagcattttgtgggggaaaaatggttatggatatctcattttccagaagctgtttctcagggcaacagattgatcctcaattaatgaacatgaaaacacttcagtttattactacatatccaaaaactgaaacttactcaacagggaaatagctaggtcttatattttccaaaataaggtactaaatccatcatgtgtaaaaaagttaatcatatgtaggcatgacttgtaaggctctaaaaatgtctgcattttagggtattcctttttcctagcattggttcttttatgacctttgtgtttttcttgcctgtttaccaaatatgattgcctgacaatgttaatgtgctgttacatagatgttgcctctatgagtacagcgtacattttaaaacttagtctcatttagtgtgagttggccaagcctggatgttttcactttatttctttattctttgtgtgaccctggtgggttgatggaggcagtgggatgaatttcagtttcactcttataaacatagctgtgcaaagctgatattctttagagctgattgtcttgtataagagtgactcccttgtatggggttaggaaacaaaaatcctctgattggaaatccaagtgtaattgatttgctaattgtcttacatagttttagatatgaccttccacaatgttatgtaatggtaaagtcatggggagtttcttttgggttgacttttagggctgttttgattctgcaatctaatcatcccagaagaaatgttgagttaatgtagaagtcagtatgatctgtggaagaaaacataagtaacattctccaagataatcttcagttctcgtgaaacatttaaaattgagggagctggctattcagagggtgagcaccacctgaaaatcaacttaatgaaagctgtcttgggctacattttaagaacaacaaaagaaatggaaccttacaaaggttcttgataggcatattcttttttgatattgggttcttattagtattttaaatcaggactgagaacctgggaaattctagcatgttgtagccatggcagcaccaggcaaatccagaatctccttcctgtattttgtggtaatattgtcactgtcagcctgctgttgagtttttctttccttcaaacatcgaaaaatgttgtgtagaatagaaccctcctgcatgcacccacacatgtgcaaaagggttgtcatttttatggactttgtgaaaatagcagttttaaacatttcatacctatccttaacaacattgttggcttttaccatgtacatgacaactgttttgagtggcatacaatttgggggtttggttattgcttctggtgccctggagaagcacatataggacagtctttggcacatgagtccttaacacacatcaagttcctgactttatgaggtgggtgctcatcatggctttgtggggtgaagtaaagggaatgaacgtgggtcctcagcccacccttaggagctggccaccctgtgctacattgctggtcacacactgcaggatgcctgttggagaaattcctaggttcacactggcatgtggtaatagatgttctttgcttgcaacaaatcaatagcaagcagctgtggatagtgcagatagtggagtgtaaagcgtctttttcagacagttttctgcaggagtggctattaagctgcagtgttggctattgattggccttttgctttttatttattgtgtgggtttatttatttttttaatgtaggttggtgtattgattaaatctgttaaaaacacatttcccattcaagcttcagaaaatacaagcaatgtatgcattactcagtgtgcaaagaaggggacagatatgtgtatactgattctgtctcttgggtccatataggtacatagacattatgttaaaaacctatgttgttatgaacctatgttgttccagacctattggtatagcagtaatttttaaggatatcatagtatagtacatccatgtttttggttatgtgttcattccccgccattgttttcagactctacctgcccagcgaataggccatatgtaagaagttcacttgtaaaacaattgtttgttgcttagaatgcactttatcatgtattgattcattcactcaccaaacatttcttatttgcagatataatcatgaataagagagttttgttctcaaagaccttctagtctaatggggaaagacacatatgaaggtgcttcagtagaaacatgaacagtgtatagcgaggagtcataaggtggagtaatggcagctgtccccagggttgagactctatgaagagcagctgcttttaggatggttttcattgaagatgagccttgaaatttttttttttttttttttttttttttttttttgagacagaatctctctctgttgcccaggctggattgcagtggtgcgatctcagttcactgcaacctccgcctcttgggttcaagtgattctcttgcctcagtctcctgagtagctgggattacaggtgtgtgccacacaccacgtccagctaatttttgtatttttttagtagagacggggtttcaccttgttggccaggctggtctcgaattcctgaccttgtgatccgcctgcctcggcctcccaaagtgctgggattacaggtgtgagccactgcgcctggctgccttgaaaatttacaagtaggttcaaagcaaacatggtatggaagagggctggaaaggaaaggtagcgtgccagcaggcaagcagggaaaatatatgctgcagtcactgttaacattctgcatgtttccttccggtcttcattttaagcattagcatggttcagatcacattctgtttgacatttttgccctgctttgtttggtttaacactataggctatgcatttttcaagatataaaaaaaaattagatttcccaacttctttcaatagaatgcatgttatggtgcccaactcttggggagaaactcccctatgttgaaatcattgctgagtcctaaatgtaggcctcatagggctcaaatctggatttatttcattgagtcgttggtggagatcgatcttgaaaatttatttataaagaatccaatttttaaaagtttgatttgtaatgtgtataacttattaaatgataaaagaaatcaaagcatagtcattaatttaattggctctagaatcaaactgctttaaatgccagtcctgagtctttctatctgtgaagttgaattgttcacttagcttcctgaaactttggtgtaacataaggagtgtaataggtacttggtaaataggattagtggtagtttttattgtagctaattataatatttgacaactgttaagtccttatcatggtcctgacactctactaggacctttataaggatatcattcttttaatcatccccaaattcttaagaaaatattatagtacgatactcctgattttaattatgacaaaactgagatcacactgttagaatatagctgattgagggtttggtcccaggtttgtctgacataaaagttcacattcttattcgatttgctgccacttagtcattattagaaataacagtttaacatctgtactgatattagactaggatgcttaattccatgtgggcaagtcttcacagacaatcaaactgcataaaaacatagaactgggaaagggaaattgtgttcttgatgattatttgcatcatattgtggaattcagaacatttcaggtcttccttcttaacactcagatgaggccatttagaattaaaatgtctttagccattatagaattagagtatcttgcccatactccaaactatttatattttcattctctgttgacctagatcttctgatttttatgtgtttgctttatttcaattccaacatatgtcatacagcacggtggacgagaccactaatgtgtaatggggtggcctgtgttcaaatcatgactctgtcccttaatatctatgttaccttggacatgataattacagtgcttctaaagtgcagatattttgtaggtcctatcttgtaagaataaattttacaaacataaattgaataataataaattgaatgtgtagtggtgaagtttaggagatatggcacatgatggccctgccggctactcttcgatattactttcaaaaagttaaaaacatgactcatacaaatataattattataaagttaaaaacaaaacactcatgcaaatatagaatgaatgtgtgtcaaatttatttaactccataatgagagaaacaagatggtaacagtgtaaacaagatgacaaaagactatttgaagaactggatatttataggccttaagaatattaaaatacaaattttagatttaaaagtggtaaatgtcctacaaagcaaaaatctcttaacctttggtgttatcttttctatggaacatctgtgctgaacaaaaatctacaggttcagagggcatcttctgtactctgggcccccgctaacaataaatgtcagtgccagtcacaggttcttctcccatagagctaaatgtttctcgggtgggcctgttaaacagtgtccttttataacattagaaagacacatgatttttttcccctaacttttgccctatgttttggataatttttattaatttatattcagtttcatttttcttttttaccttgaatacctctttcatacacaattacgttttttaaccgcttaacagtgtgccccaatgtgctgaattcattgtcatttaaaccccacggcaaccctaaaagtagatactattgtgataccagtttcatagatgagagaactgagacagaaaagtcaagtgatttgctcaaggtgacaaaactattaggttgaggaacaaagattcagagttatgttagtctgactgcaaagtctgggctctggactgccaatatcttcttaatgcctcagggaaagtttcctgatgagaattcatctgaattcataggggtttagattcacattagccacagagcttaacgacttttgttagcatcaattatactgtaatttctagtgtctgtgttattcttttgggggggatgctattttattttattcactttaaatgagggcatttaaagtaggactgatttgctcggggaacaagatcagaatttccatcaaataagtgccattttgcaggtttggtacatctaagcagggaggaggctgagtcctgagaagtcagtgaggctgagaggggcagcatagctccatgataaccaggtcccagaaggcgagacagatgcaaaagaaacgtcaggagtggcagcaccaaaggttatttctctgcatctgtttttattctcgggcccacagatattccatggagccaaagggaagtcagaagataacaatgaaacccagggtcttctaagagcagaatgaagctagcggtactcttaggaacagttctatagatgtgggttgtagcttgttgcccatgggaatcacacttgcttttaagttccatcaatattaagaagggatgatttggagtattctcaagctttatcagggctaatattaatatgtgtgcaatactaaaccgattcagcaagagccaggactgcgtgcagctttgtttttcacaaccctccctgaaaataagctgggactcataggtgacacattggtttctacaaaccccagtagacacttggtcctatggttcaagaaaaaatagtctccataattcaaaggcatatagcttatcatggattatcataagctgttggagtttgtggcctcaataatttcatttccaccatcttccacatgctatatttgtagaccattttcattgctgtgtttaattatagcccattcatttctggtgtccttggctagttacttacttaaggtgacggcaataatccacttagagcctattgcttcacggaagacaatttttgtattaccatgttagtcacatacaggtgcaattccaacatatttttcaacatggacataatttcctatagttatttccacatctaaaggcacaagaaagatctaaattactttactttgtcttgtaaaatagaaataataaatataattttgttcttttcatttatttttctcctctactttctttttagggaaggaagagatcattttttgaaggtggtaaaatttacatccagcaaaatgcatagatcttacatgcattatcacaaatgcttatacccaagtaaccaacaccagttaagataaaggatagtttcatcttctcagaaacttttcttgttccctttccggttagttcttctctttaaggtcattgctgtttgaatttgtatcagcatttgttatttttgtctcttctggagtatatataaatggaatcatacaatatgtgatcttttaggtctgttttctccagctccatgtcagctctgcattctagccagctgagagtctcttctgagtcttagctccatctatataactgcaggagttggctggattccagctggaaccttcctgcctgctccatgatgcagaaattctctccaggcagtaagctggagcagtcttaaatctcacagtttatcttctctatttcagaaaccactgctcttctttgcctgatgtctcatgtctcatgagccattgtttcatgtgttgtcattttcccggttatatcaggtcagttgtagttccagtctttgttactccatttaggttgaaaattgatgccaacctattcttttttacctgacttcacctttgcactgtgagattagggtgaaggtagcaggagaagacataacatgtaatgggctgtgcttcaagccgcaaattctaagggttttctgaggctttacatcagtcccagagtgatctggcagtatgtaatattctacaactgttttatttattcatttattttagggaaaagccttcaactccagtgataatccctctgtagtcaaagaaccttcttggccaaagaaaacgttgcaagaagctgcgcaaagctagttaaagacttgccaatgtgtctctatcaagtatttattaatttgagtgtttctgttaggagggctacattaaatttttttttttttttttgagaaggaatcttgctctgtcacccagactggagtacagtggtgccatctcggctcactgcaacatccgcctaccaggttcaagcaattctcctgcctcagcctcctgaataactgagattacaggcaccagccaccatgcccagcttttttttttttttttttttcagtagagacggggtttcaccatgttggccaggctggtcttgaactcctgtcctgaagtgatcctcccacctctgcctcccaaagtgctgggattacaggcgtacattactttttacttccactccctctgaaaacacttgattaagctcagtgattgcaggcattgatttgacttgaaaagctagtggttcttattattttcttcacttagaattatagtttattttctcaacctacccttttcttgtggatctttgaccactgattcatgtccctttgccaagtgaaattaacaaatgttttcaaacaaagaatttggagacttcagaaaagtggagttgtttctataccttgtagtgttttggccattgactgtccttattttgatcaccaggcactggtttgcatttatgattttgctacatgcctacggaagaaatgaaggaaccttgcattattggtacctttgatttaactgagtttttttggatatggaaattataaaagctcactgctgaaaatgtggaaaacacataaaagtatgaggcagtaggaaaaaaacatgcttaatttcatcaactattaatatgaccttgtttcagaatatgcatgatgtcaggcacataacagatactcaaaatatatttgttggttgaatgactgagtcttgcatattttcagcatctgagttgtgcaaagatcttagctttcttttcatgaaaagaacactaacagttttactaggactaggtgttttcttgccagaagaaatgcttttaggcatatgggaattataataagtatcccaatatgaaatttccttcttcagataaaaaatgaaaatgtcaagatggttccatttcttttcaatcttgcccttctcctttctcaaagaaagccttgctgtttctgaacagtcattcatacatacatctatataaaagggaaatggttttacagcggatcatggttggagggaaaacaccgctataacataatatgggaaaagagcctcttggtcccagtttcttctgtggcactcacttccaaagtgatgttgtggtttatttcacaagatgagatttcttgtaacagtctagtactctagtgatcgagtgagatagtagaactttatcgtcaatcatcaaatcccacagttttatgttgaccaaaatcagtactacatgattgaagaagttggatgcattatatactgaaaatgtaaaacacaaaattcccctgatttttttcacaccctggattgcaaatttttatttccctgtaggagaattcagtcaaaccttgtaaactgtaacaactctcaggagcattggtaagaaacaatatcatctaacttcaggcattatttcctggtaaattaactacatgctctttgaaatcagccctttactaaatctaaaactgcagttttactcagatattcttatgtgagtgaaatcaaatgcatgtatgtgcatacatatgtaatataaataaatataagttttctttaggagttttcccaattcttctgagatgatttttctatccaaatacctttgtttctatgtcttaaggagttatagctttcggttgcatcttagtccattggcaagacttgtatttctgtaatttctgtaaaggtaaggtatctacttgggccacagatcaggtatctgtctgcctttgtggatgtttggcataaagcccctttattccacctaaattctcgatatttggggtatgattttatttctgtaaaaaaggatttaggcagggaggtgtcatctggattttatctgcccttaagagtaagtgttctttctcctctccctatctaaaatttccatgtgattccctcacactggcactaaagtgtgtcatctggttagagctcacatcagtgccctgctgctggtggaggttgcgggaggtgagctttagaaaagggcctgcagctcaacatacatgtcatggacacaatcgtattgtccccaactcatgaaaattcctgagaacagagcaaatcaaaaataatatgttaaaacaagaaagtttagtgaaacaaactctcggtattgttagaggctttattctaatccctacaacacagcacatgtattctcaacatctaacatatttaatttgcatttggattcctttagcatattgtcctattatataaagtttaatgaacaataaacacagctataaccaaatttcacagctatttctcagtgtggggtaagattttgcatttagttatatttggtttcctaggtaatatttgattgtggctctatttcctgaagctgcatctcttgtcacatggaatcttttggtggcggattctgccgaccgaggggaagccaggaaggagtaagttgctttgaaaccactgaagccatgatagtgaagaagacttcacagtccttgacagtctttgagctctccattgttgttctccaggcttgtatttctgaaatctactgtatgtactagttccagatcagtcttgcccaaataccatttttatcctgtcattcctctgctcgtgaaccttcaatgacctcttctcaatgtagtccaaaccctacacttggctttcaaggtcttccagaatctgtttttcaaaagctgtccctcgaaccacattttcttgaatattcatggctttctatattctaataaggtcaggtttctcgctgtcactagcacattctgtcgtcattatgctccatgcccttgcagctgtacttctttctccctggaaggcgctcttctctggatctatacccctttggggttcagcccaagtctcacctattttcccgagtcttctttggtcagttaaatccatactcatgccttatcccaaatcccactgcatttatattcagtgctgagagacactctggcttggcatctaaagggaattagcgtggacctgagagtaaaaggtcagttcaagttctggcttcttttctttctaatttttgtggcatttgtcaattaatagaaggtgatcttactatggaagtctcacaacagtctcagctttgttaacaaagattataaataatgggggcaaagcagagtattgggcctgggaaagagtttttgtaaagcttcaggtagaaccttatgttagaaatgtaaaacctcctctaaagaaaaatgttaccaataaataaagcaagtaggattttgagtagattatcatttttgttgtgtattcaccctgtttcctagagaatcaactttcctactttgtgcttactatagtttcctctagagtaggggctaactgtgtagaagaggttgtgtgtgggtcgtagggttactgggattagactattcaaatagcacaaatattctgtgtattctgatttcaaatgtaaacatattcctgattggaaatgtgtatatgtattttttatttttagttctggggtacatgtgcaggatgtacaggtttgttacataggtaaacatatactacggtggtttgctgcactatcagcctatcacctaggtattaagcccagcatccattaggtatttttcctaatgctctccctcctctgatcctatcccctgacaggccccagtgtgtgttgttcctctccctgtgtccacgtgttctctttgttcagctcccacttatgagtgagaatatgcagtgtttggtttactgttcctgggttagtttgctgagaataatggcttccagcttcatctacgtccctgcaaaggacatgatctcattcctttttatggctgcatagtattccgtggtgtatatgtatcacattttctttatccagtctctcgttgatgggcatgtgggttgattccctgtatttgctaatgtgaatagtgctgcaatgaacatacgcatgcatgtatctttgtaatagaatgacttatagtcctttgggtatatacccagtagtgggattgctgggtcaaacggtatttctggttctagatctttgaggaattgccacaccgtcttccacaatggttacacaatttacattcccaccaacagtgtaaacgtgttcctgtttctccacaaccttgccagcatctgttgtgttttgataagtccgtataatttaattagaaacctaagtaggttttggaggacctactacctttacttaaacatcctgaattttatttatttgtttattttagaattggggtcttgctctgtcaccaagactggagtgcagtggctattcacagctgtaatcatagtgtattacagcctcaagcttctgggctcaagcgatccttctgcctcagcctcccaagtagcttgaactacaggaacccatcacagtacccagtatatcctgaatttttaaggcagcctctccaagaacattctgaggtgttctggtgtctttagtaatcttatctcctaattttggttcttgcctggaatgaagaaaattactggtctgtgaatctttggctcttgtcattgtaagacttagggaacaatgctgcaatttttgcagcctctgtaatgaccagaactttcaatacacaatcttaactttgtagatattaacttatttttaaatctgctcatttaaagccataaaatgtaatctaatttagtctttacaatgaaatatttacagtagataatttcacagtcactgctccctaattcaaaacgctttgagcctgaagctctaaggccaggccagcttgagtctgatactgatgtgctttaacatgaaacgtgagaccaggaagtggaagacccgtagccaaactctcatccttattcacagtaaatttcttgacagaagaaaccagggaactatggggtttctggtttattatctgagtggtctaatgcaggaattattgcctgccatggggagatgattgcagatcactctccggtggagtttgactgaacaagaagccacatcccaggtctcaggaataatgttattccacaccctccctgttactcaggggtgctctatgatgggctcagctgccgaacattaggggattcgaccaaaaccttaatcatggcgattttgataatcagttccaatgagcagaatcctgtgggctctgtgaaacccgtgaagctgatagtattgaaggaaatgaaatgtgataagtgtgattgcttgacatgccagaagggggttggtggagaaagaattcaaaaaagaaaatttagctatcttaaaaactggcacttctgagaataattatgtagggaatttgcactttcatactctaggtgtttctgagaacaaacacatcttaagaatttagttagaatatgtagataataaagatttaaactgattgccaagggtcctcacacaggaatgatttttcttttatagttaatttattaatttgagtaaaatgtgattcatttacttctgagcctttgcatggtgttcatataaatagtgttgataatttctttctttctttttttttagactgtatctcactttatcatgcagtggcttgatctcggctcactgcaaactccacctcctgggctcaagtgatcctctcacctcagcctcccgagtagctgggactacaggcacatgccaccatgtccagctactttggcatttttggtagagatgagtttcaccatattgcccaggcaggtctcaaactcttggatgcaagtgatgtgcctgccttggcctcccaaagtgctgggattacaggtgtgagctactccacccagccaatagtgtttgtaatttctgatgacaaatatttcatgctaaataagtagccgaccaggaatgaacaagtaattaccaacagtggggcacactgttgtttgatggtatatgttttcctaacatgaacaaactcccttacaacttcaacatctgtgccttaactaaaatctggacatgctgcattgagagagcatctcttggaagtctcctttagtgaaggatgcttttttcctaatgttttaaattcctggagtcagaccttgattctacaatcattcttcagtgatgtttcttcttttaaggtcacgtattttttatatgctgtcgccccgtcctcatcattagcatttattgaccttcaggatgtaaaaaatactctgagttcttcccttgtagccttcttctcactccatcctttgcattgtccttggtgacttaagttttcatgttgtattttttcctaataacctgatttcctcaaatacctggccacgtagcaaagggagtttctattgctggtactgcttcctaagttttcagttctcccataccttaaacctcctgacactactttctgtgtcaataatctcaaatgtttcactagcctccatgtggcagttggagtttctagtctagaatacaaatggtattcccactaatacgcaggagctcttgcctcatgacttgatacactatccaaattccaaagacattcccttgctcggtttcttggcccctgccttacagctagaaaaagtcatgtacttggcaattacttcctgtaaatccatatcctcttaccttagcaatgccctcagtatgttcttttttgtggccatctaagctttgtccctaaattgtgaccattttcttttctactcaataatatctcattttctacgttggtagttagtacttactcagtagaagttatctgatgagagtctttcttcatatttctttgtgtcaaaatgcatttttatgtttaaacatctcaaacctccctggcaattaagacattttgggacttttctccaaacataacattccatttaagtctgggactcactttcataaacccatgcacctgtgggaaaactctcttccccaacgtgccctaaactttattgatttgggcttaccttccttaccttgttcatctagatatgttcaatgggccttgtactgaatatttgtgtggtgtttacatgtttatacatgtttacctgtgtgtgactttttttttctaatttgaaccaggactatgtgattattttacttgtacatttcttagaacagtgtcggtcctcaaaaaaaacgagtgggtttcttactctctttcctttctttcactaaatatttcatcattgtagcactgatcttacacatatttgttaatttttctggctcattgtcaactgtgagttctacagggtaggtacaatgcctcgtttatttttatattcccggtctctgtatcaaacctacataggatttgcaggaaatgagccactgggagtttttgagcaagtgtgtgatatgcccaaagatatgccttagaaagattcctcctggcagagtgtgagaagcaggttgagagaaaatagtaagctttgttgagagaagattgtaagcctttctgagagcagacaacacgtggctgcataaacagaccctagtgcaatgtctgatatatagtgcagattcaatgaatattttggggaagaatgagcaaaatcaagaaagctattaggaggctcttgaaaataggtgtggtaaatggcaaaaaacaaacaaacaaacaaacaaacaaaaaccccaaaagcatgaactaaagtgtcagtactggtaattttagggttagcctcaactttaaaaatagaatataagctgctacatacacatgggcacagccaattatagtagtcaaagtatagtagtcaaagaactggtgaaatggcaaacatttaagaaatttactccatttttaactttataagatttgattattattcctttatagccttagctttttttttgtttttacaattaaagatgtttttaagttaaaataatccacttatattagagcctctttttctattatccagacagcacatattattctatccattaaaaaatgtgaccattaaaaatggctagaatagcttaataatataatatcatatttattctatgatttccagtggaatgaactgttatggtctccctgattgattataattttaataaacttggttgtgtgtggctaggaacaagttcattccaagttcattttttccctgatgtagataaaattccatcagctaagttctgctactgtgccccatctccagacttctagctaaatgaagtactacagggctctgattcttgctcaaactcactactgctaaactgaaatgcttgaggtattcaaaactgttattttctgcgtcaatttgatatatgtgcagcatttcttttttaaaaggacatgttctgaatgtttagagtgtgtagataaccactcccaccccccaacacactcacgtaacagaagaaactttggatacttttattgtgtaaacttacagaatttgtgtcaaagaagttcatgtggcaaagacatcaggtgtatcaaatattttggtggttttgtttaaattcagagtgagaattaaccaagcatctacaatacgtacacctgctctgtattctaacccttttgttcatggcatgcacattaaaacacgtagctccacttcgctgcattgttgattgcagttgatgatgagggttgtcgtttctgtcaacttttagtattgaagagaagcctcatgtgtagtgatgttagggacagttcagccatgttacatacctagaattgtctctgaaaaaaaaaagtcatgaactttttttttttaaaggcaatagaaagcaatcaaccaaccaaacaaacaaacaaaaaaaaacaaaaagtctgggcgtggtggctcacacctgcaattccagcactttgggaggccaaggcaggcagatcacacggtcaggagatcgagaccatcctggctaacacggtgaaaccccgtctctactaaaaaataaagaaaattagccaggtgtggtggtgggcatctatagtcccagctacttgggaggctgaggcagaagaatggcgtgaacccgggaggcagagcttgcagtgagccgagatcatgccactgctctccagcctggatgacagagctagactccatctcaaaaaaaaaaaaaaaaaaaaaaagcagaaaaatgtgttgattacagagttaagggggagaaacttataaatcatggttatttaccacccctgagaaggtaggtacaaggttgactactacttacctcttaatcctatgattttctggttctgtggcttagaaggtttaagctctgtcaagtggctcaagcaggacagcccaaggtgactccaattctctgtgactttgttttcccatgtgggaagtaaaccctaccgctgtgttgtaaactgtttagatatccacataagaaggggttattcggtattttgggggggcttaagataaaagctatctccatttgagaaattagaaaaccatttctacaaatcaactctgttaaaccttgtcgccccaaatcaatttaggacaaaaagcagcagcacattacttttttaaaagcccaattcaattttaaagttttgaaaaatttcaagcaaacataaaggacagaaaatgttaaacatccttgtactcaccactcttaacaagcgtcaacattttgccacatttgctgaatactataacttacttttttgctttttaaagtttttattattgaacacagacaagtactatatgttaatatgtgcaatgtacaagaataatgaaatagtcatatgtctactacccaacttaagagttatagatttattttttaaagaaaaagtataattactttgagcttgccagcgtaagtttcctcctactctctccctgcaaaaaaaatagttgtgtacaaaataaaattcctggggttgacattcagatgaccccaatgaatctgattttttttcttttctttttttctctttgctttttttttttttttttgacagagtttcgctcttttgcctaggcaggagtgaagtgatgtaatctcagcttcctgcaacctccaccccttgggttaaactgattctcctgcctcagcctcccgagtagctgggattataggcgcccaccaccacacctggctaatttttgtatttttagtagagatggggtttcaccatcttggccaggctggtcttgaactcctgacctcatgatccacccgccttggcctcccaaagtgctaggattaaagacgtgagccaccacgcctggcctgaattttttttctgttgctcttcaagttagatggtttaagtaatgatgtttgccgggaagagatttgaggacctaaccgtgagatagtcctgccctgttcaggtctcccgtgtttcctcattagaccttccagcttattactggaaaagcattcttttctccatgttttaaacacctattgagtatgaatgttttaagtgcttattaaatactggttcataactctttgtaagagttaggggagaatcatcaatatctggaacaacaccattcttcatgatattggttttgagagccacgtgggcagagaaataaattctagaaaaaaagaaatggtaatctgacatgcagacttggattataaatatggtcaaaggtgtacttaaaaacaagatattttgcttcttggttagctttactgagaatccagggatcaagtaaaatcattgccattggtactgacggttgagagtcagtgcgatgctaaaccacaggaactccttacttctatgcatgattaaatccagttgtcaggtttgggcagaagagagccctccttttcctcaagtctatagggaggtgctgtgggggagttttctcattttccagaatatacagagcaaggatcatccatcataatcagacaggggtatttcatatcatccatttccagtgagaactgtggtaaaattctgtcctttttcccatttttggctgctgtgattgaaacccgtcttataaacagaaaagggtagtttgagttattttaaaaaataagaatccttcagtctctgttgcccattttctcctctatgaataatttctgcagacaggtgaccagttcaaccatctctctcggttacaaatgcctgtggttggtccacttccttcagccttggagtaaaataaaggcttcttttgcaagatcacgaaataattcagcaaatactgtgggactataaggtattcctgtgttgtcaccttttcttttgaagaatatagagaatatgcttttcttcctctaattcaaatacatagattccttatgcttgtataatgaaagaataagggctctgatacatacatatcattgaacaactattatcagtattaggcaatttagaaaacaaaaaataagacttcagaatttatatcagctccttcaatacttcatttagctggatccatttaaatatttcattttttagcctatgttgtagtagattgcttgattggtccaaggtagtctctaaatccaattagagaaaatgaaattcaggaagcacatcactgtagattttggtacagtgacttgagtatataattgccatctctttctatgttagctcaggggtgggttttgtgccataaaccaaccatccaaccaccagtctacccacctacccacccaactaaccatcatttgggctatatctatctgcatatcatacataatatccttgcaggaattaatccagcatccatatgagtgtaactcatacctaggctgataacaaaatctgaaaggtttttcactgaaatatatcaggtgactaaagaatttcacaacccaaaagaggagggtatatcgatcctagtggaattctatttcatggattttgttctgcctttattgacacagttagacattaaagagaataagtataataacaaaatttataagaaatgcttatggaatattttctaattttagctacaatgatgggttgtttatattctgtggtttgatttttatatcaatctttatgcagctattatcattacccaaacaagtagatattattgcccctttaataacagtgaaggaaactggaatgtaagaattgaggtaactggcccacacaccacaaagcgaggaagtaggaagctggaattcacatccaggtttgtctgttagaagcccatccccttgacctttctgccatattatctttccttatgctgtggcacaaaaaaagaattgtgaccataccatcttcccagagagggattagacaaagtccagagaacgtctagatggtcaggaactctagtcatggcgatgctagttactataagaggatacttggcaaacagcattgcacccagatggtgcgcaacccacacgtctctatttacgtagaggtctcaagtgtttgtattaacaggtttggaggataataaaaggagttgttgtttgttctttctttgtacgtctgaaattaatttttagcataaatttaaaaggggagtttgtaaattcactagacactgagagactggagatccaagcaaacatttgtctgttgagtttaaaaagatctggtgtaaaagtgattgttttctattttgcccactaggtggcgctttggtctcacaggttccttttaatgggctggatttccccgcccccccacctccccccaacccacctccccccaaccccaccccatacctagatgttggtccaggaaaaaaaaaaaaaaaaaacaattcaagactgattaagaggactatgtcagttgagtttgttcagtttgggttttctctatcattatccatgttgataacaaagataattaaacttatttgaaaattttggacactcctttttcaaccttcttgcaataaactgtattcacttattttggaaaaaagcatcaataaatggaactagtgagttatcttctcagcatgtctccacaggctacacttacaacagtctttcctcctacagagcggggcaagtcataggaagtgactaaaaccatgtcatttgggtgttcatattaagcacactggctatgagatcgccccggaatgtatacacagcccaacatgtcattttcttaacaccttaacatcagtgtggacaaaaacaataaggaacaatgttttaaacatgtttacatcaaagaggactggggtcataaggaagcagttcgatgggagaataaataacattattccaaattcaataaaactgatcagtcattctacaaatgtacactgatttgactcattccattaccatgcaagaattttatttgttgactgttgtgaagacattcctgtcatcaagaaggaattttctaaaattataacctgagatagtagtaagtgatagaaaaattcactaaatggcttttccatgaaataatatttatttatacctacttctgaatacctactatgtgctgagcaggtgcagggtgatgtgaaacatatattaaatcccttaaggagcctacagacaaagattaagagatggctgaaagatagtgtatccaaggtcacgttggcacagattactgaagtgagtggggtggcctggaagaacattaagtggacatttaagatggaacagctaataagacaaaggtaaaatgagtctagaagaatgactagactgagaagagaggaaaggaaagaggcagaaatagtagaatgtagaaaagctttaggcccatggtgattatggagaattgcagaagtccagtaatctagagcataataatgcatatgtggaaagagtgggaaattggggccataggtagaagccagaatcagggactttgagtactaaattgagcatgatctattttctagaaggtataggagagactttgaagaaggctgtcacttgctccccacgtaaccctctaagaaggcatgccattcacttccactttccagaagacacaggtgtgtttccccagaagaccatctggatccagaatctgtgcagactgaccatctatcatggtctttccttgtgggaattttaagtcttgactttccttctggagctttccatgcgaccgaggaagtgattatacaatagcagatgagatccttggtataattaaggattgcttgtcactttcaacatttccccccatcaaaccgtggacagagaggccttggaagggtttagttctgctaccatactcatttaaccctgctaagcatattttcttcagcattttgcaagcagaaatttatagtaatgttttttgacactaactctgagtcctgcattctctgcctgacttgctgtatttgaaggtggtagcgaaacacatggtgtatgtgtatgtatgaagtaggaggcatggtggtacagatttagctatgggacttttcagctttgcctgtatgaaattcatttactaagtatatgtaagtgaaattccagcaattcagaaagggttctggaattgcttaaagcccatcactgcttgtgaattcttcccacattaaaatgttatcttacagaaggtcaaaatgtctttcctgcatgaatataataatgacttacaccttagactgtaaccattgtgaatttattctatgtgtatctatctctggttttctttgttggagtggcaagatttaaagcaggccaattttatgcctcattctatgtgcaccaaaactacttacatgatattggttttcagtgcctgctacaacaaaaacaatatcccagtaacagcccactttactttctgtgggtagacaatgccctcacaggggttattaacttctcccagagaagcttttgtctttgcaatcctgaatgcatttctcttcatattagattttaccagtcaccttgttgattatgaaatgctaagtcagggtctttattagactgactttgctttccctttaataattcaggtaattattatatttacagaatttgcctattttttgaaatcaacactttgttaatcaccagacccatgacaatctataagtagccactttacgtggcttatagatctaaagtgaatgttggttttcacacattcattcataactattatttttactgatatattaggcaaaatataagattcatttatgagtttgttcatcagctagttataaaattcctgttgcatggtaagtgctgtctgtattgggcaacagagataaaatgggaaacaaaacaaaaatcttccctactgtcatggggtttacaacacctggacttctcaaaggacactgaatcaaaggttcttctctaagactttgtatgaagtcttagtcagaatcaaagatggttggcaccatcattcactaaagtggcctgagaagtaaaaaacctctgtatggcaaggagcagtgggacctctctttttttaaacttttattttaggttcaggggtacatgtgcaggtttcttacttaggtaaattgcgtgtcacagggatttggcatacagattattttgttagccagataataaacatagtacccaatagcttttcaatcctcaccctcctcccaacctccaccctcaagaaagccatagttcctgtcattcccttctttgtatctctatgtactcaatgcttagctcccattttttaagtgagaacatgcagtattgggttttcttttcttgtgttagttcacttagcataatagcctctaactccattcatgttgctgcagacatgatctcattctttttatggctgcgtagtattccatggcatatatgtatcacattttctttatccagtctactattgatgggcatttaggttgattccatgtctttgctattgtgaatagtgctgcaatgaatgtatgtgtgcatgtgtcttcatggtagaataatttatatttctttcagtatatatccaataatgggattgctggctggaatagtaattctgttttaagttctttgagaaactgccacaaccattggtggggagctagtgcagttgtttggaggtaagaaaatactctggcttgttgagtttccagagttcttgtgaaggttctttctcatttgtgtaggtggatgttccttcaatctttgaagttgctgtcccttggatggatttttgttgctttcatcttctttgatgcccttgggggcttgattgtggtataaggtaggttcagtcaactcatttaagttcgcttttccaggagtcactggggaccaggaatgagtcctggtgcatggtaatcccatgcagagttcccagccatccctctgtcagcccagcacctgtgtcttcccacatccactgtcaatgccttccctctgagatttgctcagagtgcgcctgtcttcgcaatgtccccatctcttggtgacagatgttcctcttggctgcatctagtcagccatcttgaatcaatctctggacctctacttaatatccctgagaatctccttctctgttgtcaccggtgcaccaactgccaaagacaccatttttgcagtgtttggtggggggtttgtttacctctacaattgcgtaactgaatgaccctgagcaaacggtttaacctttctataattaacaggatttcttcttacatccaagccctccctgctgctctgacccagctgtgggtgatagatcattttcaattctgcaaaccacggctgagaaagatggcagtgtgtaaggctcctctgatagattaggaatcatggaaggaagggacattggctgctagctatggctgctcagacagacaacccatgggtcttggttctctctagtggatctctacagggcttccttaaagtcagaggctggctttgccttaagattcttgagcatgagtagaactcccaacccaaagtaaagagagcaaaatccagagaaggacttttctccattctaaggcccgcctcccaagtccttaatttctgttttaaggtctggctcatctcaagaagaatgacacttgaaattatgacacagaaagaccctgtcttctacccaaaggggtgtggcattgtctggtgatgtgggctgcttaagcacgtttaaacacagtagtccaacaccagtaaatgataccctacagcagggagatgtttccttatggttctgttgaattctctggcagaatgtgaattctatccaacctcaagatttgttgcttatctagtacgattggctgccttgtccacaacatcctaaaggccctctgctcttttctcttaaagggcactctaaagtgccttcccagtgtgtaggaacaggactgaaagggccgtttttcttggctgctggtgactttccaaagcaagtgtctttcccttctcaccttgtccatggccccttgtgccctttatttgctctttctgcctgatgtagcagccacaagctgagagggctttctgtgaagtggcaggacctgacataagcagctttgtgcagtgggaaggaaatgtttatgttattatacacctgggacctctaagtccacaaggttcactttttattgtacacctgggccatccttttctacacttctggctcaatttgtttttggtttggtttagaaggttttcttctccctaaaatctcccttaagtcttaggccctttttatgcagaaatgcctgatctccaggctcaaaaaaagcatcttgtgcaagggaaatcgttttagatttaggaaacctcttacacagtaaatttgaattttcaaggtgactgaaaacttaaattcaacaaatatttttatccacctagtttatactcaaagtgtgctagatgcaagggatagcacggtggtaacgatagacatggtcccagctctagtagagcctgtgatctggtggagaaacaggcactaaatcaatagctacaagagtgatgaatgttacaaaagaagagattccagatgctacaggtacatagagcaggaggatttaacctaatctaggggatttggggagttttcatttaactctgctgttgtctaactgaatgaccctgagcaaatgttttaacctttctataattaatagcatttcttcttactcgccaagctctccctgctccagccaaggctcctgggtctatgaactgtaacgtcaagagagaatactgtcaacaacagtaagcctgactgcagagagtaaacacaaggagaaaatggccttggaaccacagagtagactccagagtatcaggaccatttggaggagagaatggggaaaaggctcgtgggcagacagcagtaaaccctgtgatagacattccatctgtccattagtataaacctggcacttagcccagtgatcctcaaatatttgtggaatgaatgaaatgcaaagcaatgtcaatttctgtccacagctgcttgactcttaaggttagtgttgatccctttggggaatataggcgagcagatgaccccatacattggctaactatgaattgagtggatccaatgaccactgccctccttgtgcagatcgccccacggatcactggctgtgtgtgcccatctacccctttctacaagaacttttctagccctgccaagcaactggttctgttcatgatgctgtggggttaccacaaaatacgtaatagctccattcacttagaaagactcatcctagataagaattatcctgcctcatctacccctccctcatagtttttcatctcatccattccctcctcctccccatgccgttatcaactttatacattggaccccatcctgggactcatactctgctaatcctgttcttggagttagggaggttattcaagtggcttggagaggagatggggaaagtcactctagacaagaaacattcagactctacctaggactaaggtcaatcacaatactccaagcattactggagcaaattataaccgtagtcgggtcagcttgcacattctatgctatatatataatgagggagatatagttttcatggcaggttctctgttaacaatgggcaaagactttggggattgatgtctgcagggaaaggatagaaggaactgaaacttctctccacagaagcacctgaaacccagtctgtgggcctttcgtgtcagaatctagtgaaatgattttgacaccacacacggcaaatctgtgcatgtttttctgtaacaaagaactgagaaaatcaggagtccttatcaaagggaacctttgatgaccctctggtggtcaccttttatagtgaaaatgtttggtaaatagagaaaaaggggccaggcatggtggctcatgactgtaatcctcgcactttgggaggctgaggcgggaggatcacctgaggtcaggagttcaagaccagcctggctaacatggtgaaaccccatctctactaaaaatacaaaaattagctgtgcatggtggtaggcacctgaaatcccagctactcgggaggctgaggcagaacagttgcttgaacctgggagacgaaggttgtagtgagccaagatcatgccacggcactccagcctgggtgacaagagcaaaactctgtctcaaaaaaaaaaaaaaaaaaaaaaaaaaaaaaaaaaaagagagagagcaagaagagtgaaagttataaatgaaaacaataaaaaaaaatccaagaaactcaaggaacctttgatgggaaaactgggtttttctctgacctcactactttcccttaaccatcatagccctgccacttctacatgcattggaggaagtgatttctccactttctgagatcctagaggacttaatttgcatctctatgataagaattttaccattatgatctttttattctcatctgttttattgctacaggattatgggctcctctggacagtgttttattcatcttcctctctcactctcctttacagagtaggcccctaataaatatatgcagaatgaataagcaaaatcaataattaatagatagcaaatacattcatgctgacttctatgattctttttctcttttctgtcttaggtttttaaaagtagtacaataaacctattgctagtgtctcaatatttgcctccaagagaataaattgtccttttaagaaacaaaactatctttatctaaatcaaggctgaaaaagatatctaggtacttccaagttactgagcacccctgccctggctttcaggaattacagctgctgattaaacatctgtttccctgccttttctctacttattatccttctctacttattcatccttcaagactacttgaatttttatcttcttactcagtaaaggctttctctgtctaccaaagctggaaacgtttttttcttttctgatatctagcatgactcattactattcccattcattcagtacagatgatgtagggacaagcactttggagacagtaccttggttcaagtcctactgtgctactcagtgatggtcagtgaccctttgatcttgagtttcctcgtgatgttgataaactcctgtgttgggatgactggtctagagggtgagatgaggatatgcatagaagatgcctattccaacacctggtgcttattgagggctccattaaaggcaactgctcttattatttgcatatatcttatgccatgctctagattgtaaattcaagtattatgtatctttccaaataacagcatctgacttcttgctttcagtgagagagatagtcaataaataaacatattatatcatgaaagatagtgataagggctatgaagacaaataaagcagggtaaggagagaaagaaaagggccagggataatgtaattgaggaagacttctgggagaaaggtgcacttgaatagagattgaatgaagtgaggaaaagaattatgtccgtgctcgggtggaagcaatgcacttgataggtacaggaaaggaaactccaaaaggtgtagaagaattacagcatcctagtgacacagaggcccatggagtggagttttgcaaggaggaaagtaatcctcagtttcaaatgcagttgagagggctgggagggcaactgcagagaacacttcctggattgagtaagtaagagagcaagaccaatgacagtggattggtgagaacagcagacttggggatgccctgagtaatccaatgagggaaaccaagacaggactgtaaccagagagagaaatggattgaaaggggagttagactttcatctgaaagacttggttatgtgtctggtagagaaaaaaagaaaagttaaaaatttaggagagagataataactgacagcatggtcttgaagaaggcaggaactgatggtttggtcttaagaaaagaagtgataccaccacatgcagggtaaagagggaaatactggatatggataaggctagggatggcttcaaggttgctttcttttcctttcccttcccttcccttcccttcccttcccttcccttcccttcccttcccttcccttcccttcccttccctcccctcccctcccctcccctcccctcccctcccctcccctcccctcccctcccctcccctcccctcccctccccttcccttcccttctagatggatttccgctcttgttgcctaggctggagtgcaatggctcgatcttgtctcaccgcaacctccgcttcccaggttcaagcgattctcctgcctcagcctcccaagtagctgggattacaggcatgtgccaccacgcctggctatttttttttttttaatagagatggggtttctccttgttggtcaggctggtcttgaattctcaacctcaggtgatccacctgcctctgcctcccaaagtgctgggattacaggtgtgagccaccacgcctggccgacttcaaggtttctaattaaatatatggcagagtttgcagctgagactgcgggtcagggtggtgagcttgattagaggggtggaagtttaagctagaatgaataagaaaagaaacccatcaaggaacatttaaaaaacaaagtttgttctctttgatcttggggaaagtaagtcatgtactccatttagtacaaataacaacccctaaccacattgtccatattgcagggtttcctaagttcacaccaatgaaccaatctctgtttatgaaatgcgctctgcctgtgcttgcattttacacacacacacacacacacacacacacacacaccactctacatctttgccaattcataaccaatcacctcaattatggagggtgatagtcttttctttctttaattaatgagtttccagtttagatgtgtgatctttacacagtactatttaatactgtgcagtttagattcaggtaataccacagtggcagttatttctagcagcaggtgtggttggttacttttatagacatatgctcactgtgatccagggactatgttggacacttgatacctatgttatcatattgaaaatccttacaaccatactgtaagctgactgatggggaaactgaaatgtattgatattaaggaatttgctcagggtcgcctggcttgttaaggtaaactttgaggttgcaggtgcgggtctgggaccttaaacatcatcatgtcacctagctacagcaagagccagcagaacaatactcttcagcctggttttgatatggaagatgctcttcagcttcatgctggcttgaatttcctttgcagtgaagggagaggagaaagtgcattttaataagcttcaattaaattaatttcattttacttcttttgatgtatggtctcttcaaaaaatccaattctactgatgtttattaagtgcctctacttacttggagagtgccaggcacttcaggggatctatggatgagtgtgattcagccctgcttcaagagctcacaatctagtggagaggatgggagtgtgcaatttgctctaatactagattgaatgtaataagtaccatcagaagtggcccaaactgtggttttttaattctgaaatgcaaggttatgtgactaattagaaaattggcttggcagtgcctaaacaccggaagcatcacacaatagaactcttataaagggtctttatttcaaacatgattatgcatttgttcaaatctatggcatacaatgagtgaagaatgtattgatggtggtgacatcatctgccaggctgtgaaggtcaacagtgccagcccaagttgtggcatagtgttgggtgatttaaaactcaggggcaagacagtaaactcacaacaatcccagtggtggtgcatgacctgcagctgttcttggttctttgtgtgttttggcaagcaacagctgttcaagacattgaactgcaattgcacaaaaatatatgttatgtgaagttgttggtttttcttcttttattactatagggtgcttttttgaagttaacttcggaaatattgtgaactcagaataggtcaagtcctatatattccagctaaacaattgtttaatacatttttaaggagatttaaaagtagggcagtagatactgccataaaattcttttccaggtttactgcaagcttttggaagaaagaaataggagctagagaacatgagctagtacaatgtaccatgtgcaaataggaatttaataaatgcttcccaattcttttttttaaattggtctcctaggtgtgttaggttctgtaatagtcacttccaaaatacacagctgaaaaaagcattgcttttgtcttctaaggttttatatctaaatagaaaggctggggaaatggtccactgacaggtcaaaagcaagatttctagtgtcatattattgggaacacacacgaagccagaaaatccatcatttcataacttttgtagcacttcacactattctaccaccacatagatgtttgcttccatatttgtctgaacatccttgcattttctttgccacactcccctgctgcaatcagtccatgcctccctgatggattggttgcagcagcatttggtgttgcttggatgaggtgatggatgcttctctctcttcttcagctacttggagccaaaatacaaaagtgctggttaaaaggtgattaatcttccctaatggttttgtgcattgcaaacaggactgcagccaccatgtcttcattagccttaatcagggcccacattacctcagatcaggtaatcggttatttattatagaacagcaggcaaaggccttttgagcaagtgtcaactgtataaagtctatttggaaaggaaaaatagtggggttccagttgccaagcatccatagggaaggaattaaagctggagtgtatttctgggcacctctcctgctaagcactttggttgatggagggcagcgggtggctttgaggtcatcaggatggacactcagtaacagccctttgccttttttttttttttttaacttcttttttgcttccagggtgacattatctgggtctagggactgaaacagtttgggaaatgttgtcttctgaaaatggaagatggatttttagtatctttgggggtttggtgtacttcttaaaatatgagtttagaacttgctgtatgcccagtaatattcagggtactggggatacagagatgagcacaacagaccaagctccaagcttttgaagcttacattgaatggaaaagacaggtaataagcaagtaaacacatgcaatagaataaaatattagcactttctgaaaaaaagcaaagcaggtaaggaaagaaagagtggggcagggactgatcagggaagtcttccctgaggaaaaaacatttgtgttgggattaagtgaagggaggtgtattagtccattctcacactgctataaagaaatacctgggactgggtactttaaaaagaaaagaggtttaattgactcacagttctgcattgctgggaaagcctcaggaaacttacaatcatggtggaaggtgaaggggaagaaaggcatcttcttcacaaggcgacaggaaggagaagtgccgagcaaaggggaaaggccccttagaaaaccatcagatctcaagagaactcactgtcacaagaacagcatggggtaactggccccatgattcagttacctcccatcaggttcctcccacaacacatggggattagggaactacaattcaaaatgagatttggatggggatgcagccaaaccattatcaggaggggtgcccagcattgtaagaagggccttctgtgcagagggaacagccagtgcagaattcattcttcaagtggctatgttccttttatttattttatattttgcacttcctaagaatcattccatggaatcaatccattccatcccttccataaagtacaagcaaagttaaacgagctgaagtaggtgaatcactagaacggtgtctggcatatcattcatgttcaaaaaaaatgtgagctgcttcctttcaatgtgcaactcaagaaaatgacttgccatccattcttacatacagagggtggctaccatttgccactgaaacaccatattctataacttcaggccatcaatgggaagcatcttccttttgcttccctctctcctttctctctttttttcttctcacctgtgtgctgaaacacaagtgcctcaaattcaggtttttaaataaataaaattcaataaaatcaaattcaggtttttaaataaataaaataaatgtaatctgcagatcacagagtgaacagctgatgactctgtgataacatcatatcacatccacatattccataccatgatccttaaagaatacatgcacacacagaacagtgggaacagctgaattaggtattaaagtggagtataaatagaaatgggtaagttttgtgggtagctgagaatttagagcatttaggagttcagaacatcattttagtgcaggaatgttggtctttcttgctaggatctgtagagacacatgataatgatggcctttcagggcttggtaaaacattgtaatctgtataatattgtgattatctccaaagctatccttaaaatgtttggggccctaacatcagtgttcaaaatcccaaaatattattctcatcagcaaaatattgctcctacacacaaggtacctcttctccttttttcacttgctaataataatagcaagtattaatataaggtatttgttgagcaattattaaatatgtcatctctaacacaacagtccaaaaagacaggcctaagttcttctactttatagatattgagactcatagaggcataaagtcctacagtataaatgagaagctgggatggccctggatgtgactgcctgtaaagccagttcttcactcatactatttgttatttttcaaaacattcaaccattctcttccctttgagagtttatcatttttctccctaagtcctggagaatctttcttggcaatgtcctgatattctattcattattttcctaccctagttctttcttttcatagtctttatcctttcaaatctagactgctgttcttttctgttggtcctccagactccaaataccttccagtatcagctagtcttatgcactgtgattggatagttaaatactactttgacacaaggctgccatcttactgttggaactctccactgttcttatagtaatcatcaggctctgaacactggcttcccagccctgtataatctcccccactttatttatccaaacttatttcagcagcatggctgaagtcactatccatggaactcactgcgtgtgttcccccgataccttgtctcaaactgtatgccctactaaaagggcctccaccttttctttacattctaaaaggtccagatcaatttttccctctaccgtgaaatttattttcccttctcctggcatattgatctttccctgtgaacactttctgtaaacttgaaaggtctataaaatggtcctttttatatagtctttcaatagaaacattttatcttacaaaagatgccccttactgaaaatggattattttctttggcgatgggtgactgttcagctgaaactaacagaaaacacaacaaatgttgacttaaccagttagaggttgaagacattaagtaagaaaaagttgagaagtatgctcgccagggtgaggcagctgtttaacgatgccatttgggagccactctcttctatctttctgtttcatcatccttgatgtatatgctttcagcctccagtttgttgcctcttagtcacagtatagttgctgcacctccaggcaagaggaatggaacagcagaagtccaggtatgtctcatcggtcagcattggtcagaattacataacatgttacccctagctgcaagggaagctaggaaattgagttttgagcttttaagcttgtatagagaaagtaggactggaaaaatgtgctcaagaactgatcttaagtaaataagcctatagtataaggcgcagcaaagcttaatgaatagatttttatattcatataatgctccattcttttatgatgggaaagatattagagtgaagaaaatggaatactggagtcagattcaattgttactgaatattggcactgtcctcttgtagtcttgagtaagtgactgttctttctgagacagatttcctcatctaaacatttggcttaataataacactgcctcttagagttactgtgatgattaaaagaggcgatgcctgcagcctatgatgtggcacatgtcaattctttttccctcttccatttgaggccctggtaggtgtggagaaaatcctaaaaacaataaaacaaaccaacaaacaaaccagaaaaattgaatcaatgaagacaatatctgccaccagctagtcccataaactcatttcaataaggaaaaaatatcaccccagtaacggaactgcaggagtgttttagatttatttatcttgtaattgagtggaaaggaaatctctgaatgtttgtgaaggtgttgacccatggatactaaggtatgtgaaaataactcacacatctcaggtgtttaatgaggatcaataacaatttgtgggcccatcagctctacagtcctatcacctcaaatcacacacaggaaccctgcttctgaaaagtggcacttgggagagagaatggcagagtgaaatccaattagcaagatctgcaaaagaggcacatgtgccagaatcatgcgtgatcccagaaaaaaaagtatatatatatataactattataattttatatatatatatatatatatatatatatatatatatatatatatatatatatatcatagcacattcttagcctacccacctcccactaccccaaaaagcaggacaacattttccatatattctattgaagttttttttttttttaaaacttgttggcacagaagcctatatctgtagatattttaaaaactttacttatatctatttgaaatgtgttaaaaagccatatattctttttttttcttttgataaaaggaaaagcaacaccctaccagatgttgggaggaatagtaagcaagtgattcaatcagatttctcctatggggacatagactctctcggtcaatgtcacagaatgaaatagtctcagattcacccagcagtgagttattccatctggttgtggcaattaggagctgaagatgacgggaagttaaatgactatctttatgaaacaaagcaaaatagaaaagggaacagctgggggactggatggcttggggatgcagaattggatctagaataaagaatctgttacttcgagttgctagttataatgccagtgcaggttaatacaaattgaaggttgctgctgtgtgctagcagttagctgtcgcttgcctgaaatatgaccataacatttacagtactgtctggattgaggtctctagaatgtaatgtcctttttacttaagggccaagccaccagattaactacatagacagggagtcattgaacttcagctctggaaaggatgttgttaccaagttcagtttgtgaattgccaggaatgttatgtgtcttttctttgcatgtgttatagtctaaaaagatgcatagcttttatcaaatccaaaggaaagaatgtgaatccaccagtccttttctaccctcttcccctcttcccccacaaaatgtgaagaacttgctttagaccttgtctttggagttgggtagtctagaacataagcttttggcttactgcttactagctgtgtggccttgggcaagttatttaatctctactagatttattttttctaatttatacaatggggatgataatattgtttatcctattccataatgttttatgaggaaaatttgaaataatatatgtaaatcgttttactgtaacatgtacgaaggatccaataaatattggctcttattattatgttgaggtatgctgaaagttagtggcagaaacaggaccagaacattgatacccaactcactactctggcctttggaaaacatggtgagcctatctctcttcttatttgtcacacccttcatgttttggcaggactcaagagctaacataaggtactgaaatcaaataattacttctaccattacagcgctaagtggtctacttctgcattttgagctctttttcagaattctttaaacatcttatctgcactgcagtctggaaagggaaatcacagagagaagggaaatcatactttggctttccaacaccctctacccaagttgcccaagacaaaactgtgagcaaggttaaacgtctgactcattagtaagaggaagtctttttaggcagttcctctgttgaatagataaagtggatcaaacaaaagagatgacagattagaaactgtctggtggctaatgtactgtttactgcagtataaatgactggtgtttgggaaatgacagatgagagagaatacaaatgtggacgtaaataatttccaggtttctacagtggaggagagtcatggttggttaggatgttgacagggaagggggaagtcattggttggagtttcagggaaatgagaagagcatggagaggacttttgaattaatccattgatccacgagttaccatagcctccgtgctgcatacagaaggtaccatgaaggggtatagttcttttgctcttttctcactgcctgatccattctaaatgtaactcttgttccagaccaagtgcagaaatctttacagagagaaagcattgggatggggatgaggctatgctcagccagtctgggagatctctaggggaaaatgtcataggaaaaaatagtgataaatatgcttaaaagaaggcaaggaagaaagcaaggaaggaagaaataaagaaaaagagagagaggaagaaagagagaatgaaaagaagggggttgggagggaggaaataaaagaaaaaagaatggaaaggaagaaaggaaagagagaggaaatatggtatatcagttattctgcatgatatgtttgagttgagtttgtggtggttacttgccccagggtatcaaaagaagtctccaattaatttgtagccagtgtaaccatatagcatctatttgcttagttttcaataataataatactggttctgattaaataaagcatattgtcaaacttattatttgcaaacatattactgttgtaactggtaattgctcagatctctttcggttcctgccccgacacccaaaagtcaagagggtggaaggtgaccctttctaagactttgacatggaaattctttattctgtttcaggaatggcaaattccagtttacagatggatggaaaagatttcttccttgtgataatagaatgcaggacagtatttctcaatagccatgccaatgacattttttgactggttaattctttgaggggattgtactatgcattataggatatttaacagcatccctagcctctacacagtagctgccagtagtagcctccccaacactaattgtcacaataaaaatatctccagatgttgccaaataccccttgtagaggcccaaaaatgccccttggagagggctataattgacatttttgaccggataattctttggggcaattgtatggtgcattatggtttgtttgtttgtttgtttatttatttatttataaaacagggactcatttttttcacccaggcctgagtgcattggcatgatctcagttcactgcaacctctgcctctgaggcttaattgatcctactgtcttagcccccccaagtagctgggactacaggcatgaccactgtgcccgtctaattttttttcttctttttttttttctttctttctttctttttttttttttgtagaaacagggtttcaccatgttgctcaagctggtcttgaactcctgagctcaagcgacccacctgcctcagcctcccaaagaatagaattgcaggtgtgagccaccacgcctggcccattatagaacatttagcagcattcttagcctctacatagtagatgccagtagtagcccccccaacataattgtcacaataaaaaaatctctaaacattgccaaatgtcttttggagagggccacaattgttcccagttgagaatcacttcttcaggatagactgttgttaaaccattgattcagattcccagggaaagactggacactcagcagccgagcatcctgctgacccccagaaccctgccttgacacctgctcacaaacccctcctctccaccctcaagggcaaggtgtaatttagctgcagccttttcccaaatgcctgtagcttctacaattcaatcttttttatttgtaagtatctttgcagttttctactttcaaaagactcttagtgatttctaatacctcaaattgtacaggtacatggctttttgtctctttctctgtgtctttttttttttttttttttttttagcttttcattgtagaggttcctactttttattttttctttccatgtttattgcttttgtgtctctgtcttcctgatttcattttggtgtggaaactgtctttctctgctattatcaatatcttactacctagatctcaatttcattttatggtttagccttttggtgtttatctccccagtcgctatcatccttttaatgactatttgtgtttctgggtcttttttcgtgtggcagcttgtcttttggactgcctctctctgtttgtatctttccagctattttttatagtctcctcctacttttggagaatagcgatatgttgttatgacatttctatttgtgactgcctttttcctctattgacttcccttcccctttctgcctttcttttgaaaatggcccatctggattaagtttctatcaagatctctttctataagcaggatttttctcaggtatgtaatggaaaccttttacttctgttgaatggtaatcctaaggggaggtcagggaatggacttttcagttaactgctcagaggcaattgtttgttttactttatataatcgaacttttataaaacttagaatattaaatccagcaaggttaaatatttagccttttgttaactttgtaaaataaaaatagaacttaaatgattcattataaagcaattatcttagaaaatgaataggtaacacattattagaatcaatttgttctcaaagctatgagaaataaaatcaataatttttagagatagataaagtgttttaggtaatgtttgggaataagaaactataagagtaggatttggctatttgcaaagtacctgacttttcccttggttcctaaagaatttcgaaacaaaatgagggcactataaggttcacaaggactgaaaactatttgatcttctcatttttggaagaaagtgagaatcgtaatatacttgcgaaacagattggattccatctggtgtagccaaattaatccttctttaatgattgtttatattgtgtatccaaaatcaaactcagtatcaagagttaattacaatttataatcattttggctcaacaaaacaagagggaattgtaaacagtaaagtttattttatagtataaacatgttaaaaacatggatcttcattggaccatatgtaaattaatcaaattatctccagtttttgttgttgttgtctgtttgtttaaacgtggtgcaggaaaaagcaatggctgctgagactgcagaggtttgtgaagaagtctgttaggttttctgaacattcctcccctccgaccaaaaaaataacccaaccggactaagacaaaaaactgagaaaaccaggatggaaatttgacagaggtgtaggaactaaacaaggaaagggaatgtttctcttctctctagtgcaggataaatttcatcagttccctgtctgaacctcattaaccttaataatacactatcaaaaagtcaactctatgcaattagtatttaaaggtacttgatattttaggtgggaaatttattttctctgaaaaatcacacatgcctccaacaacttgaagcttgctaaaatttatagcaataacattgaattcaattacattcaatcaaattccaggcatcaagtcgttattaaacatttacctctatggtcattgtgctatggttgggaataagaataatactaaggcaagatcttctcctttacaaagctctcagctgattaggaatctcataaattgtcaaatgtcactgtttcagctaacaatgtttctaccataaacagaactgactcaaaggggcaaaaagtaaataaagtacatgacatgggagcatactctcacctgagccttagagaggaaactgacatctgtcaattcacttgttctgttaattccactttgatatttcttaaatatatccactcactagggctaagccacaccataactgacttctaggcattcatctttcttccacttaaattcattctccaccttgcagctatttagttagttcttctagcaatacattggttaaaactagtcaatgacttttcatttctttcaggataaaatgcagtatagtatgcagtggtaggaaattaagcactagaatttgtgtttaaatcctaatttcctctcttatctatctctttgccctggagcaagtaattttactgctctatggttcagttattttatctgtgaaacagggataataacatcacttacttcatagggttactagtaggaaaaattagttaataccagttaagatgatttgtagagaaatggcaccttcaattaatgttaactgttactattgttgccacctctagacactcatcccttcgcactgcccttttctcatttttccctggattgttttgagtttcttagaacgtgtacatgctgttccctttgtccccatcactagactgactcctacttgactttcaggacttctgactttttcttcctccaggaatcatcttctaccactcctctgcatggcaggttagatgcccctcttaaatgcagggttaacctctatcgtacatttcacaccttgtatttacttgtttgcttccctattcttccttctacaatgcatacactttgagggcagaaactcagctctgtttgtctttgcagctctgtcacctggcacagtacctggttcattctctgcagaatgaggaaacctcaagcatccactgaagggaacagtgtagcatagctcatattaccaaatatctgcatgttagaggcttatgtgtttatgagtaggcaggtgtcttcatggaactctggtatcttccagatgttcataggtatatctggaacgatgagtatctggccaagtaatatatggaatcaggaatatgtctctcctaaagagttatattttgatcaacctcactcttactgcagtgggcaagcaggtacaacctagagttttccaaaccgttcagattatgaaacctgtcgttagtaatatattggaaaactcaattatagtgccctaaagagctataataagaaacacagtttggaaaatacaagtctgagttagtaaccaagatgtctttttttcctcttgattctaggattatttcaggaggttgtgagagacacaatgaggccttcagctctgggtagactagtttcagccggagctcttaatgggcatcaaccatcacaagttgaagccattcagggatgagaattcttttagctattagaacctgtctccatataaatatttctacctttctcctccagtggtattctctgagcagaggagatgggttgcatagtggccttaaaaggcacagccccaaatttcactggttatgtggacataatatgactttaggatttcttatcacccacttcaaaaaccccagggtcacttaattaaaatgactgattcctggagcctcaacatgtgccttctaaatcagacagtctatgaatgtgagactaaagccaaagtttgtactgagttctcctgtgactcttatgctccctcatgtttaagattctaccctgagtagaggccacttcaaaaatagaaactttttaatagttctctgtttacaaggtcaattctgttaagccataaaccatcccatttggaattagtactataattatggttcttatttcttacacacacacacacacacacacacacacaggttttttggaaaaaaaacatgttaagagaagacatttaaaagtttaaagaacttagatgttttattttgtgagaagaacaattttggggcaagtcgcttaactgtctgagccccgttgtaccatctgggaaataggaaaagtggcatctgcccttgctccgcacttgggatgggagagtcaaatgagaaagactgaaagcaggtgtaaaatctaaagtactaggaaaaacaaggtgttatgatgtcttgataaacatttggtaagataggagtcttgttacacataataacatttttctgagtaatctagtttggtttatttttctgtggggtttaagagtacattttgataactgagagtttaaaacaataatttcagatgtattaaaaattgtacgtgattattagaagtgacgaaaacttctgggattatataaaattgagttttatacaacattctctttgactctaacaagagttaaatgttaggaatcattgatgtaaactattcttaaatgattccacattccaagcaaatgctctggagaacaaataggagaatcatctgtgagattaactttttactgatgccatgtggagtaagattatcgaagcatcttacatttaagaattttacctcagacttaaatagcacgttaaataaaacaggcagaactaacaaatcctgatatcaactttaatttcaactttagctcttttacacttttataaggccctttcctcttataaatgtaaacctattttttaaatggaagctaatttgttaagtccattctatcagaggtaaattgaaaaatgccagcaggcaagataaatttgacagaaaataggtaaaatcaaagttttattcatgtacagtggttaagaatgaagatattaagataaattattttaagtgaggactgtccttttaataggcctcactctatagccttgtctcatttttcattttcacaaggttcttgatgtattcttttcattatataaaacgtgccatatttggtcttttcatgaaatgtatctgatattctcctttgacagccattcacgtgaaaagaaaaggtcctatttctgtccatcacctacatgcacatattcatagaaatcatagatttttggtaaaatatgctatatacttatacagcatcttaatctcagaaacccaaagggtttagatccataactgtaccatatttcctttctgtatgttgagagatacacatggtcaaatttcctaaaacctgaatctaactcaatctaaattatatgatttccgtttctacacagtggaacaagtgtgtgtgaaataaaatcaccagcccagaggcattcacccaaataaatcttggagattttctgcaacatttcatccctctacttctatatctaagtattgctacttctagttggatgtaaaatgcatccttctcaatttatttttgtttgtgggggatggatggaactaactgttcccccactactttataaacaaatataaaatgtggatgtgtaggtattttaaatgctaacagtagaattttagtatctagttaataaccctattggttggaatttaaatcttttcaggaggaaaaattaatcatccattatatcattcatcttgatgctgtcactttcttcttgaaatcagaaaaacatcgtagtttttacatggtagtttttccttgttggaggacagttgcattttactccacactgttaaatgcattaggccatgtaagagaaatataattctgtaattattcagaactcagttggttgtttatatggtattcagcaagatacttcccccccacctccaacttcttataacacaatttcaaagcaccaatcgtcttcctcttttaaagtaacaccatgactgattgccttaaatttatatatgatcttgttctaatgtcctttctaaaaataagaaaaaaatattccacaagtaaaacgagagtatgatagatacttcaccatggtgctggtgtatgtagacttgcgtgagggggaggacatggaatggtatgttctccattcatctctagttttatttcctagatgagttatgggtgaatactgtgacaaaaacaaaacaacaactaaaatggaaaagtcccaggagtgaacagaaaccaggacttaaactgcttcatcattattttattgtattgttttcgttttgggtttttttttttttttttttttttttttttttttaaggaagttacaacaaggagcagctaaggacagataaattggtagcagattgtggtttatgataacgacagtcccgaaggaacttggctttcttggtgacgttgaagtaaattgcattactcaagatgtatactaagaaggatagataatgaggtgtatgggggaaaggcatgatgactatttttatagtattgttgactaccaaaatgaatggaagggaaggcgggaccaggtggagttccttgggttaatttcgatgtaccttataaatgacaaaatttccacccacttctcttagagggataaaaatatttgaaagtgtctgaaacaattgccgaccactatttcaattccttttcctaacttctagtacctttgatttactctgaattcctaatttcttgttaaatgggaccatatttgtttataattcacctgggttaaaaataatgttttcttctgagaagaggaaagaggaagggagtgctctagcttcttcatccagaaacagactcttatgtaaaacccccaggagattctataagatatcagggaagattcacctaaagattaggaccctttgagcctgacaaatctcctgttgaatgccttgctttcaaccaaagctgagataaaaagtgcgcgcatgtgcacacatgctcaaatacacaggcagaaagctctcagctacaagacctgcttccgtagtttacagagcacctgtagcccatttcccctgtgttttttaggcaaatctttgttatcatggtgtatgacagccacatataatctgagtaccacttcctcccttcttaattttccaccatttatgccaattagaagcaaaataaaagggatgatttctggtcacttaaaatcggggtgaagcaaggatggaggttgtcctgcaaaggcattttaattctaaagaaaaaggagattagtggcctctacccatcttagagaatagagtgtcctgacaccttcccttcctccttgctcagtattctccctctccctagtgccacattgagaggagattcactcctaaaagagtgtgtcattttaagttgactttcttggagctgagctaagagccattgccaaggccagtgggcgtaaattcagtccgcctgacgggagatgaagggttgtgggatttatgacttatttgagttctcatatatcaccctctgtgtcgctcgcttatgatggccctgccaaaagataaagaagtgtaggacgctggtacgggctgtggtgacaggccagggacaaatgtctctgttgggtaaattgatttgaatgactctagtgaaatatcaggttaggctgaaaatatgattgggtttaatgatcctgctgactttgtagactgttgggattccaaatcctggacaagttaattaaggcattctatgaagggggtgtgtatgaatatttgtaaatccatgtaattattaatgtcaataaataccaccatgtaaaaactcagacctgttctttcacataatatattgaatgtccattgaatacagggaacattacttacaatttatagagtatttatctgggaaaaactgttgagaacgttattttttctccacatcccagagtcaacaagcagagaccgaaaggcataaaaatgtggaatgaaaagatagagaagagataagcagtttattctctcctggcaaaatttagtagccttacccttaatagtggagaagaaatttttatgtgaaattggggttgttttaggccactaacccaaagatcaaatggattgctttttcaattacaaaaacacatatattgttaccttattttttgaatgtggctattcagttaaaaataatagagtttagatttctttgtaggaccaaaattttttcagcaggtttctgtttttccacttaaaattgcttccaaatttctgagtttacttctaataatgggtatgctctccttgctatttttatctctaggtaattgttgactgcttgtagttttttcttgttgggcatgaatgactggcttcatcttccaaaagtgttacaaaacaccagttatttctttgagctttagacttttcctttgcagaaaggagccttatttacatccaaatgaattcccaggagagttttccactgatgccgactggttaacagaagtacaggcgagcaggaatccctcgctacctggcctttcgttccctggttccatctggatctctgggaaaattttccatctttatttgccataaagtatgatttatttatttcaacgagtggctaagagccctggaatgccatctttaatgagtgtagggaggatggtaaattgggtttagagaagaatattgttaaatatgttcaacttttagaacccaaacaaaaacacaaccagtgtcagtgtttgagagtgctgtactcatctgtgaacgtaacagagaggaaaggtgtctccgaaagaactcttcattcttaggagaggccccagaataatcacaaaacttggaactgtatctatggaatatagaggtttccttgtcttggagtggattcttagagtaaaacatgcctatatccttctgttcttttatcaacttcaactgactgtgaatgatgtactcactgagaaaaatccatttgctcaggtctaattttaggtaatttctctttctgtatgttaatggaacccataactgttttgcctactggtttccaactgaggattaatataacagtttccactcaacaattgtattgcttttttatcccccttatttccttttctttcttcatatgagaatattgagaataagagagattaggaaatttacactgcttctgagggacaaggcagcttttggacccaattatgcatgcctctgaaacacatgttctgcaccacaccattttttctgttatgtttgagagataaaaagttgtccgtctgtctacctctccaggctaatgtctcaccacattcaatcaaacttctccttccccaggccaggattcatgcagtccctacctgtaatgtgctttttcatattcttttttattttaaatagagacagggtcttgctctgttgcccaggctagagtgcggtggtgcagtcatacttcactttaatctcaaactagactcctgggctcaagcaatcctctcatttcggccttccaagtagctaggactataggtgcatgccaccatatctggctaaatatatattttgtgtgtgtactttttgtagagacaggatcttgctaggttgcccaggctggtctcaaactactgacctcaaatgatcttcctgcctcagcctcccaaagtgctatgattataggcctgagccatcttttcattatctttcttcagatctcaaattatttgtcactcactggaagtgtacagctaatctgaagtggccttccacagttcccatctcgctcattacctggataatttcctttatagcaatgaccacattttggtattgttttggatattggttaccttgttaaatgcctgtctgtcttatctcctccaaccaaaagtaaactctctaagatcaggaatcctgcctaagtttttggcctgcatatcatcagtgtcctgcatatagcaggcccaatagttgttctaaaaattaatgtatacctgaatgaataaaagctcttagagtgacagaaatgtaaacaaatacttctaacgctaagaaaagtttgttacatgttctaacaaagatttaaccaaaatgttgtggctacaaagaaaaagatgggtgaagaagaatggacaaacactaggggaacatgagaaagttcctggaagaatattgtcatatatgaattgagactggtgcatggtacaatttcatatataaagatagtggggaaagcattcttggaaaagtctcttgttgtgaggcattacccagagttctttgtcttaaaaccaagagaattaaggagcatggacagaaagggtgaggttggagtgaaagtttaataagtgaagaaagaaagctttccaccacagagaggggtcccggaagagggttgccatttttacagttgaatgcaaaagaaactgatgagggctgggtgtctcatgtgcataaggtgtgaatttctggtagctccaccttgtcctcctaatgcgcatgtgggctcttagcttgagttactccatattgctttgttccccttactgcacatgtgttgaggtggaatttttcattgcaggcatgtctgggcaagtcacctgtttagcctttcttatctgtgtggctgtgggcatgtcctagttaggcaagtcccattttccaagttcccttatctgtgcctgcaggctgttctttcctttgagagaattcagccaaggacccaccctaactgcctgcctgaccactttcttcctttctcctctctcataatgatgtaacagtaaaaatacctgagttcaaatcctgatttttccttttaatagctgttgactttgggctatgtgcttaaaaaacattttttgcagagctttctcaatacttggcacattattgtcactgtttctccctggatcttagttttttgggttgctaagtgagcataataatccatagttcagaaatttttgtgaaataatgtatgtcaaagagcatggtttttagcaggtactttcattcatagagatagtagctgagtttaggtgacccgttaaatttgggaaaggattatttaaagtcaaggagcagatccattatgacaccataattagaatggataaccacatccgcagaaagtgcgctgcactatgagtaaatgtaattttgttcgtaaagtgctgggcctagggttaggggagataagttcttaatatgtcttaatatagccttgggttctgggatatgctaaaaaattattcaactcattagtgtctcagtatccttgtgcttaaaattattattataaaaatacctgaatgtgaacttaacctcttcttgagagtttcagtaaggaaagtgaggctcacttctttctggaacattaaacttaagcaggaaggtgccacatgaagtattatatcataatggaagcaatgtaaaaagaagagtgagtcacttcatcaacttcacaatgcaaaggtgctaccataagtcataattctaatacaaagatttatataaataatgattctgggattagccagatctcctaatgttctagggtttgtcatcatgaattgtggtatcacttagtaagtacatacttaaagagaagaataggaggggagggaatgttagaagaatagtgaacaactaaaaaaatgtgagagatagcctggagagaaaagcaaaaggacaaggcaacacaggaaaaagcaaagtggagaaacagatatgcctagcaagaggaaaccaaagttagcccggtagggtattgttgcaaaaggaaagccggccttgtcatttatctaaccaaacattccactcctcagtgatggggtagctgctctttgaaagacaagcaactgtgatggggacctgtcagtcttccttacatgcagctggttctctaaatattccaacgattcctatcattttctgtaggagtacctgcaaaactggaaggctaggctgatggctttttctccattaagcagtaaacacgttaagcaagcttgagccaggttctggaggaggtcatcttgcaaggataaaaaacattgcatttattggatgaatacttaatgcacggtttgccttatccctaccttagagatgagaaaactgaggctaagactagctaagtaatttacccatgtttgcatggcttgctgatgatggatccggatttgaattccattttgtctgactccataaatcatactcatgctagtacactgccctggcctggatgggccattttacattgtgtttttcttttatagacattaatatgtgtaataaatagaatgggagtatgtattattaaatgttaattttgaaatataagattgttttcagatggaatatccttttcattctttatgatccttaatgctgatttgaaaattagaataggaaaggtatggcaagtgtgtatttgtgatgggagtagctaacactgctcactttaacagtaaagctctgccatctgggttattgcaaattcttgtaaattggtatggcctgtcctgctgtcctggaaagggagcaactagcacaagagaaaccaatcaaaatgcagcaaaaggattttttttttttggtaagattttgcttaattatcactgcagtagaatggctagccaaagtcagaaatcttttatttctgctcagtgagcagcccaataaagcttcagaacatacagcacaaacaaatgccatttcatttttctttacttcttaaaaaaagttaatcaggaatttgttagaataatcctgtgttaaatcaagcagccagacaatgaaataggaattaaagaaaatgaaagtggtgggaattatagaaatattaaattatttcaaaaaccctaccaagtgaattggttaataagcatgtacaatttattgccctatgggtcctctttttacaggcatctttatggttcatcagtttgctcccatctacaccacctgcctataattcttgacaaaagtctgttttagatactgaaagtatccactagatttgagaacaaagcaaccctgtagcgtgagcccagagtccagaaggatgtgggtggaggcggatcaggatccaagattttagcaaaagatggcttgcttaagtgaagcagtttgcactctgcctctttattcagttaggcctggtgtcccttccagcaagaaaagcaactggaggtcctgaaattgcacactcacccaatttccccaaattctttacttctgaggactattgaatcacagagatacagcagtagacttcatgaagttcatctagcacctaggatcttgggatctatggcccgggacagctcctgctgtacaggtcttgggtaggctgccatcctctaggtggtggcggcagtgtggcttgtggttctttttgagtgtacactggctgccttacttgcgagaatctagttctatcaagtgtcagttaaaggccgtttttgtctctgattgcataacagggtatgtttgagagagacatcgctgagagaaattcaaagctaccatgtgaagatcctttcctgaatatagtgtggctacctcagatcaggattctcaagcttggcagttttgacattttggactggattcttttttgatgtggggaaactacctgtgcactgaaggatgctttgcagcatctgaggatgacccactagatattagtagcacctttctcccatggtaacaaacaaaaatgtctccagacatttccacatgtcttctgtagggcaaaatcccactggctaaaagccagtgatggagtttgtactctttgaaataagaccactgactttttgtcttccacctaattacgctcagtaagataaggccttcttttgaggtagactttcaacatctatctctgattctttttgagaaaacacgttgcattttaatcttttagtgaccgattgtccccaaatgtaaaatagaaagttgagggaggcagtagttatatgcacatattttttgagccagagttccctgagtttgagttaaggtgtcctgagttttgagttaaagttccctgagtttgctaccaattagctatgaaacctgggccgagttaaaagttagacctttacagtcttaagtctccctttttcatgtgtaagacaagggagaataatgattgtacctttttcataggttttgatgatggttaaatgagttgaagtagtgaaagctcatagcacaatggctggcccatgttgaatgcctaatgaatgtttgctataattactactgttgatgataatacttttgaaaacatagttgacttgttataattaagccagtgtttacatctgctttaccaaatacttcccatggtttttatctcagaaaatagactcaaaagtgaacacacacacacacacacacacacatatataccacacatatgtacaacctgcatcgtctaataagctcagtggttccatatactatatctttggccaaatccggggctttctgattagcacctctagttttttttttttttttcttcccactcctgctataaccattctcagcattttcttccagttttttccttctagaactactgccaggtgaactacaaattattttcttgatttgcagcccatgcaccaatgagaaaatgcctatggtgtcttttgattttatggttcattgcttaggccttgtcataaaaaccatggcgtctcttaaaagaaaatataaaacaaaaacaactttctcttggccagagtttatcaaacctatgcccataatggcatagaaatataggaaatgagacaatcctactcccccaatccccgttttctgtttatttgtttgattcctgccaaagcaaagtgaccttgagggggcaccggctcagtgtttgctttttctggcgctacccacacccctccttcttcatctcctactgctccccattcagctcctcaacaatcggcaatcactctgcccttctgctccaaatttatgaccgggagcaagccataaacagagaaggccaatcctgatcctaggcactgcaccttcctgtttgccagaggtatgacagcttgatgggactgtaaagaataagcctgcatccccacaagccgcatgaatcatgtcctaggataatgactagcaaaggctgctgcagagactgcaggtgactcagagccctgaggcagggctttccctaaaccacctagaacaaagggttcccatggatgttctctctgtggcgtcatctcacaaatgagaagacctcacccactctctgatctataaaagcagcctttttattctgtgatccatgtgaaatggcaaagatcactccagcttattgatgctcagagaattatgaaggtgccacctgaatgatactcctataggaaatatttggtgaacaagataacgttttttcatggatactatttgcctcctccagttgccgcttggtgtgtatattattcgccagtgattgataatgcctcgggaccacctagtgatcttgttcagtttctaatttagttgatctgaggtggggcctgagaatttgcatattttaaaaactcccaagtgatgctgatgcaaaacagctagaagagaataataattcaaataaatgttcctggtgtaaaggaaagataaatatttcaggtgatggatatcctaattaccctgatgtgattgtatgaatgtatcaaattattccaggtaccctgaaaatatgtatatctaatgggtaccaaaaacaataaataaataataaaaatctgctttcaccaactgatctaggtttaagcaatggagtaacatgacaccagtataacaccttttgcatttctgaaagcttccttcccctcctctttcccctcccctcctctcctttcctttccttctagatctgacagtagtagctgcagcttatgctttagatttgagatacacagttgggatctatgatggtccctgagaaaggacaatgagtagaagaagcaaggtgcagagaggatctaacaatttttgcatggacatgagatttggagcaaggtctagaagctcatatcagcaaggagtaagtatgcttgtggcttaaagattatggtcttcaagacttgctcctggactggaaatattcccctaattttttgcctaaatgaaatgtgctacaggcctgagtatacctaaatcagcttcatttttctgtcaaatccctccctgtatgcttcttccagtgatatgtcatgcagatgtccacaggggacataggatcttgtagtgcaaaaaacatgagactttcatcagacaatcagtcttgactctcagactcactgttgattctatgacctagctcaagctacttaactctctaaggttaaatatcctcctctataaaaacctgatagtatgtactaaagagggtatttttgaaaattacatgagataaaacagcctagaatgctatctgatgcaatagtcatccagtaaattttaatatcattctactttgaaccaggttgtttatattaaatttaacagaattaagcaacatacagtagcgatttattctgtgggctctggagtctgcctgtaagggtttgagctctagctcagcgacttctttactgtgtgaacattgatatgtttactttaatctctctaggccttagttttctggattttgaggcttaaatgagttattacttgtaaaacacttaggagagtctctgctatgtaataagtgttcccaatatatagattttatttcatctagttgaatttagagagtagcaagccactcccttcccgccccacccccgaaaaaaaaaaaaaacacaccaccaccaacaacccacttttagtgtggcaccatatctaagaaggtattctccaagacttctttatgtgaagtagttcagccttggcagagttaaaagttttcagttataatcttgacaaaaattaattgggatgtatcatcaatctagacaatagctaaaattataaagcttctaggagaaaacatgggaaaatatctttgaaagtgtgaaataggcaacaatattttagaatacaaaagcactaagtatataaaagaaagtatcaatagattcaacttaatgaaaacaaaaattcagctcatcaaaatatatacctaagaaaattaaagggtaaattttaaaatttttgttccccagacatagactgggagaaaatattttcaggatatatatctaaaaaaggacctgtattcacaacatatgaggatctcctgcaaatcaaaaataaacacaaacaataaaaataggcactttataaaaaagatacgtgaatggtcaatagtcccatgcaaagatattccacatctttagtaatcaagaaattgtatattaaaatcacagtgatgtatcattttataccaactaaaatagttaaaatttaaaagacggacaacaccaaatattggtgagcattagaactactgaaattgtcatactttgcacatgggaatgtaagatgataaaaccactttggaaaaattgcagtttttaatatagttaaacataaatctaaactaagacttcgtaagtttacttttacatatttatccaaaagaaatggaaacatatatacacaatgacataaaaatgttcacattagctctttaatagtctcaaaatgaaaacaagacaggtatccatcaagagtatggataaacaaaacacagtatattcctatgatggaatactaatattcaataaaaataataaactacaagtaaatgcaacaacatgtatgcatctcaaatacagtatatttttgtggagagaaagacaccaaagagtacatactatataatttcatttatatgaagttcaaaactaggcaaaattaacctgtgttattacagaaaacaatactaattgcctatgagtattggcaggaaggggcatgagagagctttgtgggatggcagaaatgctctacattctgatgggagtgttggtttcaggggtacattgatttgttaaaactcatccagttgtatataggcattccttggagatattacaagtttggctccagaccccataataaagaaaatatctcaataaattgattgacaccgattggcacacagctttatttcccagtgcatataaaagttatgttgacactattctgtagtcttttaagtgtgcaatagcattaagtctaaaaaagcaacatgcacaccttaatttaaaagtactttattgctaaaaaatgcgaatgattatctgaggcttcagtgagtctttttttttttttattttttgctggtggagggagggtcttgcttggatgttcacagctgctgactgatcagggtggtggctgctgaaggttggggtggctatggcaatttcttaaaataggccgggcgcggtggctcacgcctggaatcccagcactttgggaggccgagacgggcggatcacgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaaaaaaaaaaaaaaaaaaaaaaaataataataataataataataatatgatggggtgtgctgcattgactgattcttctgtttacaaagaaagatttatctgtactatgtgatgctgtttgatagcattttacccaaagcaaaattttcaaaattggagctaatcctgttaagcccagcagctgcttcatcaactaactttatataatattctaaattatttgttgttatttctagaatgttcacagaatcttcaccaggaataaattccatctcaagaaaccactttctttgcttatcatacgaagcaactcctcattcattcatgttgtatcatgagattacagtaattcagtcacattttctcctgtacttctgttctagttctcttgctatttccaccacatctgcagttacttcctatgccaaagtcttgaaccccataaagccatctacgggggttgacatcaacttcttccaaactcccgtgaatgttgatattctgaccttctcccatgtatcatgaatgctcttaatggcatttaaaatgatgaatccttttcagaaggtttttaatttactttgcccatatccaacagaggaatcactacctatattagctatagccttacaaaatgtatttcttcaataagacttgaaaggtgaaattactcctcgatcccttcaatttgtaaaaaatacaatatatataaagcacgatgaaatgaagtgcaataagatgagatatacctatacctaaaatcatgggctccactctgtataaattgtaccacaatttaaaaatgtatatcatatatatatttaaatattataataaaactaattttgaattattcttgattctaggcagtctctctgcaggagtctcactctgtttgttagactcttttcttccaccagaatttctgtcctgcagctcaccattatctagaaaactgagaaacaggaatatcataacagtaaacaaaagtcacttagttgattacatgcatctctcaaaagcctgtaccttctgctatgattagattattccagaagcctcttctggaggaatctcttacatttgcccttcatctatgggattctgcactttcgcctttctgtttctgtgttgtcctgagatatctcatgtagaaatgaattgatggccctttatactgcggttggactcttcattcagattttttcaaagcacattataaactctaattcattaacgtcatcataaatggtaatgtcctgtgaaaaagagaggtggtggcaccaattaaaataatcttcttgtagtcacacatcaaatcaatgtcagtgcaaacacttgaaccaccagttaatgcagccccatttctttttatattgacaacagcacagtggttgaagctgaaatagaacctcagttcatacttatagaatatgccatgctgcacttaacacatggatctacagggagaaggaaacagaagtgaacatggactagatgagaatctgatggacgatatgtaccacgtgctttgaaatagccataaggatgtctgcacaagaatatccatgcattcgttcttagaatttcagggccggttgtagctcagtcattttgccattgacttaattgaaatccaaatcaatgcagacacttgctcaaggtcacatagcttgttctctcccagctcccctgactgccggcctcaagcccctgcctccacagactgtgggctacagattccccaagagatttccttattccctggattctcctaagtttgcataacagaagtacttaaatgcatcacttcatttgggtatgggattttaaataaataatatgatacaaattctctcacactgcagagagtctaataatagcttacagtaatagaatgaacactctgtgcccagaactcctttgaatattttacataacattaacttaatcttcacaatatcctatgaggggatactattgttatcctcattttattgctgtggatgctgacacatagggaggtttaaaaccctgccccacataatgcagtttgctagtgatagagccagaatcagaatgttgaaggttggttctagcagccacacagtaattgctctgacctatctcctttctacaggaaatggggtagaggagattcgtttcctctgaaaaaaaaatagctaaaacctcaatgatgaaaacctatgagtgactaatgagtatgacagctaatactaaatggacaattgtcactgtgctaagtggtttatttcatttgaattatcacaactcaacaaaaaaaagttattttcatctttctcttatacataaagaaactgaggcaggcggtgttaaaggaacatgcctttagccgcacaggtggaaaagagcatgaacccagacaggctggctccagggactgcggcaatgttgtaataaaatggcatttgttcagtccagttttaattgatgagatactaaacagagtcggcactaaagaaaatttccttggagaaacatttatgcttagctatttcagagctggaaagtccctttggtttgatataaacggccttcatttttatggagctggcatcaaactgattttagaaagaactggcctttctccaagttagccctggtcagaggaacctaacacatttctcagtttaaactagtaattctcaaggaagggcaaggtttggagagagagcagtgcaccgctaagggaggtatcagtacctggaagaggggaagcaaatacatgttctgaaaacaaaacattgctggaagacggatatcgaacttgacctaagattttcttttccatctcccctggctaagatgaacaagtttgcattgggcaagtagagtcagcatttacactggtatcttgtgcttggagtgaaaagcaaaatgaaacaaaaagaggtttctttttctaaaattgttttggttttgatttgcgtttagtcataattcttaatttatgtaatttttaacatttcataagacagcatgaggattttgtttttgaggaacatccattttaagtttgaagaaaatccatttaaatgcagttgggcagagctgccacatgcctatcccatccctgttctgatggtggccctaagacgtttcgaagagcttggattctacttatccaaaactaattctgtacatttacgggatcatcagaatcatgaaaaatgtttctagggattctaggtttttagtagagagagaaaatgatttctaggataaaattcagataagccttgagctaggaaactcatagttcatgttgttacaaagaactaaagctgatttttcagagtaccagcttctcagaggacctgagacttgcggatctcatttacagattccaaaacccctcgcagttacactggactgatttttggcttggaaagagcagtgggatacatcctgcactagcccttgtcctgatggattgagacacaaagcttggcctgagcctctgtgtcaccagtgttagagatgatctttgtttctcctgcagggagctttctcactgccaaatggcgtggggctttcctagctttaagatgaaacaaagagaatgcattctcccatagtcttgtctcatagactcccatctcatgaggaattatctcaagtaagtatcactttctaaacaggttgcaaaaatccattagacaggtaggattcacctcgcctgcccattagggatcagaggctgcctgctgagagcccatatctgcagtgttttctgggtttccttttttgcaatggctctcataccctgatgtcacttgtttggtgtgcatgattgtgcttagccaaaaagaatgtgcagtagtcacttggcctttaagtagcaggtagtgaaagacagcagggagagtgtaacgaatcttattctttcagaaaatactaagattattttatttcatgtttcactctcatcaactatttaattacattcattcattcattgatttaaaactcatcatgttgccactatttgcctgttctatgctagcactggagatctatggatgaagaagacaaacaaggatgctattctcatgtgcattacatttaattgtggataggaaattaaagcaactaaactcactgagaatcagagctaacatttgcccagcacttagtacatggcaggtgcagttttacagcttgatgtatgttaactcatttaattcttctaataagcctataaggcataagctattatctgcttttagagataagaaaatgaaggactagagactttagttaactttcctagggtcacacaggtaggaagtgacagagctgggatttgatccagggctccctggctccaaagctcttgcttttagccatgatactataatgcattgaataatgggcgatatctacctttccttgatggtcaggaagaaaggtcaaaagaaaggttgttagagctaaaatctgaaagaggagaaaagtttttcagataaagagagtgtgcgtgtgtattttgtatgtgagtattgtgcgtgttctatgtgtgctgtatgccgtgtgtgtgtgttgtgtgtgtgtgtattgtgttgggatagagcagcaacacaacagtgtccctagcggaagaagtaatgtctgtgatggtaagggaaaagagggtgaaagtgagaaaagagtgagagagaggctcggacaacttaaacaactggaaggccagcaggataatggttatggtagaggtggagagaaatatgaagttggaatgggatgggatcagggacacatcatgccaagtcttctatgccacattgggaatggaaagtcatgaaaagattttaagctggagagttacctaatttatcatagattttaaaaagattcctcttgcagctgggtcttaagaattagtggctcttcattgatgagttcatgtcctttgtagtgacatggatgaagctggaaaccatcattctcagcaaactatcgcaaggacaaaaaaccaaacaccgcatgttctcactcataggtaggaattgaacaatgaaaacacatggacacaggaaggggaacatcacacaccggggcctgttgtggggtggggggaggggagagggatagcattaggagatatatctaatgttaaatgatgagttaatgggtgcagcacaccaacatgccacatgtatacatatgtaagaaacctgcacgttatgcacatgtaccctaaaacttaaagtatataaaagaaaaaaagaattagtggctcttgcagttgttcaggcaagagatgaaggaggcttgcccttggatgaatggcaagattctgtgtgtggtatgaaagtctagagcttccttgatgaccatctcctaccccatgcatttacagctttctctccttagaaaaggatttttgacataagcaaaaacttttcacaaaaatttgtgtgaaatcttatttggggatttgctctctgtgcaaggagtcctactccagcaggtttcccagtcaaaatatgcctttgggaatgcagagaactgaaggccctggctgagcaaaccccagctggagagacagactggggattctatctgtgtatagcatgaagaatttattctaaacacttggatatagagccaatgccacttacaagctttcctttaagaatcctaggccagttgttaacagtttttaatctccttaatttctttatccatagatacctgacaggaacagtttggactgtggaaagacaataatggtccctttctgaaacagtctcctacttgctgaaggctactggaatagaagagaaaatatagtattttctgaaaatgtaaacagatgttagtttaccatttgtgagctgcagggttcagttaaagtggatgttgtatgtaaatacagtggtagcttgggagctgcagatgtctctaataagcattcccaagtgcactgtgttccattagtatgtgggattccactaccctaatcccactactgtggcttactctgggctccttctgtttctattcctgcaggacacataaagacaccttaggcgttagctgtctctatgtttccattccaccaaatcggaacttcatgactttttcaccttctctctcagtcataagaagacggctttttaaaggatgccaagacaggtggatcatggtaatagtatactccattatagcagttgttattcattgaacacctactgtttgtcaggattgggcaagtggcagtatacatcatcttatttagtctgcacagcaggtttaaagggagataatattactccgactgtacaggtgaataaatggaagttaaaataatctcggcttggtagtgatggaatcaaatgatgtaattgcctcattgtgaccagctaagggcaattctgttaggatctgtgtaacacattttaagagaaacattggcaaatgaagaaaggttagaggaaaacatctaaggtcatttaagtatacctatatacatttctctcatatgatatgacaggcttgaaaaattacacagctcattacgagcaagagagcagtatatatatattaacattctaatcttaataggaaaaactaaaggatgctgtgggaataaatggaaggatcatcatacctagccaagaaaatgataacttaggtcctggataaataaattttaagtagggaaaggtgggctggagttaggagcattctaaactcaatgaacaacatgcacatgcacttggagacagtgcaggtcaatttaggagctcacaggccatttagagtgacagaagcagagtgtgcaggtcaggcagtaataagacatgaggctggagaaatgagtaggaagcagatcaaaggccttgaaatgtcaagaactttgtaccttatgggtactgaagaagtgaaatgtttaaagaagccgaattatatgatttcttttgacttcaaaatggaaaatacatgtcgatattgggggagaaattaggaggttcttgccataatacaggtggcaaatgatggtagtcttcaggtaatggcagtaggaatgcatagaagaacacagatatgaaagattcttagtctggcagacacctggaagcaagggtgcataggaatagctaacagttaaaaaagtatttggagagctatcatgtgaaacagagagatgatttattttttctgttcatttactgagggcatagtaaggactaattggagaaagtcatagggaaacatattttaatttcaataaaatctgatgctccaaaaattgaaaacataacttaccattcatctctgaatgtatccgtgcattttttttttcattcaagttacatttttaaatgatgtgcaagttctatagactgggtaacagtgtacataacacttaacaactaactaaaatcagtgaaacacatatcaatataaacaaagagctatggaaattaatcctgtccggggttcagaggagttattaattaagatggtaaaactagctgaagggataattagagggaagagttgtgtggggtctgcaggatctacaagtggaattgcccacagaacctttagatcttatgaatctagagcttagaaaatagtcagggctggtgaagtatactggggaattttcagtgtaagcaaagaccatcaaagcaaatgtctctgaagaataagcaagtaatacaaataagtgagatggacaaggcataaggcaataagtactgggactatggaaaattggcaagcaggtgccccttccaaatggcaccactgccagtcagctccagtaaattgttgctctgtgctctcagatctccacagtttctaaataaaaacaaaacattggatatttatgtgatgcttctagttaatatgatatctcacagcatgtccttgatctaactatagcccaaaggctgtcagattgccttgtatgttataagatgattgttgaagctgtgagtaagactgaaattttctcaagcgagtagaccactggaatgtatacatgggtaatctttctcaagtgggtaaccaaatgttatttggtatgtaaacttttctatttccacatctgaggattcatgctgctataagtgatgtctgagaaagtcatgcagcacattagccagcaaggcataaaaggcaaagagagagataagaaagatgatgttaatctagagcctaatgaaaatgtgggagttcataaggagtgatcaaatacgtaaggtgataattgtggatatgtttcgatatcagaaaacattgcttttctgtgtgatagtgctttctttataattaatgtggatttagtgtgtgttatttttagccttttaatccctataaatgtgccacttcatattctacgactgaaaatggcactataaacaaaatggtttaggaaccagtgtagagagcaggagccaaagatggaatccagagtcacagcatgagggatgagtaaggaagatgactaaactggtagattttagaatgagctatagcagtatcaccaaaaccaagagtggagagaacttcaagaggaaagacacatttggaccttttaggtaactgaaaaatggcaagtccattgggtttaaaaggtaaaggcttctggtgacctctgagagggcactctaaggggagagttggcaagaatccagtttgcactgcactgggcagtgaacgggaggtcagtgagtggagtgattgccaactgctccttgggcaagtttggcaggaaagggaaggagagatgtggtgccattccaaggatgagacgaggttaaaaaaaaggctttactcattttttttctagtggagtagaatttataatatattaagactaggagtgataattgatgaagcaaggtacggaatgaggcataaaatggagagatcagagttagagcaattgataattatttttctttcagacaggttaaaaatatgaatctttggatgtaaccgagaggaaaattgagggagcttatgcctgatgcctctacattttctctaaagtaggagatgcgggaaggggtcagtagagagttgtgggctggaaaaaaaaagtttggaggagctgctgtagggaatttaacaggggtgattaaaaggattgctgaggttcaaactgaggttggaaaccattaagcagcaatgatcagtacagttgtgagcatttctccaacagtatcaggaagtccaggaacaggaaggggaaaaaagagggtctgtgttgctccaggtttttagaataacaaaccaaattcagcagaagatcaaagtgaaacagacaagcagtatgtaagtggagaaatagacaatggaacacaggcttgagaaggacataaaaggagtcaggagaagactgattttctgagagcaaagagaatccctgagatatatatatatatttttaatattagaatgagagattcttgcactgggtaggactttgacctgagtgaactttgaggttcctcctaattccaagattctttgattctagacatgagaaaacaaagctagtccctatgctgttgtcataactgtcatggtatgtgatatggtttaactctgtgtccccacccaaatctcatctcaaattgaaattcctacatgtcaagggagggacctgtagtccgcaagtgttgagggagggaggtgatcggatcatgagggcggttctctccatgctgttctcatgatagtgagttctcaggagatctgatggttttatgaacgtgtggcatttcccctgcttacacttctctctcctgctaccatgtgagaaggtccaagattgctttccattcaccttacgccgtgattgtaactttcctgaggcttccccagccatgtggatctgtgagtcaattaaacctttttcttttataaattacccagtttcaggtagtatcttcatagcagtgtgaaaatgaactaatacagtatgtaaaaatggaagtcctgtatatacctgtctctctcaggattggcctcaaggaaccttaccaagtagatgacatttctcacttgttcctctcacttgttcctctcacttcctgttgtagtatcatcttctatttattctccttatcaccagcagatcaaaacaatgagggcattgatctatcataagaaggctgccttcaggccctattctttttttttttttttttttttttttgagatggagtctcactctgtcgcccaggctggagtacagtggcaccatctcggctcactgcaagctccgcctcccgggttcatgccattctcctgcctcagcctcccaagtagctgagactacaggcgcccgccaccacacccagctaattttttgtatttttagtagagacggggtttcaccgtgttagccaggatggtctcgatctcctgacctcgtgatcccccagccttgacctcccaaagtgctgggattacaggcatgagccaccgcgcctggcctcaggccctattctaataaaacttccaggtagatgcttgttctccttctctgtgagtccaaacaaggtctctagttattgattctcatgttattgcagcttctacaaatttcaccctcaagtcagctttttggcttttctgactcaagtcacaagataaccatccttttgtttcatttttgtaaattctcataaccccaactggatggtagatgaatatgaggaagaggggaaatcaaaagaatgagagcaatgagcctattactcttgagatgaacagagggagagattcaacaccaaatgcgtccctcttctgaatcccatctctcgaatcagacagcacttctgtgtacttcccaatatccatacaaataccaggaaacttattttacttgcctctggccttggtttgcaggtttggggaaacacaggagtcaaacagaatttttttgggtgaacccacagatttcactctgaggaacagctcccttgctgttgagacagctgggtgcactaagcaacacatttgaaatatgcctcagactttgtggaaccaggtagtctgaaatcttgccaggactttagtgcctcttgggatacttctgaggtagggcaaagtcccattcaatgttctgttggaggagagaatctttagtgaaatctcaagaatgaaagccaagaagccttaagataagagcgagagattcaacagcaagtactatctgtaagaactttgatttcattgcatttaagcttcttttcctagtggactgtttttagttgaatacttcttgaggataagtgttgtgtcttctatacttatatctgcagcttagcacagttcctgccctatggtacatgttccttatatgtacatggaaattagccaaatgtcaggatgccactttttcatctccatctctattcctatgatggatgactggtaaatacttctctgactatgtatgtgtagttcaaatactctagtttttttttagcataaagtgctgtgaaatcccaccatcaaaagagccaaagtaatatgatgaaaagaatttggtttcagaattaaaaagaaagcacacatttttgagttctcgctcaaaaacaattttgtgagggtaagttatttaacttctccgtgtctcagcttcctataaaactagaattatgagatctctcttataggtttgaaataggatgaaaattcctccctctttttttttcttataacctctctcaaaaccttgcctgtgtctctatgagtgtgttgtgttacagttactgctataatttctctactagattagggtggagaagttcccatggctgttcgctctctcagaggaccctgggcaaagttggtgctcactgtgcatcactgattatatcaaatactgtgtggcatgctcaggccttgttggtctctctgtaccagtgtctatcgtgggacataataattcatgatgaacagtcaggcatctacttagtggcttatacgtagaagtggctctcctttcagaagccagaaattaataaatggtctacagtcagaaggagatccttaattgattaattaattcaataagaatttattaagtaccttctatgtgctaaacactggggagacaacagtgcataaagagatcccatctttgttcatatgaaactatattctagaggaagagacacacactaattgaatactctcacaagcaaaagtacttttgtaatggtaattcatgctacaaagctgtagaccttggtgctatctgatacagagatctgatggaatcagaaagttcaggaagagatcgtctgagagttcctggctagagataggaaggaggggcagagttaaccaggaaggggaggcaaaagtatcacagtcacagagaacagtgtgcaaagcacccatggcaagggggaatgtgataagggtgtgtagtgaatgaagccatagtgactggaatataggggacaagattgaaagtaaaacttacaaggacgaccattgcttgggagtttgggttttattagcactgcagtggaatgctgtgaaacaatgaactggcattgtagaagctggcatagcctgcttttttgaggacatccaacacccatgacaaggtctacggcatcaaggattaccttggtttgtctttgctaaccaaactgggttatacacaagttacgagttgtccttgtcccaactcacaccctcaccattggagaagaatgtggagtgcccctccccatcccggcccatcccttatgtcggtggactaacgcagcatgcctaatgccagagtgggcagaaagaataatagctgttgtttcagtttacctgtactaatttatcacaccttacccagagactccagctccactttctgagttttctctgtctggaggtgaaacacacaagcacataaataagtaggaagctgttaggaaatcctctttgtcactactgaagcatgttcatttatttagtaaaacgtccataatttttaaattgctttatttagccactggctatttggtatcttcaaggggtccccattaggagctgtacttccccattacctgcaaaaacaaggcaggcttttgatccctggaattaattacatgcaaagattttcattgcttggagcagcaagcagctggttcctacgggacccaggctgaactctcttgccaatttccctctcatgcttgtccctccctccacacctacaccctttctttctttcattatgctcaatgggttcaatctaatgagggaaattgtaattaaacatttacaaggttccagttttctctatgactgcccttaagactgtgaacattcacagttcactctttttccaaatacagcacaatggcaaagtttccaggaatgtccttactgactcaggccccccagaatggtattaatccatttgaaaacaacttcacttgagttattagagctggggcaaaagcagggagggagagatctactcgttagggatgagggagcaagagcaatgatgactagcttttgtcaggacacaaagtgcgtctctggtgcttgtgcagatcagttgacaatggtttatagcttttctaccttcctccctttcctattaattattcatacttctcctaccaagagaggggtcttgttttccttttaggtgtaattagagtaatcaaagggtttgtaacactcatgtgttttatttctcattctctattcaattttgtttttcatgcaagagaaaaatataaaacacgaaacaaaaaccccaagtctctgggtgttgtgaattcttgcagggaaaattggttttaccatattagcaattggcagcaataattctgaggtgaaaaacctgaaattactcccttaaaggcagtaatttgtatagtatgtattttgagaaagggggggaggagtaggtgataatttaggtgaatgttagcagtttatctttatattttgtgataaacgaggaagccaagtgttggtgtgttcaactgtggacatacatttgcatatggttttgtttctattgaatagattttggtttgaatgacaaattaaactcccagcttccaaacactgaattcttttgttcagactttacacattcttgaaaggaaaggtgcccacatgcacttatcctttaagggtgaggttaggcaagcaaggaattgacagttattttatgtttttttgttttttgtttttgtttttgagatggagtctcgctcttattgcccaggctggagtccaatggcatgatcttggctcactgcaacctctgcctcccgggttcaagctcttcttttgtctcagcttcctgagtagctgggattacaggtgcataccaccatgcccggctaatttttgtatttttagtagagatgaggtttcatcatgttggtcaggctggtctcgaactcctgacctcaggtgatgtacctgccttggcctcccaaagtgctgtattttaccttttatattaacaaaaccttcttcttgcagttcagaacccataggaaatattattggaaaggtatttcaccacatcatcacaggcatttctatggtgacgaagcgatgtgccatgaacaaagttatgccattttttaatacaagccgaggaaagagaaaaaaaccaggagcaagccactgcttcagggattggcaacctctttatgtttgctcaagatagagcgaaaaactcctaaggttttaccattaaagaaccaaataaaattgtttaacatgttggaattgtgggtcctttttgtatattgacttgagaaaaaataaaaatattgatacagaaaaaagagaatgcatatgatctttttatcttagccaatatattatgttttcttgtttttgtatatctacatattcataaaaacaagtatgtgtgaagaagtttacatcacagtgcaagtgtgatccttcatataaaactaaagcaagtgaggatgaattcctaaataattaaacggtaaattacttgtgtttgtatcagctcttgagccatcttaaactactaatcaatttctcataatcatcagtgcttttcatctgtgagcggattatttggtcaaacatggagacaatggcacagccgtgagtagagcccaggtgtttttctccgatttctccacagaactacaatgccagcagaaaggtagagtggagtaataataaaaaccaggtttaagagaacactaagtttttttttcagtgttgttcacggaactgcaagtggtatagaggttcaggaagtcattacagtcttcataggggtgcaatagttctcacttctcctttcaagaagagttgtaatggaaagttgaggaagaacagtagggacacagggacaggtggtgtctccaattggtcatattctccaagttatttttggtctatagttggttccctaaatctcacttcttctcttcctctagctttagggactggactcagcattttggtttcatttcttttttgaaaagtaaaaagaaaatttacaaaactataaaacaagttatatatgtatatataaaactagcatattaacaaatatatatgggtaattatataaaattatttatacatatataattacccatatatatttttcataattacccatatatatgtatatgtatatatatatataattacccatatatatgtatgtgtgtatatatatataattacccatatatatgtgtgtgtgtgtgtgtgtgtatatataattacccagaattaaacacctttaggtgtaattagagtacattaaaatttggcatactttcctttagttcttttctaaattataaaagtaacatatagtatatttttcttctctaaaaatattgaaaagttaaagtttccttatccactttctcctcaaccagagctgcttctcccaaaatcccaagggaatcattattttgagtttgctgtagatacttcaaacgtttaaaatatgtatttacatgcatatatatatatacatctagaaaaatactagcatatgttattttatgtagtttattcagttacttacatagtacagtgtactatgtaagtataattcacatcttgcttttttctttcaacactgcatttttgatgtataggtccctgatacactgggtattcttcagacggataacatttgatttagattctgaaagagggataagattttgccaggtcaagaaaggaaccggtcaggtagaacattagtttacgtattagcacttacttcataaaggcatggaatagactgcggaaaatcaaggttgctggactttagggtggaactggtgagagaagagacaggagactgagtaaatgcagaaagggtggccatgtagcctatggcagatattttgaattttcactgagaggcagggatattataagtgaaggtgaagtgtatcactttgctagagctgctgtgacaaagtgccacaaaccaggtggcttaaacagaaaatgtgttgttctggagactagaagtatgagataaaggtgctggcggggttggtttattctgagaaccataaagaagaacctgccttgttctctctcctcttcttatggtttgccagtaatctctgccattctttatagacaagtcaccccaatctcggccttgatgttttcgtgacattctctctgtgtgcatgcctctgtccaaatttaccttcctttatttttacaatttttattttaagttcaggggtacaggtgcagtatgttcagatttgttacctaggtaaacgtgtgccatggtggtttactgcacaaaccatcccatcatccagatattaagcctggcatccattagctcttctttctgatgctctccctctgcctccccttttgctgtgcagaagctctttagcttaattagatcccatttgtcaatttctgctttggttgcaattgcttttggcgtttttgtcatgaaatttttgcccacgcctaattcctgaatggtattgcctagattttcttctagagtttttatagtttgggattttacattttttaacccatcttgagttaatttttgtatgtggtgtaaagaagaggcccagtttcagttttctgcatatggctagctagttctcccagcacaatttattaattagggaatcctttccccattgcttgtttttgtcagatttgtcaaagatcacatggttgtaggtgtgcggtcttatgtctgagttctctgtgcttttccattgatctatttgtctgttcttataccagtaccatgctgttttggttactgtagccttgtagaatagtttaaagtcaggtagtgtgatgtctccagctttgttctttttgcttaggattgacttggctattcaggctcttttttggttccatataaatttaaattttttttctaattctgtgaagaatgtcaatggtagtttaatgggaatagcattgaatctataaattactttgggcagtatggccattttcatgatattgattctccctagtcgtttatttttatcctctctgatttctcagagcagtggtttgtaattctccttaaagagttccttcacttcccttgttagttgtattcctaggtattgtattctttctgtagtaattgtgaatgggagttcattcatgatttggctctctgcttgccttttattggtgtataggaatgctagcaatttttgcacattgattttatattctgagactttactgaaattgcttatcagcttacgaagcctttgagctgagccgatggggttttctgggtgtaggatcaatgtcatctgcaaacaaagataatttgactccctctctttttattcaaataccttttattttttcctcttgcctggttgccctgactagaacttccaatactatgttgaataagagtggtgaggaaaggcatcgttgtcttgtgccagttttcagggggaatgtttccagcttttgccctgcagtatgatattgactgtgggtttgtcatatatgactcttactattttgagatatgtttctttaatagctagtttattgagaattttaaacatgaagggatgttgaattttttgaagtacttttctgcatctattgagataatcatgtgatttttgtctttagttctgttaatatgatgtatcacatttattgatttgcatatgttgaaccaaacttgcatcccagtgatgaagccaacttgatcgtggtggataagctttttgatgtgctgccgaattcagtttgtcagtattttattgaggatttttgcatcaatatttatcaagtatattggcctgaatttttctttttttgttgtgtctctgccaggttttggtatctggatgatgctggcctcatagaatgagttagggaggagtccctcctcttcaattttttgaatagtttcagtagaaatgtgtactagctcttctttctacctctggtagaattcagctgtgaatctatctggtcctgggcttttttagttggtaggctattctctactgcctcaatttcagaacgtggtctattcagggattcagtatttttcctggttcaaatttacctttcttataaggaaggcaatcatgttggatttgagtccagtctaatgacctcattttaactttgttaccttggtaaagactctaccttcaaataagttcacaatgtctaactgtgagttaggaatttaacacatgaacccattcaacacatgaacctttgggggcaggacttaatttgacccttaacatgaagtgataaaaatattttttagacttgataattgtagctcttgtttgatggctgaagtatcaagaggattatgagaacagacatgaggctatgaatatgttgaaggattggaattttggatcactcaaatgtgatccaaaacctctggacacccttaccctttctagatatattttttccccttaaagaactcaaaggagaacagagacctggaaaaatatctgtggatatctggaagtaagcactgtactagaggttatcttgtatttgtctctagtttttatgttcgattctcagaggcaggtatttcattgtacaaggtgcaataattatggagtatacattttatttaatcacataggaagtggtttattataaaagagaaagaatactttaactttaaacctgttggacaaaagggttaagtataactttctcaattacttaggcaaatatattcttgaaaataaaaagttagaaaagagggaaagactgagaccctcaatgttaaataacattttataatgatcacatgctgagtcaaaggcaaaagcaatttctaagtcgcctacttaattctctagaccatgcctgctatcttatatttatatcttaataaatgtacatatgctgccttgctgttttggggacaatgggaagtataaatttgatctttcttgaattctccacatttaaagtctccacttgtcacttgaattaacatagtattttagcatttaatttcctggggataccagatgttttattttgtgagtttcttttatttatgttatagttgtggtttaaacaactatatgttcatttaaaatgaaactcaaaaaagaggaaagaatggcacaactcaataaatatgtagtttaataatattcagtgaatacgtatgcacagtgaatggaagtctaaataacgtactccagtgaagaattattagatgttgcccgtctcagctggattttcagttatactattcaagctggtgggaggtttcaggggaagaacaggggagaagacaaagcagaaacagccttaggcagtataaattctgaatacctttaatttgattaacttgttaatactagcaggagagttactttgttgtattctagggattataacatggcatcatttgaaatgatatggttcccactgataaggggaggatgaatagaagcatacactgaatttctctccagggcattgagttcctttggcgacagcactgttggctaaatatgaaaggctgtgagatgaaatggcagcaagagaacagcagaggaaaatgtaaggcaaggatgggaaacacatgagaagtttatacctgaccatctcttttctatcattggcttcctatctcctattcttcttctttgtcaatctctgtagcctccacctttgctcaaattggctcagtgatatgattttaatactaagcccacacccagttggtatgaagacattaagtaattaattaattcaataactatttgctgatctgaacaaagtggacaaaaaaccctgtctctgtggaattttcttccaggcatgaggggcttgggaatgggtaacaagtaagtaaattatgtaacttgtttgacagtgctaagtgctacaaagagaaactaggtagataaaagaaatagggacttgggaggttgaaattttataaaaaaaaaaaaaggtcagagaaaataccacttttctgatgagttaaaaagctatgacctgctaatttttatgtatttattctgtgtccattaaaacttccagaaactttctcttgaagtgacatttgagtctcaagatctggccctggtgattatattgtgacacactgtgatcattacaaaaatttttatcatcatgtataactgtgatgctattttgcttgcagcccagacaatgtgatggatttattaaaacattctgataatcataagacagtgattctaggacatgtattatcaggacctcttctgtacctgtgtttggagttgccatagatgaaagtcatatgataagagaaaagcaatatgataatttgtaagtgagctgcttataataagcaggatatgacagtcaacatttttcctttttacctttccttccatctctacctgttttctttgttatagactttgagttttgtatgtgtcaggtttcattcatttgggaaaccaatgtcacatcaaattaggaaggatgttatgaccctctaattggcctttgcattgtacacaagcctcctatgtttgttcgggatagcaccacgcatccttttaaattggtagtttgactgtcagtttccgtaatgcccttgacagtaaaacaaacacaactctatgtgattctattatgaaacattaatcttctgactgtatggtaaaaggaaggggtgagagtttctctccattcccccaaaggaaggaagagtaagaaagaaattaaaaatgtaaaagcactcccaataacaggtcatcaagtcacagcttttcattgtggccactctttgtcagctgtgtgtgtgacaagaaacaaatcacagctccatgatatttgatagccttgagtaattaaagagtcttcaatgctttttggaaaatgttgtccaatattccagccacatgcagtgctcccttaataactcaataactccacatttctctccctgtgtgtgtttgactattgctatcccttttagagatatttgcatgtaatcaagatagagttcaaagatttaccattttccttactattattctatatttgaatatccctcccacttccatttttttcttccgataggggaaataagttaaccaaaattcaaacaaaaatcagttttaaataaatattcctaataagaattattataactactaccacacatacatttatggtaggaaaatttagaatctgtcctggaaaaaaatacgtccagattatttacaaagatttgctttcagaatccctcttgagataaatagacatgttgggggtgattctgggatggagcaaacatgtagtttgggtcgcagtttaacgatgtagccgtagtgtattaaggctatgcatagcaatttctcttgccctggagtagttagtgtcaaactctttttacccattaaacatttgaagtagatttattagctctaaggattcttggttcttcctgaaaaggaattaagaatctttggacagtggacttcttgaaaatcctatcaaatacccctaagtatgtttctggtagcctctcggttgtgctattcagtgatgaataacacagagcttgattgttctaatttagcggaagaaacacattttttttaatgtggtttttgccattttctattatactttaagttctgtgatacatgtgcagaacatgcaggtttgttacataggtatacatgtgccatggtggtttgctgcactcatgaacctgtcatctacattaggtatttctcctaatgctatccctctgctagccccccactacccaacaggccccagcgtgtgaggttcccctccctgtgtccatgtgttctcattgagaaacacattttttaaatacataaataaatatcacccttttgtcatgtatcttcataagcaattgacccaaccaatggatttgcagtcagtgaaaacaactttggatagatgggtggatggatgaatgaatggatctcatttatttgtgggagctaaaaatttaaacaattgaactcatggagagagagagagtagaaggatggttaccagaggctgggaaggttaaggaacttggagggaaaagtggggacggttcattggtaccaaaaaatagttagaaagaataaataagatttaggatttgatagcctatcagggtgactataatcaataatatcttcattgcacatgtcaaaataactaaaaaagcataattggattgcttgtaataggataaatgcttgaggtgatggctaccccatttaccctgatgtgattattacacatttatgcccatatcaaaatataacttatgccccataaatatgtacacctactatgtacctacaaaaattttaaagaatgtgaatggttgaatagataggcagatagataataaagtaattactatttatttttgatttcagaagattttaacagggcccttgattatcattcatctgagatctacccttgtctgtatggcttatttgggttgtaggtaagagtcattcttgaatgagtgggggtttctgattatttttaaacagccattcaagaccaatgcagatacctaggaggaaaatgtttctgatttttatgaatgtgtatgaaaccggtaaatattcataacatagctaccaatatatgcttctgcaagccaatctaaacaaattgccagtatcaaagattctgttgatgaggaatagacagcctgtgtttgcagtcttgttaaggtggttaacagtggtgtcctgattttttccaaaaccttccagatttgggctgctgagtagatgatgctgacttccgatactgcttgttgttgttgtttaaaccattgagcaggttacgaacctctgaacttaaacgaaagaaatcagtggtttcagctggaataaaaaagtaatactatggtatagcataacggagataatacaatttttgtggttttaaaacagagaaaaaagtccctcttttaatgcaaaatcacctgtaaccttgaatgtatcaaccagtgtgacttagctgataatttaggcctatttcatagagctgttatgagaactaagtaaaatcatgcacatacaaatgattagttacttttaaaaactgtaaaatgcttgctgttattgttgctggattgaagagttcattgtgatggtgccattcaatgactatatgactaagatgatcatcctttgtactctgtctccccatctctcctccctcccttgtttttccatgtggtatgtgttttctctctctctctctcttttttttttttttgagacggatagtttcattcctgtcgcccaggctggagtgcagtggtgcaatctcggctcactgcaacctccccctcccagggttcaagtgattttcctgcctcagcttcctgagtagctggaattacaggtgcccaccaccacgcctggctaatttttgtatttttagtacagacagtgtttcaccatcttgaccaggctggtcttgaacttctgacctcaggtgatccactcgcctccgcctcccaaagtgcttggattacaggcatgagccaccgcgcccggcccgtctctaagttattttctaagctaaaagtcatgctactgcaaccaacggatatccccccttttttggagatacttggtaatgtagaaactatttcagagagtcaaaattctacagatagagtttagaatgcacaaaatctagacatggcattgaggcatctagatattgcctttacctatttcctgtaggaacttgctccagattagtatcttaaagacaaattggcatttatttttcttacacacattgcattgtgccatgtaagaaaattacagattaaatcagcattttcctcctgcttgatgtgaataaaatcaatgctgaaatgggagtcctagttaatctatgtgatagaagttactaggaccagtgtttggtggcttaggtccttaaagaaattggaaagctctttgcaatacagtgtgttaacaacagccttttctttttattcccttccctttgcaactgttcccagcccttctttaaaaatctaagtcagaaatatattgaagggctttatttctatccatttttttctatctgcacatggctgttgatattccttcactgtcttggagctatcaactatcagtcttttgtaaagtagcatacatagtaaagtatcaagaaaacattttctcaagccagactgcctgtgctcaaattgcagctctgctacttactggctgagtgaccttggacacgttatttaacctctctgtgcctagtaaccactacataggagggtattttataaggattaaatctctgtaacacacgtagaaaagtacctgccatatggtaggcacaatatacatttttgttaaataaaatgaagcttagtagtttacctgcattgttcacattatctaacacattaccttccacatcgtaggtacacaatgaatattattagtcatgacttatacatgactaaatgtattcttaaattggagtggtacaaaaaacatatgggtccattccacatttctacaaactagctctgcagtcttgcacatcaaattttagtgtctttggagcttccttctcatctttaaaataaaaatatttgcccaatgtatttcaaagggtaattttaatgatcaaaatgataatgtacttccaatgagttgaaaaaattatttctctatatgaaaggtattataacatttttatttctcaaattactaaatcagttctaggggaaatatgctagtaaaatagttaaggcttgacagatataactggtccagaggtcggtagtcatcatgagtactaagacctagatactaggggtctgtgtttgttcttgagaatacagcaaagtgtttcaaggaaggaggcttctcctttacttaccaggcctgttcagctgtatttggctacttcttgttatggaaggaaacctgagcagaccttgggaatccagtgttcctttatcacattcctcagatctgttaggctggacgccaaggacagtagtttgaaggtgtttgtcttgatgctgatggatgttgcagtctgtaatccacgaactgaaacagggcttctcttcattgcagctggcatatcttgttgtgtttatgagtctgacaggcaaacatatctgaagcatatctcatatgctgatctgtgagggagataagccccttgttttgcttgactggaaacaaaataagcaggtggcagaaaaccctgcattgatttctgcttgggctaaaacacccagaataagatcaagtcccccttgggcacactccagcctctgctatttgatcattgatcatttgacttaagtttgcaaattgttgtagggaagtgtaagtttctttctgctttaacaaagctacttttacttattttaattttataagctattagcactattttgtgatagaaaaaactaaaaatcaaatggtgtcagagcttaaaaatctcttacttcatttgccgtgtaatctttatgcatttgatttttgcttcaggatccttacctataaagcatacccatttcatttgaccactagatttttacagaataaaaatagttcctttctgaagaggaactatgaaagtgtatacatgggttaggagatggagctgaggactccaaagtaatcagtccctgataagaacttgagttttgatgcacacattattgcattttagagattttggtctcccagttagattgtaaacttattgaaggcagtaggacattgacaatgcataaatattagttaggaaaatgaaaaataaagtgttgcttaccaattcagagattcagaagaatgtggataggattttttccctctcacctgaaatttcgactttataaactctttttattactgtccttccttttctgatcccttgatgattattaattggttccagtggtgtatatttcagatatttaattaagtcttcctttctgtccaactctctgccaaaacatatttttcatttttatacctgcaatgctcaaacataagttgatgccaaatgcatgctgtttgattacattccatccagatttacttccaagcaggacgaggcctgtagcatttatttcaagtagctttacaaagagccattcttggccctcaatgtgtgtggcaggcggggaggcaggagaggaaaatgaggtagatgtccttcccataccttaactagtttttgagagaaatggaaaatggcagatcagatgccattggccgtttgcccaattaagccatagcagtgttagctaagatgtgatcaatatggaagacttggtctgcagagccttttttagctgtgctcctgtactagtcaagcacctcctgcaactttgtggtaaattcaagcacctcgtgcaactttgtggtaaaaaccatcctcatgagttagagccttgtcttataagaaggaagaggacagcttctgggtgagacacgtgctggccatcatgctgttgcctaatctgtcacctcaactattgattcccagctcttgattctcattgttcattcatggagttgtttctaaataatggtgactagagaggaggaaatggtgttatattagttctctattgctgcataacaaataactccaaaacgtagcagctcaaaaatcaacaaggcattacctcctaatttttgcaggtcaggaatccagatgtggcttagctgggtgcctctggcttagagtccctccataaggctgcaaccgaggtgacagccagggcttcagtcacctcaacttgggagagatctgcttccaagcccttacctatggctggtggcaggccttagtcattgtggactgttggccacagataatacttcattggcacaagagcctttctacaggacagcttacaacttaatagctgtctttgattgagggttggggagaaggtggaagccattgttgttttcaatctaatcttgaaagtgacatcctgtcacctctactgtattctattcatcacttagaagtgagtcaataagtataggacatttaaggggagggaataatcaagggtatgaataccaggaggctgagacagttgggagccaccttatagactgccttacacaggtgtaaaaagcatgaaatagacattagacaaatgcagggtctgctgagatggcgtgtaaaaagttctatcacagggcttgccacagagtagagaagcattgcatttatttcttgccacccccagcacattgcctggtgcattgtgggcactcaagtacctacatgcccatgaaactgtgtctagtttactaaaaacaaagagtctctctgttccaaaagagattaatgtttggtgttatcctttctggacaattttcttcctatgcttcatttctccagttatcgtcaagggaatggatttaagtctgaaataaaatcactcaaaaataaggaatagctgaagcagacctagaattaccttggtggaattaccttcttaagaacaattagaagtttattctttaggtcaggaatgctgttgccaatcttccacagcaggtgataagaattaaattccctcatgaccgaggaaacgttctttctgctaatctggttccacctggaggttcaacaaatagaagatagagcacacggtgtgtttagtcttaaccacatagcccgaggcactggggaagtgtccacacgatgtttgccttctgtgaacctggaaagcaatttttttctagttttcctttttttcctcttcttttcctattcatctgaattcttctgtagttaaattattaatttctctccctacagaatataataaattactatccttgttaattcttttatcaaagatatgtactaggcttctgcttccacatgggccatttgaaaaacagtgcttcatatgatccctgaactttttggcaattataaagagagatcacaaatgagtaaggttgaaaattaaactataactggaatgaaatgtcctataggactaaacctatcagttgtattgcagatcagccccttataattggtgatgtggtatgagacattttatataactataatatataggccataaattattattatatcagtctgtggtataatattgcaccttagggtagaatttgctccatttacattatattcaggcagaaaaaatgaaaacatctgtcagggagagtatagccctattgatcaggtatatataagtaaggtttacttatataaggctgagaaaaggggctttccatttgatttcagttgttttatagacaagtttctagtttgagggagctatttagaaatgtatgtagccttatgtagaaattccaataaagctttcaaaaaataaagctggtatttatattggttgaaatggcaagataatgagtctaaaagattttcccttctgatgttattttttttgttgttcagaatgacacttgaaagatgcctaggatttctactgctgctcttagaatcacaggatctcagggtaaaatcaaactttagaggtcattaatttcaaccagccataaaggtctttttgtcaaacttatgaccattcaagatactttggtgtcaaagtagctcacaagataaaataaatcactcgcatgttaacccataggaggttaaacttttgacagcagatctgtggtggtagataccatgttttctactgtcctattggaaatgagtgttagaggcccatttccactacaaatactgcctagtggctgacttacatggtaaaaatccatccaaccttgctctgcatacattccagaactctaatgcaaaatgatgcctaaaccattttaactctatccatgcatgaggacactaagtaagatgaagcttgttttgatatatacactttttaaaaaggtagaagaataagaggtggtaaaataagttattcaatttattgactatagtaacaacttggctctgattgttaatgtttgtccctgccatgtgatatatagttgtgtgagattaaaaacccccttgggtataattttatttacaccaacacatatattttgaagagatgaatgaccaattctgggaatagttagaagtaaagaatttgaattttctgcagcactgctgcacgttaggtaaattcctctctttgggcctcacttgcaacaccaataaagagaggaagttatactagatgttctataagccccttccagccctaacatgctattagcccatgattcttgtgtagggataccagaagaagatgaaagagagaacctaactcattttctgtcaccagtccttataattcatggcattgtgtatttctccttgagtcaacattgcttcttttagtgacacaagcaagcctgctttctccagctcctcaggaggcaactctgctactgcagaacaaagatcattctcttcctggcactcttctgattcctggtacctgtattcagtttcacattccctttcttgttgaggatgccattgcctatagaaagatactttaggtgaattaccaggcaaacgttactaaagcaaagataactgataagggggactagaatcttggaatttgtgcaaataaattcctttgtgaaactgcagactgattagaaaactgtcatagtaaaatactttaagcatgtccttttctcattttaaaataacaactggaaggaaaatataaatatatcactgaaataatggtttctccatgaagaaaaagacatttagacaaaccaaaagtgtatattctatggtgtagtaaatcattaccttactatattaggttaatacttgataaaaccttgtagtgagataaatggtgatatggagaacttaaatcttcaaatgtatgttttaagccccattatagctattttttttcaaacttacctactataaagttttgtccagagatattccaaaaaagaataatagattggtattaatgtttctgcctcttttactctttggaagacgtgccaataggcaggtaaagagatcaaaaagaaaaagtcgggcagggtgcagtttctcacacttgtaatcccagcattttgggaggccgaggcgggtggatcacaaggtcaggagttcgagaccagtctgactaacatggagaaaccctgtctctactaaaaatacaaaaattagccgggcgtggtggtgcacacctgtaatcccagctactcaggaggctgaggcaggagaaatgcttgaacctgggaggcagaggttgtggtgagctgagatcatgccattgcactccagcctgggagacagagtgagactccatctcaaaagaaaaagtcaaactagatcaccatttacttaacaaggagctgttagtgtattaagagtattatgccattcagtctgattaaaccacctgaaggaacagtggaacctcttcctaatcattcccatgtgagacttcctgggagacagctgggggcagccagaagcaagtagctagagaggactgtggatttctttgtgaggaaatctgaaactggccactttaaggcccctgggttctactgaggttaagcgtctaaagtgtccttgactcactcaatttcaaagcaaattcaatttgatctcttgcctaataataaacactgggcagaagcagacatggaaggatttggaaaatggtgttaaaagatcaaagagatctaaataaactattttgtttgaactagagttaccaagtagaatagattgttttaccatagatggagactctttgagaaggagttaaaatttgtgggagatccccaaaataatggcagttcccacacacacttttcccccagagtgtatataggggatatataccactttctcacctccttttccacttcttatcattgttagatctctagaaagttcatgtagcttctttctcctttgtcgttatatgtttcagatacctcaccagcttcctttgctttcatttaccatatcatagtggtaatttcctcaattcctatatcctacaagagcttgatgaatgaaaagaaggaagcctgtgacaattattttattcaagcctccaaaacagagttttgccaaatgcttgtcctacttctccgtgcgcttgccatggtctttgttttgcctctttttcttttggcagttaccccaactataactggaatttcctgattgatgaagatttagtggtccaaacacagtcagttgtcttttggccagaaggaaatatacattatataatccggtggtttatcttcttatccctcccccattaacttttttttgttttgttttggtttttgaatctctgcttcccttctccatcccctaagcaaaagcataaccagcacgttttttagcatttagtagatacaagcctagcattgtgctaagtattttgcgtctattatctcactaacttttcagaaccatcaatgaagttagttcctttatcatccttattttgtagataatacaattgagatccagtgaaactatagttagcaagtgtaggtgcacatactaaaaccaaatgaatgacttgaaatcccaagtggttaacatttattccagaatactttcctaatctgtgcctggcactgcactagttaatgaaaacagagtgagaaaagatatgatgtgtccagccaggtgcggtggctcacgcctgtaatcccaactctttgggaggccgaggcgggcagatcatgaggtcaggagaccgagaccatcctgaccaacatggagaaaccgtatctctactaaaatacaaaaaagcagccaggtgtggtggcatgcacctgtagtatcagctactcaggaggctgaggcagaggaatcacttaaaccctgcccagaggcagaggttgcagtgagccaagatcgccactgcactccagcctgggcgacagagtgagactttatctcaaaaaaaaaaaaaaaaaaatgatatgatgtgtccaagctctttgtctaatgaaggagacagatgtcaaaaagataaattactatacggtacaaaaatgctcttatagaggtatgagcaatgttctatggcagacaaaaaattagaaagaagacacccattttcctcatagtaaaccaaaaatgatctaaaatattccatgtttgttaaaaagcaagatctttatggttactgttaggcactgcggtatgcctccctggattgtcaataccaatgccatatagatagaacaaatagtttgaaaagacatgaggacaaaacagtctccctgtctcccaaataatagatccaaagaattctctggatttgaatttaatgttcaagagaggggaaggcataaatatataaacatatatgtttcatacatatgtgtatacatatatatgtttcatacatatatatatacatatatacacatacttatatatacatacataaatatatttatatatccacttaaaacatatacaaaactacctatacatatatacatctatatatcacatgtttcaagaagctgttttctactaacatcttcatgtacgtaaaatttaggtgttttataaatttatttgacagagcacccctaaaccttttatatacacacctcatcagatggaagtaatatataaaggaaaggcactggcttcattcttctatttttaaaaggagtgaaaacatttttgcatttgccaaactcctgtgtatgcaaactaattgtgtgtgtgtgtgtgtgtgtgtgtgtgtagacacagcaccatttttggtgaggatggcacaggggctctcaaaagaaggagttctcagaatcatagcaccaaaacgttgtgagtttgcaataatcagagtcatggtgagcatcatggaaatttagaactaaaagagatgttacagattatctccagtctgagtccctgccacacatgagaaactaaggccaagagatgttaaatggcttgaacacagaatgatcagtggaacaatacctagagcttctgtcttccaaatgagttctttttccaccttatcatgcacgttacatcaggcatgaatactggaaatctttctaatgtagggacatccaagcaaaacaagttgcatacatgtcataaaaaactttaaaaaattcagatttacttctggcaaattcattcaggaattcaaactcagataattaaattaatttcttaatattcaaataaagaccagatacacattgacatcatctctcttgtatattcagagtaccagataaatgggatttttcactagggggacaggattgctacactacaccattgccatttgcattcacaacacgggatggcggaagagacattgatacaacattttttctgcctccttcatttttaaatggatggtgacatgcttcacagcagcatctccaaacaaaagatgacaaattcccatttattttccatcagtggtactgtgtgagatgttgtactaagtctaagcttgttgttcctgaggcacagaagtctttttcctgcagcatatagcattactgtaaaaataaccattccattgccagtcactctgtcaggagtattggcagagtgaagaagacttatttgatttcactaaagctattagtttgaaattctgatctgtaaatctggatgggaaccacacgagggaaaggatccctgccagaagcaatgggtcttgtacattctcaaaaacaaaggtcagatgaaaacactggattgaaaatagagccctagaaatgaagcaagaaggaaggaaacttatattgagcgtttgtaatgttccaagcattctgttaggctgtttacattatgtacttgaaaccgtcaactggattcatcttttccttcctttttccaccattgctggcatgtgtgcaagtgggggacccagggaatagagactacaatgtaaaaaatggtttcgctgttatcgttgtcatgttttcctatgtaaaaaataggataatgtgacttttgctgttgatagatgtttcttcaagatcccagtagagtattttgtgactggaaaatttctagaatcttgaaggcaaaaataagtgaaactgtagagaagtgtaggaaaagtcatcaggggttttacataaaacagtttttattaaatctcctttggaagggagaattacaactatctgagctaagttttgttgtgatatgaacgatagtgactgctaaaaggatagcatgggaaagttttttgtttatttgtttgtttttgagacaggatcttgctctgtcatccaggctggagtgcagtggcaggatcacagcctactgcagcctcgacccccacccctaagctcaagcgatcctcccacctcagcctcctgagtagctgagactacaggcctgtaccaccatgcctggttaatttatttatttttttttttgtagagatgggggcctctatattgcccaggctggtctcaaactcctggccttaagtgttcctcatgcctcagcctcctaaaatgttgggattatagatgtgagtcactgcacttggccagcaagggaaagttttgaggagtgatggaaatgttctatatcctaattgtggtgatggttacataaatctatacatgtgttaaaattcatagaactatacaccagaaggaaaaggaacccttcaatttcactgcatgataatttacaaaaataaaatttcaaaaattccagtagtcaactctaagccaataatatgttggactatgtctaacaaaagggatattatttaaaaatattgccaactgactatcattaaagcctaataaataataaaaaagtactgtcactccccacatgagacaaaattgtcatctttacatttatttcttaaaattattctttcctggcatctgtaatcatctatggcttcttcatttcctatgcccctctgctgtttggaaaatcagaaaatagaaggcattttggcattcagggtgataggtaaatgcccctattgtaccttctaataggtcaaatatggtgactttggttggttcttatttttgttatttctccagtcatcaatcgtattgatttttttaaaaacaaaggtcaagcacatgttcgtaggtgacaccagttgcttcagtgagttggtcccttctgcttactgttctggtttaaaccccttgtggcattttctactgcatggatagtggtaaatggggttgatagtgacatagaaatgaacttagaagtaagtttatagactgttggggaccatctgttaatgtaaatgtttaaggtaaaatgcattaaggcttaagagctgacgagacgttttatttgcctcctgcttttgggattatgcctggcacctgcttgagtctagagggttcctggttaaacttgggaaacctggtttcctcttttatctgcagctgttcgttttctgggatggaatcctaagcacttatttgaattgtatttgttgaagtcactgggttatacagtaaaaataaggagtcatgttggtttttgttcgaagttttaaagtatgtaaattaaatacatttatatggctaattgtcatttatggttacctactgttaaatagttgtttaatttgttgtcttcagcattgaaaagttaagcagtatcccttagcactatcaatgtcagtcaagataacagttcatttatttcatagattactttgattaaaatcactattaaagctatttgaattatattataattttctggtgatgtcataataaagaagtttttgaacgtgcccattttatttttaacgcttcaatgtgtattactggagaagaaattgaagtaacatatttttactgttaatgggaaaatggtcttcttcaaaaaggaaaaatcaaacttacctcctagatataaatcaataattttcatttctagcattaacttagtagtttaatgacttgggcttatggaatgattttttttagaccacatcagacctacccaagggaaaggaagcacaaaaaatagggaatgatacgtagaattagatggcgagaagaaacgaggagagagagggaaaaagtctgaatgcaagactattgaaataagtgagtaacacacttttccagaaaagattcatattggagttttctagaagcctctgagtatgatgaggaaaaagaagtgattaaaatttgaatggtttccctatgggcggataaaactacctgttcagctggaatgattctgatgaccttgcctctgaagcttatcctttgagatcagcaaaaaagttcatgttctcatctctcatttgagctggagttgattgatgcataattaagatccctaaggaacaggtgcaaaagctgcagcgcttctagattcatccatttctctctactttttaaagaccagtctcatgattctaatactataaacacttggtggcttggtattgggggcagagagcttccggtaggatgacatgagataggatgtcatcctgccacagggaataaattcttggatgaaattctacaggtcatttagcccatctcctatattgcacaggatagggagctggggactcctgaggcaaagtcattttctcaaggccgtgtatctggttagaggcagaggtaggaaggaaacccaaatctttctatttttagaccatttgcctctctactaggccatccctcgctttaacttgggatcttaagcttcccttgtaatttcttgagagtaggttttaatcttcctactgtatgctctagaaactatatgctgggggaaagctgaggggatagcatagagtaatatccaatcttgaatcctttctctcattttaaattgtggtgttttaaattagcataggtaacatagagattattactcagttgaccactttgcacttgatctgagggacattgcagagtcatcacagattcttgagttatgaggtcagtatttaatgaaaggatacgtcgaaggcttttccttaactttcaaggacctgtggggatagtttctactcaatgcttctttttattcgctttcctaataaaactaatatttaattataaaattaaaatgaaacaagtttggacttccgtatgaaaagtcttatacttgatctgtaactacaagatgttagatgttcttcatggagatgacaggcaaaggttacttttacagttctatgaaagtaaaaagcttttaaaacatttgaatgggaattggtaaaagaagcagttcttaattatgtcaattgtctgtaagagctcaggtgattatggtaaacacacctgataacaataacttaagagagcaacaataactttacagcagacacacctgaatgttggtgggagttctgagctaaggaacccagaagtggccaacctgaagatcaattccttgtctacgaggaacatctgatcccctggcctgtcccttggaacatgggccatacaaggagttgaggccctttgttttggattaaatgaaggtttccaagcggacgtggttaggaggagggtactaagtgaaaatgtgatgtaaactgcctgccttttgcaagtggttctcctgtctagcctgctacctctggactctctcccctgtatgcaaggccccagtaaaaccccaggtctcatttgctggctctgggtctctccttcagcctcttgaacatgctgccatccccggtggagtcaataggaagtcggcacaacagacaaggaagagctgtcaccttgcctgataaaataatattctaaaggggaaagtacatatttataacaactggcaagccttatgacttaaatgaacagagctctgctctatggaaacacagaaccaacagtgccaggtatgaatagggaaaacttcttggtagtggtgataccttattagagtcttgaagagggcatatttcctggtacagaaaagggggaacactcaagtagaagagtaaagcagaaaatatataactctccattttctcaggaggtctaactcattacagttccatttaacccaatcaaaaccaatgctcccctttccctcacatctttaccgcattcttttaaagaagcatacgcacaactctttgagcaagaaatatcaggcaaccgctgccatcttagctaaaaaatcttttatgtttgagaacttacctggaagagtcctctggagagagaataagaagatgctttcagttgcacttggagagaatgtgagaattaatcgcctgcttgtttgggaaataacaactagttgtttctggttaaagcaacaccagtatttggatgagttggagcaacgtcagaatgattggaaattgctcaaagctcacaatggtacttgaagtaaaaggatgaaccccttcaagaacaatgctaggttctcctttgctacatggagggcaatggcgcatgataggccagggagaaaagaatcaccagatcctttgcctacttctgccaaatctgttgcaatgtttcagataaatcacttgaactatctgagctttgaagtgcttcagcttccactcaataagaaaaattgtttgaacctctctcattctgctcaccatcttacccttctccttgaagatcagcttaaaataaagtgatttgaagccccaggtgaaatgggagccctttactacctcctgctaaaggtggtaaatgactgtgcccaactttgacctcctctagttagcaacatcattctaaacttagcccagacagaaaaggatgacagcaaaggtttgaacacttttaaaggcctctccctttccccagagttcttatatatctatgtatatgtgtataatatgtttgaatattttattataattatcctccttaagaaaaacaaatttcttggattttccctatgacttgggcttaagaagtctcttaacagttcctcagatgtagtacctgcggaagggaaggattaggttagaatatattcaaagtttgtataaaaaagagggtaaactagtcatttaaatgtaaacatataaacacttactttttactgtgttggctttgatattctttaatttctttgttatatcagccctttttttatgtcatgttgaaaatgtgccttcctggttaaaaggatggatatttggaaacaaggcagtttgaatcacagcacaactatttaattttaaaagacacttttttctaacctatataattcttaattgttctggacatgtaggctatttcagtgaaatttagaaagcaaggccatttcctacagctaagccctttaatgataattatgacaccaacccccaaagacatggtttcatggctaacagatcactctcagattttgtggggatagagtgttggtagcaggaagcggcagaggaattcaactccttcttgagcttcttgtgttttataatcctccctatgtcccacctgttttgtctcagaggggataagtcaatagagctgctgctgttcacaaagccatgcaggtaagagacatgtaccccttgcttcaaagtcttagtaaacttatagagaaaatatgatttgattgcctaacaatatatttataatttacataccaaataagtgaaacgtaaggaaaaaactgctttgagctcccgagaatgctagttgatagcaaacaaggaaggtgctttggtaagaaggttgtttgctttgagcttccatggatgagaagaaatcaagtaatcaaagaggaggaagaggaggaataaaaacatagttgagaatggaacagtcagagacatgtgggcactatcttttcagataggaattttatctttcttccttgttcaacagttatttcatacacgaatgagaaaggccaaacatagtcatgaacgtttgcttttttaccttctgcctcttcagtttttcaagaaacactaaactcgcacctaggaatattttgacaagcttagaaactttttcaaaaaataactcttgtatatggcaagatgttactaaaatcagattttttttttcccatggagacgatgactgcagaacttttcattcacaccctcaaactcgtgcagagagaagccaagatctttcttcttctgcacatttttggcatcattcagtggacttgaaagaaacacagaaaattccatggagaaatatcttaaactccagctcacctcttggcttctttcaggaatgcttatttgacctgaattaaaatgatgacttttcatctctcaatctgaagcataaataaagtaggaattttgcattaggattgtgttttttaaataatcataaaactcatattcaagtacttccttgaggcctctaaactaacacattttggattgctataaaaatagaatcagctttcctttgctaacatggataggtatttatatatcaattttatagaggactgactgtactgtaactttggaaacaccttctctttttaataataagaaatgttggctaagggcttgtctttcctggttctagattagctatgataatactcatccccttatgcagaaaagctgcttttagacttctcattgcttcccagttaatataacatagggattattaaagtctctgagtatgcatttctagatgtgtatagcattagatgaaaattccttaggcctttggaaattcttcctttcccttttagagaagaagatattatcctggctatcatacatagcaagttatatgcatataagataagttcccttttgccatgaaatcaatcttccagttacaccctgggtttgttctttcttttctcatcttgttcctttgcttttcacttctctaattttacccatcaagtgatcatgcatctgtttttcaccttgccctacaaacctctcttagttgctttattctccttccccagtgcttctgtcaccatggcttcatatctggccccacccctaccccatcctatgcactattcaaaatcttcattcccagccatccaccaactgtcagcagaagaaagtccaactctccagcctctttagaaagcagactttattccccacactacataatgcatagtaggggctcagtgataccaaatatgcagatcacataattaagtccatagcactgcctaaacatacatggtatttgaaggaaataagtcctgtcatggatgttgactgaaaatttcccagcatttacagcctagaatttttaatggaaacataaagccccaaatttggagataaaggagctacagaaaacagcagatgtcccagagcacacaaaccatgtggccaagagcaaaagggaactcacaaggaggtgtctgtattacgagaactcgtgcccaaattccttttctgtgagaaaacagtaccatataatccttttgtctcagtaaaaaaaaaaaaaaagtggtccaaagcagacagaatggaatatgcattctccctcctttacccctaaaacattctgtcttgatcaatttcatttttttttgtcaggtgcactagatgttataaaagcacttagcttattgcctggtacatagttatttgaaaaactttgaccatggaaaaggctgaagaaagctaagagtattctatataaggtctggaatgtcaagataagaaatttgcattgatctaacaggtaataagaagctccataccatattctttttacctgtatgtaaaaatcaagaggagttaatacaagtagtattttattaccaaaatagaagttgcatctggctcagactcagcctctgattcctcaggaggtttttcccacccctttccctattcctgctttccagctgatttgaccgaaggacagaaggattaagaaatcaagtagcttatctgagaggttccccatggggcgctttgtcccaggtgttcctgcttggagcttacataatcaggggctttctgcatgctgagggtattattgtaaaggtgattgtttaagtcagtgggtgacggtgtcaggataattatagccaggagatatatgatcataaagacctagttagtaccccaggagaccccaagacagggcttctgcccatacttttgcaatcacacattctgaagtaaggtggcaccatttaccaagtaggaacaaaagtgaatgattagggagaactgtttgttccagtgctctggggacaaaaaaaaaatccatgttaatcttttctaaagtgtccacttttgttatgtttatatttttgttgaggttctttgttcacttgcaactaaaccaacacgtagaactgaatgtgatttctactgatctagaaaaaaataaagttattattaaaaaggaaatctaaaggatgataaattagctgcatatttttctgttcgtctattgttttctattttctctatcttaaggttgtttataatagacagttctacatcaaacttgagatgaaattaaagttgtgaaagatttatgatgtgtgttccagttatggccaccagttctaatatgcagggaacacgtttgaaacgggatcacagttgactattaggatacaggactattcttttcagcagaactaaagagaagatcagagacctctctattttttctctccctgcctcttcttttgtaatcacatgattaatacatgctattgaaaaaggtttcaaaatgtaatgaagaatatcaagaaaaacatagaagtcctttctgactatctgcaaccttagtcgcctctcaagtgggaaccactgttaacatttcaatgtgcagatgtcaaaaaccatttgctctgactttacaaacaggaacgtgcatgcacacacacacacacccttgccctaaaagttttagttttaataaatggtgtatacagtcaacatatgtcctggatatctctccctgtctgtacttgtagaaatatgtaagttccatttaaattcaaagtcaaatacaatttgaagttttgctgaagcttctttctcaatacatgcttctagattgtagtgaataagtgactgaaatcagctagccagtttctaccacaacatgatagcttggttttatggctaaatgagccccaggaaggagtgtgagaaactcccaccttgctccattgttcatgaaggacttgcatggtgagagacccttgggtctcctttcatcccagttttatagtaaaaagatcaaagatcttccccaaagtctctgcccaactgggtccccaccctgttaccttctgaggagtctaaccctgagtactgctgggctttgcagatcctagagttgcgggttatgagtgtgtccagagaaccagagtatgtcatctggattcactcactcattcacacattcatttattcacactcaacaaatatttataccattattcatagggcagacagtgaacattaaaaatgtgaaacaataacatacagtccattcattgtcaaaggatactacagatcaaggaaagaggcaacttcaagaaagtatgattagtacattgaccagccaaatgtagaagcttctgtgtcagacttgacagggtgagggaaagcttcctggacaagaagacatctaattggaatatggaaggatgcttagaatctagccaggtgtggggacttaaagggtaaagcaagtgctacccagaaaacgtaagtaaggcagatctctttggcctgaagtcctcatcaaggagtttaagctttattctgagagtcatgggaaacaactgagaaattttaagaagcaaagggacctgatctgtaagatttatacaatggagaacaatatggaaaaggaaaaagacaccattaggatgctgctgcggatgctggggtgagtgatgttgatggctttaactaagggaatggccctgggaccaaagaagtgtgcatgttttcaaaagtcatttcttgctttctgcgagcgagcctactaaactgcctaagcacaccggttaagtgtggcaactttgagaaacagcataaaccatgggtgacattgcaaaactgaaagcacttggtgcagaggttagataaatatctgtttctagggggatatacatgtgtgcattcattgttttgttttcaagagacaattgtgcctgaggctggagcttgctcaccctatcttttggactcagagtatggggcctggtctattttctacatgaccgggctttagttcagaactgacgagtcatatatcattctgattgattttttttttcttttttctttttttcccctctcaaataaaggggttgcaggggtgagatagagattgctatgaaccatcagggcaactcaacccaaatatgcatttatcaggagccccctaagtcaagctctcctgtcctcacttggtttgtctactcagagctgagataaagaaataaagggttaaatgaggtcagttagtgggtaaaggacagagaaaatagatgaacagcccagcttggactgctctgatctctgccggggagaaatggttagaaggggacatggcagagttacaggattaccaatcagtgtcctaagcagtggggtagagctaacccctgaattgcctaccgtggcttaccttgcttctgaattcttgggtttggtttcatctgtatcctctgttttagccttctttttagtgccactccaaaggcaaggaccacaaagcataagcatccatttttattaaagcagaaaggtgaagacttaaaatgtgcttctgtatgtgtgcatttttaaagcaaccctttgtaagaatgagtggatttagcaaagtagatgcgattgaatcacaatggaatacatgcctcttactcggtctaaagtcccttggttctgcaaagttttttattctcttttcaaaccttatgcaattgtgacttcatctaaattattgatacagttctaagggattagtatcttctgacggcagtctgttcaatatatttgtattttttacccttgaaggaatatgggactgttagggttttaaaagaagtctgagtttttgtttgtttgtttgttttgttttgaatgacagtaaatatccattaaaaagctgtagatttgcagccttgatgattagctctctcttagactccagcaagccttactgaatttcctctggagatcaagtattgaggggcaaaatactggggtagagttgaaagcaatagagaagatttgttgacaatatcgatgattaaaaaaatgagcctttttaaacaagaaattcctgctcatacatttggcttctgagagagagaaagagagagagagagagagagagagagagagagtgtgtgtgtgtgtgtgtgtgtgtgtgtgtgaaatggggaaaaatatcaatgcatcaaaatggacaggtcattttgttgaatgtaactgaactcctaagcattcagagattaggagtattcataatttctgactggcatgcattatgctaatgtggctgtcctctgttgtatgcttctgctgagacagccactttactcctgcttaattttctccctaatggtagcagtagggacttgggtatctacagtgagcttttaccaatttaacttgctgccgctataggccgttataaattattattcttatttagcacttgaatctataatttctttctttccctcatgttctataaaatatagacttagacctaagttagctatgcttttcccttcttataaatctaaatctttcatttgcaacgagctaaagttttggatgctcaacaactgtaacccctgcttggcagactagagagttatcaaggaacttcattcattcattcattcattcacacgtgcttgccttcatacatttattcatctctgaatgcaataacatatttacagagcacctactattttttttttttaccaggcaatgctttaggtgttgaagataaaacagttaacaatatcgatttgtgggaagaagtactacctataatgtctagaaaatacatgtgagatttgaagaaaaatagcttctccatactgatattctcaaagtagtttttctccctaattatctgtacacctccactggaattcttgcgaaggttactttgccttctggattttgaaaagttgtctttgattttattactttctccctaatgtcctagggaaaatatttccttccttcctactgattattgttttagaatttgaaaattactggaaacctatatatgagtattttgttataaaaattcatgtgcatttgaacaagcacaagagtacttcctatgctggatgctagattctagaaaattttaaaaattttttaccagtctcccagttgtgatattcccagttagttaattgctttttctgtctctttctgtttcttcctgaggcccctcctccttccctgcctctctcttttttgattttttaattttattctattcttttttttttttgtagagccagaatctccctctgtcacccaggctggagtgcagtggcaccatctcggctcactgcaacctctgcctcccgggttcaagcagttctcctgcctcagcctcccgagtagctgggattacaggcacatgctgccacaacctgctaatttcttttgtattttagtagaggcggggtttcactgtgttgcccaggctggtctctaactcctgagctcaggcaatccgctcaccttggcctcccaaagtgctaggattacaggcatgagccaccgtgcccggcttccgcctctcttttttttaatgagcaatcataagttattatcaactagcatgcaggtaataattttcttatcttgttacttgtgttccaccactaataactatgagactgcaggcagtttttaacttctctgagccatggctccttccctgtagaattatgcagtacttcttgtgaaaattgagataatgtgtaaaaataaaaaaaaaaaactactagcactatatcagccaccatacttggctctcaccagcattctctgtgacccaatcgccagagctctgatacttattccagactcctggcaccatgtttctattgctgctgcccatattcccctcccccaacagatcccaatcacccttcttgcttgagcctattgctcaagctttctgttttgcctttcatacctgtcagttctaaatcttttccaggtattcttgatctctcatgtcgaccccattctgccactgacaaatctagttctgagagtgtgcttcagagaaatttagatttttgagataattttgatatatagtaatgagaatctcagccttatggcagcctttatgctttcagccaaggtggaatcctggccaaaatgattttttttttttttttactttctgccatggtgcctggaatttcttcaatatagactcatttcttagctcttcaaaggcttccaggtttttagattttccttctaagcctcaaatcctgttggtcatcaccctaaataatctatcacttatcacctgcaacatgctcaactgagataggtcttgtagaaatgaagcatagcctgaagttgagaacagaagaaacaggaggagaaaaagcaccagaagcaaatttattctcatatcccagttttgagaaaagctagcctactgtaaccctaggagtttggcggctgctaatatctaaaaatgcgctggctctgtagcttggaagaaaaagaggaacagccattctctttctgctttccaagggtaagcatggccaacctagtatcctgctgtgcaccatgaagcatcatcaggtgcagattaggaaatgaatttacattaagtttcaagaaagaatttctgacaatgtaagctgaattgacaagaacaaagttctgaaggaagaggccaaaccattactgaatgggtgatttgtggctgaactggatgaaccgatagcattccatggctagaatttgtgtcactggttcattctgtgtttcctcttattttccaaattgcattcaatcgatatggcagaaatgaatacccctatatacaattatttcaatatatcttatataagtttagaaggtgaagcctgtatatatttttcatgtaaatgtagtattcccctgcaactcagtgcaataactacccacagtgctgatacataggactctctcaatttgtcccccatgtcagaaatgctgtgcaaaatccccatagctgactgcaaaacctgccctgaagatcaaataaatgatatacatacgaattcctaataagtgctcagcaggttgtttgggcttatattagtctcctacagctgcctctcgggaagggataccccaacaaagtgtttgttaatgcttgccacctttagagaagtctcctgggatgctgcctaaacctacactgtaagcaaagtggaataacaagccctttgaaaagtcacttgggaagatgacaacccataatggtcactttggctaggatttaaaatgctttattattgtcgaattaaagcaccctggccatattgctctggatataccccgtcttagccaatctcaggtttacaatacaagaacaatctcaatctgatttgcttaatgaaaatgtatccctctactttaaaacagggagataccccagttccttaaaaatatatgttttattgcatatgctttaaaaaacctatttacttagcagtttcattttgtttgcagcctcattgcattttcttctctaattagcagatacatgcatcatctcttggagatgaagcaaatatttttcttttcctcattgggtagtttcccaggaaagaagctcacggcctcactctggctccgggtttgctgtgtgctttcccacacattctcaccctaccacacttttcctgtaatgttgctgagttcggctaatttagatcctttctctaatttaagttgctttcatttaacttggcttgagagtgtctgatacttacactcacaaacaaaactatagagttttagaactcagagcagtgcttcccattgagatttctggatgccacaatggtgcctgcaagaggaaactcatcggagtgctttcatcagcaaggaactggaattcctgaccagtgataagacaagatgactgtggcagcttcagatatatttacaatttgacattcaaaggccaaaggggaaaaaagatttttcccctgtatctcactatttttcagggaggaaatttttcagacgcttcctatcccacccaacctccagtagagttctccttaggtctcattggttaaaattggatacatagtcaccctttaatcaatcgattgcacaggaaaattgaatttccatgatgactatagcctaatcatgatgcatgtcctggggctgacccattttcctgagcacagaatttgttcagtgtaaccagtttctgagctaaaggaaaattcacttaacaggtagagaagaatagatgtgagtaggcaaccatacaatagtgtttgttttgaggacaattatgagtaggttttttagatacattgtatgtcacttgcaagtgtataagcagagtttgctatttttttgagatattttttgagtaactgtcatttctttgtgagatttaattctagaccctaattctctcactgcacagagagggagaggcatgggcaaatatatgggattcctgagggaaaatgtaggcagaggggtgtagggtggccatacaatttataacttaaagcaagacacttctgagagtcaaaaggagagctgcgaataactctaccaagtcaacaggtataaattatcctagacaaactaaactgtatggtaaagtcagatttatataagggagtatatttttaaaatgttatggggaagctaaagctaattttttaaagtttttgtaggtggagaaaatgccacctttatttaggatcataaaaaattccaaatttatatgaaactttttcatgtataattttgtttaaatcctaagtcttatgagacatgagacattgactgtaataaaaagtgcaaaaacctctcagatcttataggtattctatgataaatttggaaagtgtaatattagcatctataaaatcaaaatattgcctgttggtttctgttcactggaaaattataaatgttgatcattttgttttacacaatgcctgtgccaagtcttcctattgtcttcctcaaggcctctaacttgccaggttttagctatcagtgatattagtaagaatctttttggtcttggccgtgatggaagtctgaaaaacagcatttggcaagggaatgacccaaacagaataattttctatagacaaaatgtgtttaagttgatgaatgaaagatgtgaatgctcatgctaggagaaggggaaaagcattggtatttcccttaaagagaccataccagggtattttatttcctgcaagtggtttaattttgtacattgcttctctgctcacagaatgttctctgtctgtcataataaaggagagccttttcattgaaatagacctctgaatctgttttagcgactgcagtgacagtctgtatgtatctgaaagaatgagaggcataagacacctacacatgttcacatctagggtagtattttcaaaaaatggagttactttgaatccccgatcgtctctttcttttactcaatttcaagttaatatctaatgtaaaacttttataaatagcaaagagacttatacttctctagctttgcaatatttagtcttgctttttcttgttggcacggtgtgccctttaccaaatgatccatccaggtgattgatactaaaacatctcattgatttcaagtttacgtgtctagatattagatcctagaaatgagttgttaataaatatcagctttacatcaagagtttaacagaaacatattcctgaacaaatttccattgccttctaaaagggttatttcttggtctgcagagctgctaatctgtaggttgcattcagtctaggctatcagaatagggcaccccatgggacttgatgatagtattgtcacttagatggcaaacaaggcatgaaataccttttcatagaactaaacaccctcaaatggggacatgaaaccctgtacctctgggcacagtcaaaagttgctgtattaagtcatgtgtttccggtacttctgggctcattaacccacaggttgtttcttgctcccagggatcattctttttggtccaaaactaaataaaaaaaatagatagatcttatggattgatgtgaatgttgaaacagaagctctactactaaaatagtggttcataattaataatcccttgatctttactttgtttttttcctaaggggcagataagaaagcaagtacaaagcaaacttaacactttggcagaatgtaatgtatctgactttctaaaattctgtatgccagaataactggctgtttcccattccttgctcttgatatacagccaacagcctagccaggagccatgtcgaaaaggaggggaggcactcagggcagtggtttttcatggcctcattctttatagtacaatagttagtgtcccactattgtacttgtggaatgactctgaaattgtcacaccatttatgtgtaagaattgctacttctctttatttctccaattcaagcttaagttttcctgaagtttccccaccttctggagtggcaggaaatttagcaatttccttttctcataatggagctatatatggttccccagctagccacgacagaaaaacgtcgggatgaggatggttcttcagtcatggtggagacatattttctgtgggtcttttggctgtagtgctttgggccatgccctgtgttgtctgtttgaagtactcccactccaggtgtgttcagtgatgtgtggtcagcaacgctccctctgaccacgagacagcttctgcaaacatcttctccatcctgtgtgcggcatgaagccagagcactggactgtgctaccttgatatttgctgtgggttgaattgagtcccccaaaaggatatgtcaaagaagtcctaatcccttgttcctgtgagtgtgaccttatttggaaggaggttctttgcagatgtgattaaaatggaagctaagatggggccattcataagatggagagtattgtgggtcctcaatccaatatgactggtgttctcaaaagaaaagaaggtaaacacagagacaggcacagagaagagagtgccatgagaagatatggacacacacagggaaaaatgccacgtgaaggcagagacagaggctggagtgatgcatctacaagccaagatatgccaaggatcactggcgacatcagaagctaagagaaagtaatggaaccaattctggagctttcagagagagcattgctctgctcatgtcttgatttgagacttctggtctccagaactgtgaaaaataaatttctgttgttttaaaccacccagtttgttatggcaaaccctaggaatataatatagttcccttctgccctggtatagttccttacatctttctcacccaaagacgtgactaggatcatttaacctaattcccctctgttgagtatttgagaacataatgagaaccttcctaggactggagaagataaagaaaatgctacttcaattttatatttttcttgttatctcaccctgctaagcttacattttcaggaggcaagtaggtattgacagttcccaaggtcaaacttcctggcctcctgactttgttcactctggcatattcttcatgtagaatgtctcttagaacacaggcttttcaattattttcagtaaatgtttactgagtacctcccatgtgcaaggcaatgggaaaagatagtctagatagtcttagtcttcaatgagccaacaatccagagcgacatatagagttatgtaaatatatttaccaagtgttagaggagatcggtgaaggtgtgaatagtttttataaggcaaaaggagtggtggtgtcataaaaatctttacctctaagggttattttgaactgtgtcttcaaggatagggaagattatatcaggccaattaggcaaggacatcataggacaagggaatattatgataaattacatggtaggtttgaaaagaggggttggcatgcatgattaaattataggtggggtgaaaaaatggtagtaagtgagaaaaaggtgaattaagatcaaattgtgaaaaatttgtgagtgcctacaatgggccaggtcctcagctaattatttttaatacattgtcttgtcaggtctgagaggtaaatagttgcattacatagtggataaacctgaaaataaaatgacatgagtaatttgttcaagaaattcagatggcaggtagtcaaggccagagttcaagcttggcataagtcccaagcccctgttcttctctgtacaccttgctgcaaaagtaaatggggaatgcttcagggctcttgagaaaggtagtggcaatgggttggcccaggtggaggattcactggactttagaggttatatgcagagggctgtggcaaaacaggaagaaggtgatttgggatttaaaaagaggaatcctgttggaaaggaggggccatatgtacttaggtttgatgatcaattaattgattgatggttgaagggaataagaaaatagtgcaatgactgtaaggttctttgtttgagtaatgatttgaggatggtgccattaccccaaggtgaattagagacaggaacaacacgttcttgggaaaagataatgagttcgtttttagcttctttaagttttaagcgcctggtagaagatgtccagcagaacattctaaattttggcctggagttcgggagggaagttggggccagagatccatttgtgatttatcaacatggtaggacagccagtgacttttactgaaatacaagtctcatttctgacattccattgcccaagttcctgcaatgattacatgaagctattagggaataaaaaaagacccacgttcttaacatgactttgaggtattgtttgatctgggcctgcctgtgtctccagcctcattttgaggtatattctccttctgtatttcagttctcaaatgtatatgtgaaggtcctttctgacccagttgcccgataccagaatgccttcccaacatacatacacatctgtacacaaatgcatgtgttcacaccaacacacatgtgcaaatctgcacacatacatgcacatctgcacaagcaatagacacatgttcatatgtgtacacatgtgcacacatatgaatagattcatgtgtacacatgtgcacataaatacccatgcctgcacatgcacagatgtgcacatttcatccagtaattccaactaattcctcagattctcatctgaaacgtttttgttatcagggaagtcttctgtgacctcacagtcaaacaagtttccctgttccttctatgccatagcacttattaaattgtgttgagtatttagttttctgtcttattagaatggaagttccatgtcaataggacatgtggaaacatccacatatttcccttcctctggcactctacatggcaaaagtgggcagtagtctttgtatactacaggcacacatgaatgaattcatagacgaatggatgaatgagttaatgaggctatgagtatagatgagatatagtaaacaggtagggggaacacagggcacaggaatatcctccccactccacagtggacttccagcccactcgttctcttctatgataaagactatgactctggtaaactttgaagtctttctttctaacttcttgacctctaaaaggaagttggagttttcattaatgccgtgggtcaggctctgtggaaaatacaagaggaaaaccagacagtcctttctattagtgtctgaattatctcattaattgataccaatgttgaggtaatcaacttctcattaagacttctcattagatggctatttctctcttttaccttctggcagggagtttagagcatttaatcatcactttcctatttatcacttaaaggaaattcacctttcccccagttatcacatcctaatttttctggggtttgtaaaattttaatcttatgatagggcttttttttttttcctttgggtaagcctttagcaattgctatatccaacatttcaaagaagctgtgttttagtggactgaggaatttactcatcaagattttattttgccaacactcattcattgtatggaataataattcggcagttttcatgatatttcatgtctgggcccagttgctcctttggccagaatacactgagactgaaatagcagtttatttcttgcttaagtaatatggttttcttgtgaccaaaagcataggaacattttatttcaccccagacagacacttctcaggtttgtgattttaattataacaaaaactggatgaaaagaatgacttgatcatggcatagatatgccaccatcagaaaaaataatccacagacagatcaatagtatcgttttcatttatgaatactattttaatgtcttatgcacaggtattatctctacaaaccatctcaagccaaaaaaagaacttcttcagtcacacgtgaattgtctacctttccataaaaatgttctgtcaagagctttctgcataaaagagtaaaaattttcaaataacttgtaattttttattttacacaaaatatctgggctaaagaaagtacattaaagcaacttgcatctcaaaacaatacatttctctggttgaagttttagtgaaaatcgatttattcctcctctgagttttacccaatgggtaaagttgtctaaatatgggattccttagaatccatcctccttcccaagcatttccccatgtttccttccacccccaaattcttaccccatttcaggcagagctgagcaaacataagccttctctgaagtattgagggaaagtctgctaaacggctaaactacttaaggagctaacagaaaaggttgtatcagagaaacagtggagaaacacaggtttctaattatatctggcactggagagaatgtcaaaggtactgggcctggggcaggttcacaagagtgaaagtaagagatttaaaataggttctcaactcctgataaaaacacgaatatttatttatttagtctagcttttctttcttctcttatcgttatgattattattactactactacttttctgacttttcttttcctaacctactagtgtttaaacctcccgaagacagaggtcagttctgctttgatcaccactatatactcaacaattaacatatattgggtgccgagtaactgcagagagactgttctctatagttttaaacgttttgaattaatctctccctattctgtcttctagcctcttttcttccccttcagtatggtagcatagactgtcttttccatgttcttgaggtcagtacatttcaggattataatctctcagatagtataatatcagctcataatcttccaacaaaatggccttggatgacggtaggtagcaggatgaagagagtctgcttggactgaaacccaattcaagagttggaacccatgttggcagtatagatgttttatcttgataatatttctttctttcaatgaaatgaaaaagaataagccagaagaactgctttacccaagcccagattcttcaaatgtgctttctcttgattcctgtaggaagacactgaacagaattctgcatttctaagaataaaaaagaaaaaaaagttaagtgcattaaaaaaagagcaaaacaaagaaaaaattaccaaactaataaaatagtacagttggactacaccaaagggaattttcatttgattctacataattacttcaccttactctcctctggacacatcatataatttaaatgaacaaattttaaaaagtatctttctaaaatagccattaatttggggactattatataaattttaccataattgattgtgtttagtacttccctatacagaacattcttttaataagatgactgaaaggcttataaaattcaccaaatagaatctctttatgcatgataactggtggtttcaagcaaaagtatataggagtgaatatttaaaatgaaaacaaccagttaatgaagtatattttgctatttatttccaaataaaaacaagccttggtgtctaagacttagttaactaatttgtgattttttaaaaaaagtatagatgaaaaggtagctaggtagaaatagaaatagcttagaaggctagatacacagatggcttccttatgcagatttaggaagcaaagtaaatttatactaactaaagaatatgaaaggtaaatgacaagctctatgtatcatgactgactatgctaattatagcttataatattctgctggacctaagagccctcctcagctaaaaaacaccataaagttcatttaatacaaccttcatattttactgatgagggtactcaggacttgagagagtagagagcagacacacctacttcctaaagccagtagtgtggtcttctttgaggacattgaagttgagacatgaaggctgagaagtggctgatcatgtgatgagtatgtgaactttgagggggattaatgcttggcagagggtgaaagtggcatcaacaaaattggtaaggcaactggccagactgccagcatcgaaggccatagtaagcaattaagatataattccaaaagctatggaaacattggtgggttttaactgagggaatgatgtaatctgatttatattttgaaagggtactctggttgctttatgaaacacggattgtaagggagggagctagagaggaaaagggaagattacttagaaggcttttaatagggaggttaggagaaagtggaaatattggatgtattttttgggtagtgctaacaacatttgccagtggttcttggatagggaggtagagagagaattaatagaaagggaggaattgagggcatctactttctttttgacttgaaaggctgagtagatgatggtagtgtttgccgagatggagaagactggggtagaaacagaaatatgttttaggttagtatttatattttatttgacttgtattgcctaatccaagtaaaaaaagattaatcctcacctagagccaaatatatattttattttagtcaggaccaatataaatgtgccaaaggaaatgattaaatatggttagtatctattccctatatagtaaacaaaataataatttaattttcacagtggtcagaggccatcttaggaactatatgtgaaggtagaatttgtgaacagggaaggagtagtagctacgtgtcactgtgttttatatgataagtgtgtatatgtatattaatgtgtatggggacagaatgtccctatgaacttaggaaagtgaattcccttgggttagaagacaatgtaaggtagccctgtattttcaagggtgatttttagaaaatcctaatcatttttcctgaagtactttgtgtgaatactcatgaaattatagacagaccaattctcttttgcttagaatgaaaatcatctgttatgccttcatcatcagtgaatgttttgggaacttcaagactatatccatcatccagagttttggcacacacacaaaaacatcgtttgtgctagccttggactttgctacctgacaaatatagtaaagcactcaatggagaaccatacattagctggatatgtaggacatcaaacttaaatgttatgtaatagctatgaagggcacagtttctcttatagttttaaacattaaggagtactgtctgaaacttgaaacttaaaattaaaactagtaaatggcactcttaaactgtccacatccatggtaatcacagttcaatacagcatacttttttgaatgccaccaaatggaataaaatttttcctaaaatgaatgaactctctgcttctagtttaatatagcataacaatacatacatactcaaaaataacttgaagggagaaagaaatttttcctttctagaagaaggggaggcaatttgtgatgcacagtagagggaggagaaatgagagaattaaattttttacgctgctgtcagaaaactgggagaaagcttaaagagaactaatggggagatatcattagagaaaacaaaaactcaaactaaatctctaaatggttgagttggacagcattggagcactcatttcccttgtaatcactctaaaaaataggctactgtctacgatagataatatgacaatttctgttcaggtagagcgtactatttcaatgtccaaagacgttattcttttaagtaatagatgttcagtgaatgttacattggtttttaatggactttccccagttggttgcttatttcctgatatttttatgttgtgtattcagaagagtgtggactggcttcagctaatcctcataaattgtctatccattagcagatttaaactggacttggggctgccatgtttgtggattcagaagtagccttatcaatcaattagccttatcttcttgtaagtttgatgattcactaatcaaacttagaagaactagataattctatttctaatgtttttatttgttgtattctgtagacaaatatttcagaataattttctccaaaagcctgagtaaacaaaggaaaaattttcagcaaaggcagaaaagtttaaaaacttggcaaggaataactcagtatgacaatattggtgaaccttccttttattgtcatacatgaaggaaatgaatatttaaacagattttttccaggcttgtggggatttggcaaccccaggctctgtctgtgataagatcttactggcctgagagtcctgcctagattcattaagaatttctttctgtctctctctttcatacattatatatttttcaggtgaccattttagcaattgtacaagctatttttaatattaaattatgtagcctcagctgcttataaggagagtttaaggagaatattagacatatttataagtatcgtttgtcatgcaagggctaattaaccttgaaaataagcattggcctaccttcccagtacctacaataaagcacactaggccaaatctctatgaggcggtagttttctatttaaaaaataataataataaggtataaaaagttactaacaaccatgcacttgttcccctcaacttaaaagttaaaaaaattagaaaagaaaggcaacatggctaataagatatgtaaattaaaaatttcctactcttctttcatttgtcactatgttttgtttgtaggtagattcaaagaataccatacttgtcatagacaattatttgtattatgttatattattttaatttactcagatctgttgcaatgggaaaaaaattcaggaaaaacaataactatcaataataaatataaaagcatgcattttcgtaacagaaaaactgaagagagttaagacacattgtacgttccaagagggttggaagaacacacataagaaactacaaagagcatctgcgagacggcttgtgtgaactgatggtgtgggccaaccttcaaattgcactgtcctctacaggtcctttctagatccattcctttatcatctcaaatgatgtgcagtaataatgctgcttgcagaatgaactgaattatcatctaccaactaggatgtgagttccatgaggacaccactgtcacttttgtctttttattcattgctttgttccaaaagcttagaatggtgcataccatgtagtagaaacttaataaatacttgctaaatagatggatgcatttggcatttgctgttttgatgacaagtaatatggtctatagtttagttaatatgatgcattaaggtcaactgcctggtttggatcattgttctatagttatgtaaatgttaacatgaggaaaagatgaataaagggtcctgggaattcactatttttgcaagtcttctttcaatgagaaattattattttatttatttatttatttatttatttatttatttttttattttttgagacggagtctcgatcagtcgcccaggctggagtgcagtggtgtgatcttggctcactgcaaactgcacctcccaggttcatgccattctcctgcctcagcctcccaaatagctgggactacaggcacccgccaccacacctggctaattttttgttcttttagtagagatggggtttcaccgtgttagccaggatggtcttgatctcctgacctcgtggtctgcccgcctcggcctcccaaagtgctgggagtacaggcgtgagccactgtgcctagccagaaattattttttaaaaagttttttgggaaattgagaatggagaagggaaaaaggagtaaggacatgaaaggctgaggaccattgactctggaatagtgcaggaagacaaggtatgggcaagaaagagctgatgtgagtgctggcaatttgcctctggaaggccaaatagcatttgactactactcaatctttttggaaaatcttgaattaaaatctcaaatactcactgtccactgtgaaatttcaatttcatcagtattcttttacctgtgctgcttttatctatctgctgatggctgctagtgctagctgcacaaagccctgagttctagaccttctctccctgcttaaagtttattaacaagggctgggcacagtggctcatgcctgtaatcccagcaccttgggaggccgaggcgggcagatcacctgaggtcaggagttcaagaccagcctggtcaacatggtgaaaccccatctctactaaaaatacaaaaattagccaggcgtggtgatgcatgatatagtcccagctaatcgggagactgaggcaggagaatctcttaaacctgggaggtggacgttgcagtgagctgagatcgcaccgtggcactccagcctgggtgatagagagactccatctcaaaaaaaaaaaaaaaagtttattagcaagtataaatgtatcagaacttaacaggtcaatttcttgtattattgtgagactaaaaaaaattgggaaaaaaggaaagctttgaagagaaaaaaatgggtagccatcagaatcattttgtgaaaggaacaaatactaataagttaatctattgttctcaacaacctgttatccataataggaaaggaatccagtatgtgcatgactaagttaactactcaaaactttcaaaaccagaagccaaaagaagttatagtttattttaagcaatatccacaaaacctaatatagtccacttctgagtaatcatttaattatggtattctatcattttatttttaaaaaatatgctgagtacataaacatgactaaaatatcaacacattctttcttcctacacataactattaatcttaaatgttccaagagaagatgtttaaaaagtaaccctttgcagaactagcccttctctctggagctgtaggcctctcttcttcccagccccctccttttcttttcttttatcttactcgtcaccttgcagtcatgagtattgtagcatgtaggagtggactgctgagagaagggaagaaggatgcattttgcattcacttgtacatcagccttgaagcctggctggcggcaatattgtggacaatagatctttcaaacaaatagacccttgtctgttccttccttctgtaattgttggcagagttctttgttatgtgtctggtttcttgaaactttgaatgaataaactaggacacgggattaatgtaaagaactggcatctttgctgacttattcaacagactgtgtgtacatagaaaagagaaataagcactttcagaagtgttgtctgcacatgcctgggattttacaaaatttaaacaatgtgaaatgcagtaccttgaaaaaagccaggctagtctctggactctgtagtttactttctaaataaaaaatatcctattgaccataagcaaatgaacaattcacctgttagcatatggaccaaatataggccaagatatgtagtggtagagttacaagtaaattttttgatgtgaagtgtcatagaatttacagccaaatgaagtgagtacctctttgtagcagggtaatgatgaaaaagattaggcaaagtttaaagttgagacgcagttttcctacctggagagaatggacattgttacctaaaattcacattgtacaatggagtgatacatgagttgttcacagtagaccgacctttctcagcctcagctctgttgacattttcaaataacaacttgctgttagggactgttctgcacattgtaggatgtttagcaccattcctatcttatgcctgctagataccagcagcactccccttccaattgtgcaaataaaaaatgtctccagacattgccaaatgtcctctggaagtcaaaaaagcattcctggttgagaatcattgtactagaccaaggaatggatcatattgaccagaaggaagttgtatattattaaaaaaaattatccaactccagaagaagtatactggggcagtctaacttggggaccttttgaatgtctccaccatgggaacaaaggctaagtaaagcagtggcccattgctcagtccaacagcactcctccatcaattaccccctcttgactttttgtgtctttagtctcttaatcggcctcgacttcttttccttgacctttaaattgtctcctttatcctaaagcaaatcaaaattactcctgataatgcaaaggtataaaattactatgatgtcttcacatcactactaacttttttgaaaagtagtcttcattctctacctctacttcctcactgtctactttctggaatacatcccagtttggttttttccccctatgtcactacttaaagtggctgcccaaatgctacaatccaacttctcaatgatcacattaactgaactttttgtgtacttatctttgacttccatgcaacttttgatactcttaatcaatggttctgaaactttttttgtgcatcaggatcactggtgagttattaatagttaaaatacagatttctgaattcaacacccagagttcctaattccgtcgggctaggatgtagactgaggatttgcatttctaacgagttcccagatactgtccacgctgctagtctgggggatcacaaatcaagagccatgccttgattattctcttcttgagtgcttcagttgacttttacaataccatagtttcctgatcttgacgcttaatgacatttgtagtcacattttctggtttcttctaccctttttctctaaaacagggcaatgttgcccctcagagaacattggtcaatgtctggagatgtgtttagttatcacaaataactaggaggaggggaagaaggaagagaagagggtccactgctactgatgtctagtgggtagaggccaggggtgctgctaaacatcctacagggcacaggacagtattattcacaggacaaagtattattcgtctcaatatgtgaatactgccaagatagagaaacactgctctggatgcaggcattctctccaagtagatatatattctttttttttgttatgagacagggtctcactctgtcacctaggctagagtgcagtagcacaatcatagctcactgcagcctccaggaatcgagacctgttgatattttagtcatgtttatgtactcagcatatttttttaaaataatatgataaaataccataattaaatgattactcaaaagtggtctactatattaggttttgtgtatattacttaaaataaactatcacttctttaggcttctggttttgaaagttttgagtagttaacttagtcatgcacatactggattcctttcctattatggataacaggttgttgagaacaacctggtcaatattttggagagatgaggacttgctatgttgctcaggctggaatcaaactcctgggctcaagcgatgctcccacctcagtctcccaaagtgctgagattacaggtgtgagccatggcacccagcaaagaatggcctttttatcttctcttcagtctatacctctctcttgtcgacctcagacatgcccagcacttcaactctcacacgtctctggaaatgactcccagaggtattatctttaaatacgacattactcttgggtctggcctgaatttgcaactgcctgataaatataagcttaatgagccaccggcatcttaagtttaagatgcgcaaactaggccaggcacggtggctcacgcctgtaatcccagcactttgggaggccacagagggcgaatcacctgaggtcaggattttgagaccagcctgaccaacatggagaaaccccgtctctactaaaaatacaaaattagacagacgtggtggcacatgcctgtaatcccagctacttgggaggctgaggcaggagaatcgcttgaacctgggagacggaggctgcggtcagccgagattgcgccattgcactccagcctgggcaagaagaacgaaactctgtctcaaaaaaaaaaaaaaaagaaaaaaagcccaaactaaacatatccttccagtaagagaatcctttattgccagtaatggtaattatttgataaggtgtgtctctacccccttttgaccttcataacttgtaaaaatggtacaagatgattcttttaagaaaagtataaaatcacatgtatggttcagaaataccactctggcaggaatttgaggaggtgacagatattcaagaaaattgaaagagaaactttccattccatgtgagattatctaacttttgattggccagggagaaatgtgtcttattattccaagtgaaagtaaatgtatctgcctgcctagatctcagcctagtattgattggagaaaatactgatctgatgctttatgcttcgagaaagaaagcatattgagtatatgatcttctcacacatatgatcagtcttttcattagatttgttttaccgtgatgtattttgttcctcaatagaatgccatgtatatgattgttactggtactcatagtaaatctaataatatccaccattttcagagcacttactaagtgtcagaacaagtgctttgcatgccatcttatgtatactaagcctatggggtagattttattattgtacccattatgcacccatggaagctaaagactagagagaatgagggatacacgcaaggtcacctagatcacaactggtataattaggatttgaagacaggctgtttgacacctaagctgatacttccaaagactattccaatagcacaaaattcaattgctgtggggacatggttctcagaacctggtcttcttgaatcactagaccgatcctcctcagaatttaagacctgggtggaaagggaaagaccatccagctcaccccatgtgcctctcaggaatggtgggggttgtcctccattactgaaagaagcagtacagccggctaatggatggagacacaggggagagattttctttgtgggagttcattacagaggcatctgcagacctctaactctctcctgcatgccctttctctttcatagcttccatctctaagctgtaatggatgcaaaattactgcagcattttgttctgccgggctgaccccattacgcatacaccacagtcataaagctctggcttagttactgtttgcatgttcaagactactctgaggcagggaggtgtgaagtttggctacattttcaaacagagtggatgccttcttcattttaaaaacaaggaatccagcctcctttcagagtgaatattgttttgattactgctggactaatccatacttatttaccccttaatgatgatgtttctctggtgtgtgaagggtctttaaataaatgttagggcagtgatgccaggaagtcatcatttcacatgcattagttgcagaagtttgggagacttcatttccaccccaacatcctgttgtcttgataatattttattaagacatagcaaaagatatagcagggtcgttagataatggttaataaaatataagagtttggaaaggtagtgattctcaaaagttattctcagtcttccttcttctccatgccttgtcaaagatttctgcaactttcatctcaccacatctggtgagaatacttatcagagaaagtgagcaaactggttttggtaataattgacatacctttatctactaggagattctgattttaattcattcagtaaaaaaatattctgtttgttctatgcacatttctaacacttgagacatattcaagaataagacacacatagtccttgtcctacagcttacattctggtaatatttgtcagaaagcagtcacatgattatgaaaaggttacccaaatttctgtatattctatagtttatcctatatcttcttccactatttcacacatttcataaaagatctcaacatataaatattgcttttagcctgtgatattgtctccatggagggaaggactcagatggaaataaggtatcacagaagggtgcagagtgccttttcttttaaagtaattgcaaaaataggagttatattggttatcagaacatgtttgtatttcattattaagctggtaaaaagaaccatggatatatggacatgttctggatcctagatacttaatagaaatgatcactagctgtccctaaaggatttttattatacttcctaaaagcatggactatctcttctgaggtatgccccccaaaatgtcagtagcaataaatttgtaagaacatttttaaggcagcacagacaagtgtgatcggtagaagtcatggtgagtgggagtgaggaagggctagtagcaaacaagaaaaagaaaagaaaaaaaagcattttcagtctttggcagcacttctgtctcttccagcatttgtcagaatccagttattaacctgtcagcctcagacagattgaaggagacaccacctttcaaggtgagcccttaagaaaagaaaaataagaaacagtcattgttggggttgacagagacatgatcccaccaaggcctgggctatgcttggagaggaaatgatactcaagcctgagtgtgtgcttaggggtcaagagattaggcttaggggagtagggatatggaagtagtgatagcagtgaataaggaaagctatctgtttgaatttgcttgtgcaaagaggcagaaccatttcaaagatacagggtgcagattttagtgaagatgttagagctgacccctgctgggactgtggcatttcagtagaggaatggtgaatcccttcccagtggggaacacacatcatccacatacatgagggaaaaaaaaaaaaaaaaggaatgactctttttatcaacaaaagcatgcccttatctatgattgtggtgtcattttcttttaacaaacaaggatagtttttaaccttagtttgctcacaaaagcttcagcaaaaaacaagggacatcaaatatttctggatttccatgttctgggcacatagtagggctgtgccttctgaaacttcctgtatagaatggagccacatgatcatttgcaatcaatgagctgtgaaggggaatggcatgtgttccttacaggccaagcatttaagtgttgatgtgagagtcctcagagcacttttttttcttttgcctttgtcatggtgccatggctaccagcaactttcagacagtggccattgcatcaacctcaaccctgaagtgaggaaccgtggcaacatgcaggcaagcctcaagcccgcccacagtagacaaacatatacctttattgttataaaccattttggacttgtttgttactgcagcataatctggctcttatagtggacacatttggttagatacaagtgtaagaagttttattttccttgatgaatagtgggaaagtgtgtatataatattgtaaaccttttttagcacccaaattaacacccctatgtacccaaagtcctatatctgggctgcagtatccccaaagacattttgtttgttttattttagtcctgtaagaattaaagtcaactttttaaaaaaatgcagtgctaagagagacacgacaaaattgagacaatttattagcggattctttcttttctgaggggtctttttgcatgtaggagcagtcattaccatctgtaaggtgtctaaagctcaatttatttaaatcatatatctgaagaccaaaacttttaaaacccaaattttgtttttaaaactttataaaagatggtaaattcctcttcaaaatttaaacttcaactccaaatttagtatgggtgatttctcataacatttcaaataccttttaaaatacataccttttatacttaaacttaaatctatagtaaattatgagtttggttcattttatcattatatctctatgtgtttttgtattttctgaggattatattagattaataccaatgaatctattaaatagttgttgcttctctaatatgaatcaaatctaagctgctgatcaggctgaggtgttgtttttaaatcattaaatttatttattgtgtcaagacataattgcctttcccaaaaagtctaaatgttttcctataatttgctgtctctccacaagtaatacatttttaaaagccatacttggtgagattatatgatccttgttcattattaaatattgccttttatttaacactattaaaaagatatattcttataaacagcttatttaaagtcaggaaccatctggaagtttcatctcccaaaagatgagatgaatccaaatagttctttctctttctagcatgtcaaactaatgtgtcatcctagaatgcatctctgagccccatttcactaggttattaggtgtgaagcccagatctagaccaagcctgtctgctcttggtaagcctctttctttttttcattttttctaatactgtttgatgtatttcctgttatttttatttactgttttctacttatccaatagtaacatggccatgcctatactttattactttgtaaacaagtacctaagtaacagctaaactaaaacatacatgttcatatattttagcattcccctaatcattgaaatcaataacaattcaatatactctattgtattcatatttattttatattaccactatgttttatgtaataatattctgtatattaacttttctgagcatcactatgactttttcacaaacttagcttgttttaatcaacagtaaaaatgaagagtgatgttgttgttagcaatcttatttagtgttcaaattattatcaaatggccagcgagatctcttttaaatgggctccttattctttcagcactttatttgatatttgtggccacatacttgtattttgcaataaaaaaaaatttagattctttgcaattattttcttccgctaagcagaaaatcaacaaaattccagagaaccttgtgcaaatgagtgttgattgtggccatggtgcacctgcactttaagtaataacaaagctgaaaaatatatttcttttagaggtcatgagttcacactgagaagtgtgaactcctcatgagttccatgagaagggcataactttaggtaatttcttgtaagctcattgccactatgtaaaccagcttatgattcttatctagttggtcagtatactataaatatcagtgaatattcagaatagaagctgatagaaaaatcaaaccatagaaaagcagggagagtgtgagaatatattcaccatgtgtacatatatgcccctaaacaaaagcctgaaagtatctactctaaaattgatttatcctcctcactatcctttttaaattttttatattattcaccttttcttctttgaacatattttatttttgtaatgagaatgcaaagatgttaaattttttaaataactaaagaaaccgttccagcaggaaatagcactatgtgttgttcaacatacatagtgaatcttgcatacacagcatattaataaaatctcaaaaattgcttactctttacaagtaggagatattttgctttttgtgtccatactttccctttagaatgaggaggattctaagtaatcttattgtatcacatttctacttcattgcattgctctctaggggggaaattaacagcagaagacttgtcacttgagttctattcatgaccactctactctgagcattacagatggaatgcagcaaagaggagatacaattctaggggaatatgggcccatagatctttcaaaacaaagaagaaaagctttctcacaattgctatagcaaataatgctttccactgctttagagtcatcactgtaagaacatttgatccacaagtgaagaacaggactatattccatgtggcttttcaaggcgactgagagcacctgctccctagaatccttcagccacattgatatgtgtgtcataaaactgtgagatcatgatcccattgatgtgatatgaatcaagaaagccatatgctctttgctggtataaatgatagctgcatgagggcttaccaataagtgaggaatgaaatttgaattttggaaagaagtttgtagctacatgaataccttgcagcctctcttttcaatagtctcaacatttttactgccatgcgatttcttctatagctccatttatatccaacttaaatttcactctaaacattttcattttttattttttattagacaattctcttttgattatctcgttttataaaatggcacatgggtttatcacttggagacaaagaagcaataccctatatgctgtgtgtgaactgagcaatacgttcagtgaccattaactgacagacttcacaagaactcatgagattggtcaatgatcacgaagtgcatctgtaattcatgtagctaatgtggactgaagaactaagagcaaaacatacacttcgtgcaaatacccacagttaatatagcatagaaacagaaatttaagctctgttgttagaaggctggagttatgaaccaaaccatagtaactaaaattcatgcatattacaaccaagcaaaatgcagactacctgtgtgtatatgtacatttagtatttttttgtttgtttgtttttaactttgtagcttcagcacaccatgccacaaactttgtgccttataataccttggctgaatatcttctcagaggatgatcattcacttttacctttgtttgccaacttattccactgcggctctttttgtcttgcaatgcattctgtgtactggtgaagaagttttgaccacgaatagctgacaaatatgtgcaggtggtcatgcacagaagcagaaagaaaattcctctgtggttgttaacgtgaaggttttccaggggcttggggcactggttaaggaaacagattaatgagcagcaaacaggaattgatgggagtcctctgacattttgaggatatccctacacatcactgcaggctgagggaagcttggctgaaagaaactggccagaggcatgttctgactttggctgacttggaaagaatggcagtgctattaacaatgtacacatagtgggagaatttcctctcagtggaatgatgctttaatggtcccatataatgctaatgccattagcactctcatttccagatactacatgggatacataagtagaagagttaggaatcgttttctgaaaagacattctaatattatttggatattaaataaaaataaatacctctgttaagatattcagacccagtattagtgtaagtgggtacagtagaaagaggccttaacttggaatatgtagtgattaggtttaactcacagccctgccaattattagctgtgtttgcccattcatttattcatacatttgtatacattcttttattttcttacaaatctttaccaagtgcctattacgtgccagatcccacaccaggctttacgcagtcagggtcaaatcacttcacctcttcaagtttctcacctgtaaaattctgagacttttttgaaatctattttttaaaaaatacatacttgattcaaacagcagctttataatttgaaaacctctattttactcctgtttttctttggaggccaaaggtgactctaaataatttcatgaaagtaatgaaaatataatctttagtgattaacttcagaattaagagagtaaaaagtatttttcaattcatcttcagcttatgccatcacctcagcaagaacaatgagtgtgcaacaattcactgttttgtaggatgctaattagagggtagactcctcatggaaaaagcccaagcctctggttgactcctgtccatccagatggagctacaatgaaatgattttctatggctgtgtgtgcgtgtgtgtgtgcgcgcgtgtgtgcgtgcgcgcacacacacacacaagcctgggaaggaagagccccccactctgtccattattcaactcaatgtttactgtcaagatgagttttccaatttccattgtttcccctaaattgagtctctcacatagagtttagagctggtatgtctgctaggaaatagctatataataaaacatccatataatagcactataattcatccagttattcattccttccctgaaaaataggacctaaaatgcatcattgtgtgtaggtttcaattaaattcagaggacagttattgactgactactgcatgcaagctggctggactgagagtattgagatggataagaaactgtcccctctcaaggagcttaaaatctagaggaaagagaggtgtataaaatatataattgaaaatgtttgctgtaatttctaagagaacacacctggggatgtgaaaatggacagaagggaggatttagctctatcttggaggctgggatataagtcagggaaagcatttcagtggagattacgcttaaagtgggagtactgtatacatgaataagcagagcaggccaggtaagcaaagttgtggttggggaaagatgcattccagacagccagaatgttttgcctcattggaagattgtttttctcacccttagcaccctctgcttattcgtctctttgtttttaaccatttctaagttgtatcttaagactctaatcaatgtaatgggatggctgtatccctccccactccatcccatatcacaccaccgaatgagcaacaaatcttggcgtctgaaaaatgtagcacctgacgccaatcaaaacttctgctcacagctctaatgtaggtctgggggcttttctgtgttacttgaaactagtattgattgcatcagcgctcaatataatgccccagtagtcatccttgctgctttagctgaggaacaaaaggtaaaatcaagctaaatgaaatgaggtaaatgtaggaccagaaaaaccagaagtcttcattgcctgctctcaggcatcatcaaaacaaaaggctctctggctggcaaggtcagtaagggagacgagagaggataggaatactcagagacaatatgttgccctgctaagagcaggtcatggtccttaatgtaagccatgtcatttgcttacagtctttattatttaatctctgacagatggaaattggttgagaacaggtaatggtacagagtcttctgtgtgtgcttgcatgccagtgagatctactgggagaattaacttctactctcccagcacaatcggtggtcattttgagtgaccacatcatttatctccaaaccaggacaccttggagaacacaagaggatactgttaaataaacgtgagtgtataataaacacacagtgggacttccccaggcaaacagggactcttaggggatgtatgatcaccttaacatgttttctgtctggagggaaatttccaaggagaaatataagtaatacctggaacatgactctagaggtaggctaagactgcagggtattaatcaatgtataagtttataagtttataagcatgtgaaaacttcaaatttcagcaatgattctctaaattttttgctgagacagataaaatagctgtttttttttctcacacagagtacattctcataggaatatctgaattacatgcagttcctagaaagcaagctataattacattattcaagaaaacactgcagttcaggctaatgtttttgtatatttgttttgtacattttgtacatgtttttgtaatgtgtttatacatatgtacatagaaggctttacatttggtgatcagcatttaaattatttacgtacttaaactattacaaatacactacttggcacactctttccccagatcttcatctggctgtcccttttcatcttctagatctcgactcaacatctccttcttaggccatttctgaccactataactgatccctgtcacgttctatcataatgtccttttgccattttcttagcacttattagtgtataaaattatcttctgtatttagctgtgagctttcctcactagaatgaaagaaattatggacaatagttccacctaccttgttcagtagtacacctccagcactttgaaacctgtggggaaacaacaggtactcaacagatagttgttcattggatggactgatgggaaataggccatcttgtctttattgaacaacaacttttgcaggaagcattctcctcccttcatgatttttgtgcataggtaagcacctgcttagacaactccagttcctgctctcacacttcaccactggattgttgcaatgcagtcttaaatagccctcgaatatggactcaaccacatcttgcaacaagattgtcatcagcacccctttcactatgcttggcctctatatactttactcttagccttctcctgaattagtcttagcccagtaacatcttgtgctgatgtcagtcttctggttgaccaagtaaacgtattttttcatttcctctttttttgctcgtctttttcatctctcgctgatgattgtcaactgcaatgacaccgtacttttatacactgcatgatgtatacttactcagaatttttcttattgccaaataaattatttcatacgcttatgcaactcctttcgttaaaagcatgttttctactttgttctcattattaacagaactattttttcagttatcttactcattgcttttgcactgattggacatcacagcattcaaaatgttcacaaagtacctaaaaaattgaacacagaggcctctgtggttagggtgactgaaaaacttaactggatttttaagtcagtctaattttaattaacttaaactttttttttccatagttcagagcatttatttatttttttaaatttattattattatactttaagttttagggtacatgtgcacaatgtgcaggttagttacctatgtatacatgtgccgtgctggtgcgctgcacccactaactcgtcatctagcattaggtatatctcccaatgctatccctcccccccgccccaccccacgaccgtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtgttccatggtctatgtgtgccacattttcttaatccagtctatcattgttggacatttgggttggttccaagtctttgctgttgtgaataatgccgcaataaacatacgtgtgcatgtgtctttatagcagcatgatttatagtcctttgggtatatacccagtaatgggatggctgggtcaaatggtatttctagttctggatccctgaggaatcgccacactgacttccacaatggttgaactagtttacagtcccaccaacagtgtaaaagtcttcctatttctccacatcctctccagcacctgttgtttcctgactttttaatgattgccattgtaactggtgtgagatggtatctcattgtggttttgatttgcatttctctgttggccagtgatggtgagcattttttcatgtgttttttggctgcataaatgtcttcttttgagaagtgtctgttcatgtcctttgcccactttttgatgggattgtttgtttttttcttgtaaatttgtttgagttcattgtagattctggatattagccctttgtcagatgagtaggttgcgaaaattttctcccattttgtgggttgcccgttcactctgatcgtagtttcttttgctgtgcagaagctctttagtttaattagatcccatttgtcaattttggctttggttgccattgcttttggtgttttagacatgaagtcctcacccatgcctatgtcctgaatggtaatacctaggttttcttctagggtttttatggttttagttctaacgtttaagtctttaatccatcttgaattgatttttgtataaggtgtaaggaagggatccagtttcagctttctacatatggctagccagttttcccagcaccatttattaaacagggaatcctttccccattgcttgtttttctcaggtttgtcaaaaatcagatagttgtagatatgcggcgttatttctgagggctctgttctgttccattgatctataactctgttttggtaccagtaccatgctgttttggttaccttaggcttgtagtatagtttgaagtcaggtagtgtgatgcctccagctttgttcttttggcttaggattgacttggcgatgcaggctcttttttggttccatatgaactttaaagtagttttttccaattctgtgaagaaagtcattggtagctttatggggatggtattgaatctgtaaattaccttgggcagtatggccattttcacgatattgattcttcctaccgatgagcatggaatgttcttccatttgtttgtatcctcttttatttccttgagcagtggtttgtagttctccttgaagaggtccttcacatcccttgtaagttggattcctaagtattttattctctttgaagcaattgtgaatgggagttcactcatgatttggctctctgtttgtctgttgttggtgtataagaatgcttgtgatttttgtacattgattttgtatcctgagactttgctgaagttgcttatcagctgaaggagattttgggctgagacagtggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgtgtatattgaaccagccttgtatcccagggatgaagcccacttgatcatggtggataagctttttgatgtgctgctggattcggtttgccagtattttattgaggatttttgcatcaatgttcatcaaggatattggtctaaaattctcttttttgattgtgtctctgctgggctttggtatcaggatgatgctggcctcataaaatgagttagggaggattccctctttttctattgattggaatagtttcagaaggaatggtaccaattcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcatagaagtgtttgtagtattctctgatggtagtttgtatttctgtgggatcggtggagatatcccctttatcattttttattgcgtctatttgattcttctctctttttttctttattaatcttgctagcagtctatcaattttgttgatcctttcaaaaaacgagctcctggattcattaattttttggagggttttttgtgtctctatttccttcagttctgctctgattttagttatttcttgccttcttctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatgtttatttctgccttcatttcgttatgtacccagtagtcattcaggagcagattgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtctattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatttttgttggtttaaagtctgttttatcagagactaggattgcaacccctgcctttttttgttttccatttgcttggtagatcttccttcatcctattattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctcgttattttgttcattagttgatgcagtttcttcctagtctcgatggtctttacattttggcatgattttgcagcggctggtatcagttgttcctttccatgtttagcacttccttcaggagctcttttagggcaggcctggtggtgacaaaatctctcagcatttgcttgtctgtaacgtattttatttctccttcacttatgaagcttagtttggctggatatgaaattctgggttgaaaattcttttctttaagaatgttgaatattggcccccactctcttctggcttgtagagtttctgccgagagatcagctgttagtctgatgggcttccctttgtgggtaacccgacctttctctctggctgcccttaacattttttccatcatttcaactttggtgaatctgacaattatgtgtcttggagttgctcttctcgaggagtacctttgtggcgttctctgtatttcctgaatctgaacgttgggctgccttgctagattggggaagttttcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcgcttcatttcattcacttcatcttccatcgctgataccctttcttccagttgatcgcatcggctcctgaggcttctgcattcttcacgtagttctcgagccttggctttcagctccatcagctcctttaaaaacttctctgtaatggttattctagttatatattcttctaaactttttcaaggttttcaacttctttgcctttggtttgaatttcctcccgtagctcagagtaatttgatcgtctgaagccttcttctctcagctcatcaaagtcattctccgtccagctttgttccattgctggtgaggaactgcgttcctttggaggaggagaggtgctctgctttttagagtttccagtttttctgctctgttttttccccatctttgtggttttatctacttttggtctttgatgatggtgatgtacagatgggtttttcgtgtggatgtcctttctgtttgttagttttccttctaacagacaggaccctcagctgcaggtctgttggagtacccagccgtgtgaggtgtcagtctgcccctgctggggggtgcctcccagttaggctgcttgggggtcaggggtcagggacccatttgagggggcagtctgcccgttttcagatctctagctgcatgctgggagaaccactgctctcttccaagctgtcagacagggtcatttaagtctgcagaggttactgctgtctttttgtttgtctgtgccctgcccccagaggtggagcctacagaggcaggcaggcctccttgagctgtggttggctccacccagttggagcttcctggctgctttgtttacctaagcaagcctgggcaatggcgagtgcccctcccccagccttgctgccaccttgcagtttgatctcagactgctgtgctagcaatcagagagactccgtgggcgtaggaccctctgagccaggtgtgggatataatctcctggtgtgccgttttttaagcctgtcggaaaaacacagtattcgggtgggagtgacccgattttccaggtgctgtctgtcacccctttctttgactaggaaagggaactccctgaccccttgcgcttcccgagtgaggcaatgcctcgccctgcttcagctcacgcacggtgcgtgcacccactgacctgcgcgcactgtctggcactccctagtgagatgaacctggtacctcagatggaaatgcagaaattacccgtcttctgcgttgctcacgctgggagctgtagaccagagctgttcctattccgccatcttggctcctccaacttaaacttaactttaaaaattgatattcaattcagtcactggaagacataagtatgtgtgaaactactcggatatatgaattactttttcagttgtaagttttgtgaaatgtatatacagataaaatatttctagtaaaaacagtgtcagaattgagatgtgctgtaagtataaaatacacatcaaattttgaagacttcatatgggaaataggatgtaaaatagcacatttacaattttaaattttgatcacattttgaagtaatattttgaatatattgggttaagttaaatatattattaaagttaattatacctatttctccttttttggggtggctgctagaaaatttaaaattatatatttgctttgcattatattcctcttggactgtgttggcctagatcgtttattagcttaggcaacataatgcaaatttacattaactttatttggtcttcatcatattaataataaaagcaaaacaaaacaagaaaccaccaggtgctaatagtcacaggctgagttccctaggaacagactctgagattgagtttagcatgccacataatttttaaggagttccctggggaaggaagtaggattgagcagagagaagttgagctgcgatgcaggcccaacaatgggctcagctaaccccacgaggagctctgacactaacatgacctttcagtttgtcctgagttgggccaagatggcaaagtctttctaccccatcatcaacaggtcattgaatgcgggtcactctgggaagagcatgatcttaggcaagatggtgctctgtgtctgaggccaaccctgaaggcgctggcagctgaaggctgtctatggacagcactctttgcagctcaggtcaggcagtaagtctttagttgcagggtgagctgggcagcacattacagtgtctactatactaacattttttgttgaagatttcccatgaagatattgattattgtctttttcagtttttaatcagatgcattggctaatacctgtttgtagctgaagctaagtctgtcctcttaggccatggtgtgaattgtgtgtttccctttcttccttcatctctggcttagctcctttcattaccttcatggcccctctagaagtttatgttaggtttttaaggccagaccagactgacttgagcccagccgtaattggagaccagattcaaggctctctcttggtggcaggtgacattagtcagactttattcttatctatgaaagttcataagtaagtgagcttttgtgtttttctgcttaactctcattactacctgttatctctttgaagacaagggatatgtaaaggtacatatatgtgtatagattgtgtatgtgtttgagtatgtatgtatgctttaagccttgttccaagattggtttatattagaaactaaacaaatacagcccagcacggtggctcatgcctgtaatcccagcactttgggaggccgaggcgggtggatcacgaggtcaggggatcgagactatcctggctaacatggtgaaatcctgtctctactaaaaatacaaaaaaaaaattaggtgggcgtggtggtgggcgcctgtagtcccagctactcgggaggctgaggcaggagaatggcgtgaacccaggaggtggagcttgcagtgagcagagatcgtgctgctgcactccagcttgggcgacagagcaagattccatctcaaaaaaaagaaaaaaaaaaaaaaggaaagaaaaaagaaactgaacaaatacgttatttactgaaggagtaaatatgtgtgacaaccagtggtgtcctcattccgtatctccatcttcagagaatgcttgtgtgccttcaaatttatgacattttcctctcaccccttagtggtgaagaaactgaaatattgaccccatccccaaaaattaataagttaagtgtaagtggtacctgtggtccatttgaaagggaatatctgaatggaatgggaggacagccacctattctcagcaggcagaaagggtacttgtcaacaggtaatatgggaaagctaagaaagattaagactttatttttccctatagtctgcctttctgtgttcccaattctttacactgctgtgtaatgttatggaatatgattctcaattaggaaacttgaacgaagacaaaaaaaatggtaagagactatcttctaaatatatccttagttcttcaggcagcaatttaatttcagttaaaagaaagaacaaaggcatgtcaatgttttggactgaggctaaccgaggactttcactggcactctttttagagctagaccattggggaagttgcagtgttacataatgctatgcttctcattgccatagagaagcagcagctgctttgagactttagaaaatcagcagcgacttgaactctgtgttgcttgtgtccagaaaattccaggcactttgtcaatttttttcttcattttcaaattatccttttgaggaaaatataaaggagtaatcccattatctctattttagagataattcagctgagtttcaagaggtttgttgtcttgcttcaagttgtccattagcagaacgaagaacaaaatcttgctttctgtctttcccagactgattctctattgtagcttctctttggctgttgatataatatcaaatattttgtatgtatgtgaaaaatttgaaatttcatttatttcactagtttaccaaatccctgcctttcactgctgaccaaggttagaactaatataaaactatttcctttagaatgcttagtgaatattttttgccactaaggctaaaacaccactgataatttttactctctcttgtatatgtttaaataacagaatagaaaggaatatgggaggtacatgatatggaatgagacacatcttgactaaaatattttagtttagagcaaattttctctgatcatagttattcaaaggatctgtttatttgtatgtggcatgatggtgtgtgtaacctcacaaacaaatgcagagcctgggaataagaaagatgacttatggtttcacctccaagattttgactctgaaaaagtcatagaacctctccctttcatagtttctctccctctctctttcatataaatatatatatttcacaataattacttgaataaatcctaggtacctctcctaaagagttttgaaaaataaacacatagatatgaagaaagatggcccaatataaaccaacagtggtcctactatccctgtcctctatgggcttgctaagcaataccccaaggtaactttcaagctgactttgatgtgaatgcccaggttcacgtataggagtaacatagaccactaagaggggtttcttgacaatccacagtatctctctcccccttacaaaagatagtttttaacatcaagaggacagttgttgactctcatttgaattattaaaccaaataagtggctgttaaaggagcaaagatctgaataataatcagttatcatttgcagagataattcaaatgatagctaattattgggcaggcactctacataaattatttcttttcattcctatgagatgggtactttatgaggaaagagagaggttcagagaaggcatgtcagttttctaagatcacacagctcattgttgactgagccttgacatgaaactacagctatgtttaaaaccagtgctatttctagtgtactatcctgcttccttgtaattatccaacacttttcttctttttctcctttttaaaaatcaggtagtatctgattgactttgtctttcttttttgccaagggtacactcaccaactgctgtccagagttaaatttatagtcacaaagcaagagaaaagtctttgtttccaagccaatgggctgggtttccagaggcataaatcctaggaattagtaatatcccatataaaatcactgaaggttggtgcctatggttatgtcagtggcctctatgatactccctaaaggcgtaatttattccacagtccctagacacattcgttcatgttctttgaaacagggcacacttgcctttcccagaaatttttcaaccaaacaggactaggacatagatcaaggtctgtcagcctatgctcaaagtgtcctctgcagactttgttgccactaaactagaaataatccatagtttctcctgtttccttttccgttaatgaccaactttatatacactcaaaatgaataagtgatacggtttgttcttctcctctacttctctgtttcccaaagtaatttgcaagttagaagaggaaatccattaggagaagctgaatggattaaaagataataggatttggagaacaggacccagtgaatcacaaattcattacattcacagctgacaattgctaagtcccggcctgctcctctcacaatggggccaaggtctgtgcagcatgctggtgtgcctggtgaaaggagaaaatgagcttcataaatacaaacgttagagtcaatcttatgttccccagggactgccagtactttacttggcaagaatagaaaaggaattcttaaggatataaaggcaaaaacgaacactgtaaaacacaaaccacaacaatggaaaactatagagccttgcttccaaagcttagtcatccatacttttctgaaatgccaggaattgggatatggaaaagagctcagaaaactacaggaggcatccatggaacaaccacagaattctcattctggaaagctttggcagggctatgttctcatcatttcactttaatcaccttttaccccttggggccatttgaggaccatgaaattctaagaatgggtagaaaatactcccccaaccaaataagaaataagattcttttgtttctatatgtcctggattctgcatgctgcctgctcggagaggagagccttacactggagtttgcaggcatttgctgctgtctcaataggtagatcttcagttaggtcccagcttcatgccatctgttatttctaaagtattttggccttcagctggaggaaggtgacaggagagtgttctgttcctgcagaaaatttgcttgtcatcagagtaactgtgtactgttgaaacagctactgcctacatttcactgcctcttgaaagctagcattttggtgtgaatcaattatgaaaagtgatgcacactgccccaacacgcacacatacacatacaccccgcctaaaaacctgagacataaacaatgtctagaattgtgggcaatcatgcagagcccttcaaacaatattaaaatccagccacttgtaaagagtgagtaataaaataagtttagggttatataaattgagtctaataaaataattcagattcctatggtacattacagttttatagtagtgcctttattttctcttgttcttctacaaatgcctttttgaatatttattcattacccatttcctggataaagatagtaaggcttagaccttttaccaggatatcatagcttaaaaaatgacagagctatttaattcatatttaaaatcatattttttcttttgcatttttctacttcctggcatatgtttttttctctgatattagggtataggacaggacgaggaataattaaagtccctccaaagattaggtcagaaagggaccataaaagcttttccattaggaagctggctttggcgtttcattgtcattggagaaggcccatctgtacctatggcacgtgttatgctaggaaaatacctcctgaatccttttgtagaaagcaataagatagcatttctcagaaagaaaatgctttgctaagcaaatactttgaaaaaaacaataaatgattttttaaatggcattacaatgttctttgaataggacatgggaacaggaatcaaacttggatatattgtattttcatcttattttatttcatttttattagtgacagggttttgctctgtcacccaggctgaagtatagtagcatgataatagctcactgcagccttgaccttccaggctcatgatccttacgcctcatcctcctgagtagctgggaccacaggcatgtgccaccatgcctggctaatgccttttaagtttggtatggacaaggtctcactgtattgcccagactgctttctaactcttgggcacaagtgatccctccaccttggcttcccaaagtgctaggatgagaggtgttattgcatatttttacaagtatcagacatgtatgttctgaaaggcactagaatcattgaaaataagtcactgtgaagtgcaatgactcttgaagataggggatagcagaagtgtgaaactttgtaggctaatcattatggccaatgcctaattaggatttatagtaccaaggcctgaccaaagtcataaattatcagacaaaattattggacagaaagtgaatgactgcatatcttgttaaaatcactagggaacttaggcagaaggtaatgactgaaatgagaacttgcctgaaacatcaggctaaaaatagttcttgatatatgaagatgatctgaaaaatgagccaaaatttgtgttgcaaaacagcaattcaagaattcaatcttaaaacattgcctatttttttcttcagaaaacaggatacaaaagtcagtgtgaatgagcaaagccattgagttgctcccaaagcagaagaaattagacaaagctattatggaggagatggggatggatttccacaagagagggcaacctctatgtgaggggtaatttaatgaaaaatttgcaggtgatgcacctgtcttttcaaagttcttttcatccctgcaatttcatactttttcaccttcaaggccaatggctttgtcagtgctgcctgaattgtgcctttgaatgagtaatgacagatttgaaataagaacattggagcattttaagtgtccagtaatatttgctcctggatctactttgaatggtgggtgtgtgatgactggtctccatgaatgggatcatctaatgccttttaaaaattaaagacatagtgtcatttggactttttatgatgcagtactatcttgtcacagaagacttcaggatttctcttggttagcaagtcaacagagacctgtgtatctaggcctgcatatatgcatgcatgttgttacttgatatattcggttataagaaaaggaagtcagtcctagtaaataacaccatccatatgagatttatgggtttcacttataaatattaaattaataaataaaatattatcctatcatacttagtaacaaaggtataaggctacaatattacacctgtcctgtaacttcacagatatctaatgaatatctagaaaacatctctgacttgctgcgagtgtgtcactaaagccctacattgaccatatatgtctttattctctatctgataatgttgcaactttcacattatttttgaaagttcttaattggtgattaaattcctgagaatttccagtaatgcataccaaatgtcctgagactttttagacataaatctgactcaccttcaaaatcaaaacaaaaaatcagtattactatgatttcaagtcataatctgaatttaactccacctttaaaattaaatgctgccaggatcacatgctcaaaggctttcttggaaatatggcttatacaaatggcatatgcatatatatatatatatatcatatacatggcatatatacatatatatgagatatatatgtatataatgtatatgtatatataaaactggcaacagaaacacaggaaatgatatgaaaaaattattttgttcatttggaacgctgtatttgttgtcatttttgaagacaataaaattgtcattcgaaccaaacccatttgtttcattatctattaatttctatctcttcacactgcttggattggagatagcaaacaggccatgaaaacaccttgggaaaataattcttgcacattctctaacaaaactggaaaaattactgatagattcttggtttggtcatatggtgcttacatgaactggagaactttgatttgagctagttcaaattttaacacactatccttacatacctacgtttgagagactgttatatgggatttgagagattttgaaaacatggcctttttcttgccgtttgtgagcaaggagagatgtaagctgtttacctctgtacccagcaaaataccttccaatgaggttagaatcactaggacttttcttaatgttggttcacccccattatacctcctgagtataagtggataatgatttttttaaatcataagagcgccatgttgcaattgttattatcaccccacctcactgtgtgtgtgtgtgtgtgtgtgtgtgtgtgtgtgtgtgaagttaaatgatctttaatagtggtttgttaccaaaaaatccatgtaagctcaagtcacctaaataaaaactactgtataagaaggaggcacaagtatggaaaacatataggaatacaagaaatgtttacttttggcccttttcctcttttaggccatttccttcctttccctctaccttggacagctagtttcaataaacaaaaccttgtccttattactaccacttttagaatgccttaacttgcccttaatgcctagcctttcaacaggtggattcttgtgtgtcctgaataaacatacaaacacatagaaacacacatacacaatacaaatgtatatatattttgtatagtatatctgtatatatttaggtacatattttaaaaacaaacacattcaagtaagagaaacattgagtggtaaaagaaaaattagcaaactgatataaggtgtagcagtcttacttatcaaatggaacaggtgtctttttcaaatttagttggtgcctttaattggccatttattcctgagtgtgttgggcgtagtaataaatgatatgacaacacagctcatgccagtggtggacttctacaaccagtggaatagtcaagaaaggtcaagctgtctccattgatttgaaagtagattgtacctacttatcacaagcaccttagttttcctttccttcttttctatgaaggattgtccccttgtccatatcacatgttatctatcatccttaatgtcactaataaattagattattcatggaatgtgcttagccctgtgtctggctccttgtaagcagttgataaatgtaagctgctatagttatcacactttgatccttaccacgtttccttgatatattgagggcaaataattgaatctgcattttattaaaagaacactgagactaatggaggtgaagaggttacctgacttctctttggctcaggatcagtgaacaatattataggtacttgaactaagaactccagtcttttaggccagtgattgctcctcagtatcaacatttaaaagtagttagttattcttgttttctgaaaccatcctgagaaaataaaggagataccacttctgtcttgtctcttctccctggttttaaacctgtgccttgtcataatgcaaaggccatgtatttatttaaaaattataaacacattttacctgaagtgacagctgaactgtggttctaaatagcctctgttggtggcctcaaacttctgtatatattcggtatattccattaagtgcaattttatgaaaatgtcataaacaaatcaatcactcttgacttaattttcagccaccatcagcttctattgagaatctcagccatcaaaatatccataagaccatatgatgaagtacatataaagtactgtgtgagcacaatgaaaaagcaatgagattcttttggggggttcacggaaagcccccaagtgagggtgccatttgaattgagtataaaatgatgaatagagatttgtccattgaaaagggcagacaggccaggcacggtggctcacgcttgtaattccaacactttaggaagccgaggtggacgggtcacaaagtcgggatacaagaccagcctggccaacatggtgaaacctcatctctactaaaaatacaaaaagtagccaggtgtggtggcgggcacctgtattcccagctagtccggaggctgaggcaggagaattgcttgaacccgggaggcagacgttgcagtgagccgagatggcgccactgcaccccagcctgggagacatagtgagactccgtttcaaaaaaaaaaaagtaaagggcagacagaagctggagatagagtgacccctgtcagactgagggggacatttgagcaaagatatgaatattaaaaaaacaatgatccaatatggttgaattgggtgagtggcaagagtggctgttggcaacctgtgaagtggcatgcatgccaggttaagaagttggagataatttggtagcatttgagctgcaatagatcgtgtcagagagaactatgccatgaccagatgtatgacttagataaccctgacagccatggggtggacaaatggctagggttgagactgcagccaaactcttcacaatttcaggagagaaatgatgaggaatgagattgaagaagtggccatggaggtggggaaaagagagcaaattccagaaaaatattgtggatttgctcagtggaacttggcactggatgaaatatacagaataagtgcaagggaggaggcagaagattaacttggatagatgggttgataactgtagccataactaagggaaatatattaagctcctcttctcaataaagattagatttaattacgaaaatatcatctatttatttgccatcttgttttacaataatatatcttgtatcttcatataaaagcagttacggcagccctctgcactgtattttcatagggttctgtttttatcttacttaactgtaaggtccttgagggcaaaaacagtcaagcctttctcattcatcctttgcaaacccagcaccctgattcccaacagggtagaactcagcacatatttgatgaattagattgaatttaaatctatatatagttataggaataaatgcttggaggattttcctatctctgtttcaattctttgttttagctcagtctttttatgttggctcctgtaagctttttgcagtgctgcaaacacttctagctgacaagagagaaaaagaaagtcagtgaaaaggaggagggggcattgcagcatctagattgaactctccaggcttgcctgtctcataattttcacctttggtggggaactgtcccagatttcatccaccaggctaaggttctgacatggtaccttcttaaatcaagcttgaagggaaattgattgaaaagaaaacaccattatgggaaaacaattcattttcttccccatgacagaaggtagacttttgtctatactgcagaataaatatgatctggctgattgctttaagatctggaagctcagaggagtcataatggctttgctcactctttagagggaaattaccttccattttggagacatttgatacaaaggttttggttagctttcaaaaagtaatattttttctccctgtgtgattatttatattagctagatataggtgcatgaaaacttgcaaatatttctgtgtgcagttgtgtgtttctactgaagtaccctccagacagggagtaagcagattttttttaaaacttttctataagccccttaaatattacagtcgtcccatgctttctgtgttgaaagaaaacaaatttaaactcataaaggtggagtgaaggcaaaaagatagaataatgtttacctgatgtttatagtagtagaaaacacttcattgttagaaatagccaagaaggcacttacgttgtgggacactcatccgtcccgttgacaaaagttggattcattttatcttgcagaaattgcaaactagcatcccctcagacaaaatctagccctgataatacgtatttggacaacatagaaattatgttggcaagtcttttctacttcaacacagtccccaccatgcccattgtacaatggctggccaaattcacacatttaagttcctagctcccaaaagacttgaggttgaatgccttgctaaaggtttttagtgcaactctgctttgctagaagatgaattcctaccttgcaaaaaactcggatgcatgtctcctgagattggaatggacaaggaacaaatgtacttgtttgtagtacttctagaatgtctccctaaatcatcttagaagcagaaatcttacccaaaatatgatgcttgccaatatattgtttaccacccatcatgctctgaaccatcatgcctcttgtctgggtagccttgctctatgaggcaatttgtggtataaagatttttcattaagttttggccagtgaagatgttgtcaatgtacaaagtcagtaatgcttcttgtgaaatggtcgcctctcatgccaatcttggaagcgtaacattttcttgaccactttagttctaatgacttcacgtttatcctgaactagaaatatggtatcttcttggttgtttattctctttcttcttccctctttatatctctccatccttctttcttccttcttttttcttccctctatttcttccttctttccatcattctctcctctttctttctctcattctgtttcttcctcttttttttgaaaatcttagcaagagttaatggacttatgatctaaaaattaggttattagaaatttttgtcataaaacctggagaattgatgtttgaattctccttggctagagtcaatcctttatcctttttaggtaaatgaattaagtctcatgcaatttcctgtgtgggagactctttagatgaatcatttaaatggaaagccctgtctgctcatcaaggggcgcgattttagagttttcctgagtattatgtgcacgcttagtacagtcattgagatacataaggcaaccatgtgccttaatctgtatgaagtctcagttcatatgtgattatttaggtaaagtatataactgaaattttacatcttttgatctctttgcaaaatttccctgagccacttaaaaataacctttctttactcctttttgtcttgaaacatttttattggaagacttcagacctaactttagtaccagagaccgaaagtcatatctcacttagttctacaatctctagtccacttttgatactcagaatagatagtaaaggtgctatttttttaccccagagtgacagactgttataaatgttgggatcctatgaagtactgtggagagtatttaatgagccgttgtagagcctacacagatacatttatataagatattgtttttataccagcctcaaatgctcctaggagcagccagacaggtcttcctcaaaaggataatctggaatctttacctttgcaattgttctatgatacttctctttcaatgcacaactcccaattaattccttggtactccttgcaataagagaaaattaaaagggactcatttgatattagatgggatcacacttatatacctattgcattgtataataagtaagcatgagtatcattctgttgtatagtcccaaacttttccttgaaataattggcaagaggatagaggaaagacatccaagatttattaataccttcatggttctagttacctctataaactagtgaaaccttttccaaatattgtagataaagaaattgaggcacagaggtgttacttaactgattcaagttcacacagctaataaacaacagaggcacaattccaaaccagctcttcatggctctaaaatctgtgttttttccataataagctgcctaatttattgcgcttttattgtggtaattattttacaagcattattgcatttaatcctcatagccttgttatgtaagtcccaatagtccccatttttgctgatgaaggaagtaggattcagagaaatcaagtagctctcatgttgtctcacagtgaataagcaatagattcaagatgaactccagagcctgtgctcttaaccactacagaaaattatgaaattacaaggcatggtcctgccttgtggctctagcatcaagttggtaagacaacacaacaccaaggctcttaaggaatcctctggacttgagtgtatgtatgggaggagaagagggtgttctaggtaggatagtaacatgacaaattcaaggatatgagaatggaatgttcagctttattttcattttagataaagttataatatctgataagatagcatggaaggaaggaacttcactctcctggagtgtagagttgtcaggagtggacttgaaaaaaagagtgacaaccatgaggtctgataggctttagaacgcaggtcttaaagagcctggagaaaagagcgtgcatcacaaatcctacatagacagcaaaaccactgcccaggtaaaccaaggccgcagtctaatcttggaaggagagagtaatttaggacagcaaagcagaatccatctccttgggcaaagcttcaggaaagccctgtctgaatctaagagggagctctcggaaggaaaggagaaggacatttgcagaaggaagagaggcagccttggcccttatgaactctgggggaggttcctccccctactcttaactgaatgtggccataagttgaacaccagtgaacaccagcaactgctgagactgaggagagcagcaacaactgagcaattaacctttggtgatgggcttgaagttctaattaagagcagagtctcttctatcaggtgggagggggaacagcagaaagatgtatgagggggatgaaaaagaccagcatgttagcaggtcagatttaaaagacatccaaatgggtgtaagagggtgagagaaaagaaggagatcactgaccaattaatttttctgtttcccagtcaaagtttcttctcctttctcttaaccctgcagtgactgctgtgtgcagaagccagcagctccggggagagctgacgttgaatgcttatgctcctctctgttgtaaattcctttcttcatttgctgagtatcattggtaatttctatgtaaattttctcagagtagcaatttagcagcttttctgttgacaaatgaggaataacttaatagtcaagtgactgcatgtcatgtttcgcaaggaggtggaagtagcgccttgtagatcgcagggatggatgctggaagtgggcgatcttgggaaagcctcattgcctcagtgccctatttaatttcgcccatttaagataggagagaataagcttctatacttgaggaacctagtttcttgtgaagagtgattgttaggaatcttttctcttttagcacttagttaacgaatacctttcaaaccaaatcaagaggcaagaccccctccaactttgtccagaagccttcacaagcagaggcatattttgttttgtatcaaatgcttctcattgtccatattcaggaggcaggcaacagtggggtcctttttgaagtgaccagggatggatgcaggcagcaaggcatcgttgctttccagatgccacctttactataagaatcgaagtcctttaaagtggactctgagaaacttcacctaaatcatttcccaaggtgacagctctctatgcagttttttctcctaactagaaagcttcctcttgccactgcgctgaaaatgggaaaagtaggtggatggggaggtcttttttaaagcccagatttctggaatttgtggtccttctactttcctgtctccagcagtgaccttctcctcatttattcatgacagaatcatacgtataaaaattcatgtattctggtcaccgttctaaattctggatggtgaaaaaaaatatgcagggcccctccttttatggaactttcattttaggaaggaggaaacagtaagcaagtgaacagataagttagtggtataaaattgtttaagagtgactggatgggaggagggtttactggaagctcagagggttcatggtagcccactctgcagagatgagagttaaacagtgttgtgaatgattgaaaagagccaaccattcacagatctagggaggcatgctcccagaagctgagacagctagagcaaaggcctgaggtgggaaagaacttagcttgctgataaatcagatacagagccaagctgctgttgtattgtaagattatttcagactcgggagtagggatgtgtttgcacttctagctctataggccctcatgagcctgttggacacattgttaaattgatgccaagtagctcaaagcagaacccagtcccttgtccctcatcttctttctgctgacttcataagaacatggttcactttcactgccttcctttgtggacatactcagcctgcgaattaaaaacagaactgattttctcatctcccttggatcctggggaaattaaggcctgcctaggcctcagttctttccctagattgagattaaaatagctttccttgcaatcatccagatgccaatttaataaacattctctggccccttccacatataacccctggactgccttactaatttcttagcattcttctccttttctccacaaatcctccctttaaagagtgtttttttcccatgcctttcttattcttttttgtggaaagcccaaattagtttgtttatttttgcccttaaagtccaccatatccaaatgagaagtacagaagctattaccttaaaagtaagcagtgagaatcctaacatctttttttccatccccacattctcctcaatatgttccctgtcctttgatgcataagagggtgaaaacctcacatgagtattttatgcactaccattttacaagtgtttcagtaaatattacttcatgtaattctcataaaaatcttgggagatcagcaacacaagaactggtaggaaactctgtaagggggaatgtggggatgcgagggaagccagatcatttccaaagtccaaaggtcagatcttcacgttgaaacccagtctgcactgacctttgacctggcatcaccattccatagctatttgttggtgtcagcatcctggatagggggatttttttttttttcaaattgtaattcaaaggctaacagaaaagagaaggtaggcttgagaaagcactagttttcttgggactctgacttattatttggaagaaaattgattgaaagcataggtgattatttgttccttgtatctttcagaaaaaatcaagtgctctatgacattactgagtatatacccaaaggaatataaatcattctgttataaagagacatgcatgcgtatattcattgtggcactattcacaatagtaaagacatggaatcaacccaaatgcccatcaatgatagactggacaaagaaaatgtggtacatatacaccatggaatactatacagacataaaaaggaatgagatcatgtcctttgcagggacgtggaaggagctggaagccattatcctcagcaaaccaacgcaggaacagaaaaccaaataccacatgttcttacttgtaagtgggagctgaacaatgagaacacatgggcacagggaggggaataacaaacagtggggccagtcatggggaggggaggaggagagcatcaggaaaaatagctaatgcatgctgggcttaatacctaggtgatgggttgataggtgcagcaaaccaccatggcacacgttcacctgtgtaacaaacctgcacatcctgcacatgtaccgtggaacttaaaataaaatgacacattactttccccactgtttttttttaagcaaaagtgttctcacacagaacacaggcaagcatgtctaacatgttccattctaagtcttgcccttgcatgtggttgaaaatgactatggactatccacatcacaaattatgggttccagtgtgtatatggacacttctgaattcactcaaaatttttcttactgatccctattgccagatgggggagatcagcttctatattaagcaaggatgtgtccaacttttgaaatggaatgaatagttaaaattgtgcatttctcactctggtggttgcctatagctgtctccgcccccacccccacctctcttccccaccaccttcaccagcagtagaaaagtatgtcatatgtgtgtggggtgggtacagatagagaaacttggcagaaatagggtgagagatgtgactaacaccctcagctaatttctgtgcatgttcccaaacagagatctgcagagaaaggagcaagagttccttgcattctaacccaagccaccccttcacacttccagctttagttcacttctccaccttccatgcatggttgccatctgacctggctactgagaagatcagacctcccagtaggagatccaccacataagctaaaaataagagctgctacttctctgcagataccattaacccaattagataaataaaaaaaaaaaaagaaaaagaaattacagcttcattaagtaacaccagaataaactccaagaaggcaaaccaaatcagttatacaatttaaaactttactcaaaaatcaaaatgatttgaaaccaatggtcacttaaatgaaggcagaagctgcatggcagccattattggagccagcaattcagcagaagtccaaaggtccagtgcagcagtacatgtgacaggtgatgttgcctgcatacacaaaattaaatggaactagttttcgagggtcttcttgtctccatgaaaagagaatgtatccttctgaaagtccttttgtttaaaaatatgatcaggctctgaaagaattttaggtcttgatactaactaacagaagacatgcatttattaaaaattgtatcacaaaggggtgaactggggcctgattgattgatgttgaaatttgatttatccccagtagaaagtgccaggatattaagcctctattactccacaagggataccattttgcctttggtgggtgaggtaaatcttcagattagaaatggtaaagcctcaagacttccaaaaacatacaggctcctattgtatacttgctgaagttcctataattatttacaattccctgcaaagaacattcttgggggtgagtcccagaacagaggtgagcctccagctgcaaaaaccatagcaagtatggcagggagcatctttgattcagaacagaacgccactcatcgttccatcagaacaggggcaggaggttcctgccaatactgattgatgccacgaatcaactggagttgttccatgatccacatggtccttggacttggtgctgtcctggaaactggattcattgctcaaggagctgagataaaagaaagcagcctaaccaatggccagctcaaattaggagctcaaatgaacagggcctcaaggaagtcagcctctgagaatctgagatttccagactctgataatgggaatctcacctatttgtccacttttggggtagatctagacaccgtgatgtgtcagcagcctcttagttgctgagacaattgtcccagagtgcacagactaaatctaaatccctacaatatgttttcaatgaatttatgccacactaattttctaatttgcaatttttaagtcaatatactttattttcttttaaaaatagtgttttatattttcatactataacatatttccatgatattaaaattggcaagtaaagaaaataaaatatgtaaagtcattactgtcatcctcccagaagtgatgtgctaacaattagacatatttcatccccagtttttttctacagacacttttgctttaccatattgtgtacttgggtctattttcaactctgagccacttgctatattgaacagtgtttctacagacaccgtgctgtttcttctttccttctttcactcaacaatcatttactgagcattttgagaagaactgggaggacagcgatagaatgcttttgcattttatctgcagtcaactagttagaaaccagaaacaactatcttgcatctcactatcttgttatttgcacctttaaaatccctttgcagaataggtgcatagtattaatttgataactaaatgaaaacaaaatggagttcatcaaagtggatttgttttgaattggcttggagttactggcagtctatgatgacatacgctactccccaccattgacacatgcattcaaatgcagatgctatattagtctgttctcacactgctaataaagacatatccaaaactcggtaatttataaaggaaagaggtttaattaactcacagttccatgtggctggggaggcctcttaatcatggcagaaggtggaggagaagcaagacatgtcttacatagcagcaggcaagagagcttgtgtaggggaactgctgtttataaaaccatcagatatcttgagacttattcactatcatgagattggtatgggggaaatcactcccacaattaagttatctcaccctgaccccacccttgacatgtaaggattattacaattcaaggtgagatttgggtgaagacacagccaaaccatatcagaggcacacacaattttatgtgtttgtgaagaaaaggcaattgtggaaactttacttaaaaagtgtaatgtcaatctcatgagttgaggacagttaggagaccctgaaatgacacctgtgggcttgcattttattcttggtcactgctaaaccatttttcacttccctctgtttcagtaacctaaaaatctagggttcacaaaacaatgagattaaggaagccaactgataactattgtaataggataggaaatgtttcctgatttgggaaggatgggcaaggaggtggagaatgagcttccaaggcagttttgattttccggaaaaactcatcttaaaactgattatctccccaacatgagacctaccaactgacctgtatcagcctaactgcaatgtatctgtctaaagctgttaaacacagctattttcaaaacatttatccattttcataaaagatttcttaaaattcaagctaggttttcttcctttatttgaaaagggaatatggtaattttaggaatatgattatatatgcatatgtggaagagaagcagaatacttaaaagacaagcatttcctctttttatttgagagagagaaagagagagaaagaaactcctaggcaatcagagcagaacattcctaaccttacatttgatccacccattgagctactgaataaatgcttaatatgtcagtgagcccacaagtttcttgtcctgggccctttaaactgatatatctcaatcacctttactgaaatgttatcctgagaagaccgtaaacccagggctgctcaccactgagtcttcttttatgaaggtttctcaggagaacatacagctaaagatctctaacatttttcctgagtagacctcttttttctcttcatgaggatatcataataaatgactcgttggtaatttatcagagcttgttccttccccaacccattctccttaatgcattttttaaatttatccagtatttgaaatgcagaagtccaggcttggtaggaacccagaagagaagaaggtgaaagaacaaaatgactgtgaagctaagaaatccagatttggaaggagtagcatcctcacagatgctcacagaagtccatatgacactccttgcattgcctggggctttatggaagaagcagggtcacgcaggattagtcattgcccaaagagcgaagagcatggaactcgccaatagcctgcaaactctttccttttggcttttctagcacttactactcttttatgacttttactttacttaattttcttatataccaggaatataaccaaccagggtagttgggggccattgtgtattgagcactgcccaactcaattcacttagcttgcaatgtgaatggcttctctcttctagaggtgctcaaggtgcaacccacataatcacacctgatagccatgttgtcaatgcccaatcacattttaaacacttggagggcagagactatgacatagagaaagatttgaatagctattcacagaattcagttgagctgaaaaagtcagaagaggagactagtttcactgactacaagaaagagtgatttggttttctgagagtgaaatcttcccccacaaacatgtactgtttggcaacatgtttttttaagcctttagaattgtaatgctttttgctgggtcatatgttctcaaattttgcctcaagccccatcattccctgttttattatggtaagcttattcacacatttatatacctgccaggctattgtaggtattttgatatgtggcttggcctttctgggcctcatttaacctctctagactgcagttttctcaactgaaaaaattcccatcatatctgccctgcctatatcatgagactttgtgacgattcaaaggagcaattcaggcacaagctgtgtaaaggttacagaacacaatatagactacattatcattaaactacttgatagtcttatgactatttttatggtaatgaaacgtaatccaatgcaacttcgtatatgtaagtaaaacttcttaattcttgtcttgtaaaactgaatcttcatcctttgactgatcaactgaccagcttaaaccttggagaatcttaaacttctgaacacattttacttctctctttatgttcccctgtggatctcttatgagtatacagagattgagagtccaccatacaggttacctttcactcaagaggttgtggcatcctattcattgtcaactactggactttttcctccccgtcgtggaaaattggtgtcacattgccacatggagcatcccttcttcactcttgacccttccttcatcaatggtggagcatcctcctgaagctggagaagagaaatataaagctatgtgtttcagaatgaaaggaccaatcacaagaaactctcaagccttaaaatacatttagcttttggatataatacatcacatctgtatttgttagtaacatattaaacaaaatgatagataaaatgtagattatataagaacctatgtaattgacatgatttagatactcattcaaagatgagtcatgaaaaaggtacggtattgtcattgcacagtatttcctatccctgtgacatatgaataccaccttcaccgtttttgtagtattcactcatcacttgcactgttatttacttaatagtcttctttaagttgatttattttacttaaatatatttattttgaaagcaaaatatataattctaaagtaaatgaaaagtcggtattacttctcataaataaaaataattgtaaaaataaaagctttaagaacaaattatgttgttatattttagctatgtattatagcctgacaaaagacaagaattagtcctcatttaaaaaaaataaaggagattggcagattttaaaaaggcttttaaagatatataagtgcttattttctctctgaggaaataaagagcaaaagaaaacttaaaagttaataattttgcataagtataatttggaatgattcagtgtattttttcattatgacttcaaatcatttaatgtatcaaaaacatagtcataaacattggggtcatcatctattttgattgtagagattttacttttatacatagatgttttcaacaatataacctaaatttctgggaagttatatcttttacatttattttaaaaatctctctcttccctcacttcttcattgaagtaataagggacttaacttctttaaaccaaagtttccattatagataataaaacaaccatcacaacaagaaactactaaatgattatttattcagatcccagaagaagtgctttacacggatactctacttcaaccctcacaactgctccataaagtaaatgctattagagtaaccgttttacagatgtgaaaaataagtcttagagcaatttcttagtttgctgtgatcacacagctagcatgtcaggcaatctgatctggcacctgcaatcttaacctttcctgaaataatcttattacttaaaaaagtattactaataatgataagaggctatatttcattattttttgaaaagtatgtttatggtctatgtcacaaattaagagtgacaatcagaaactcctgtaccattggaaaatgaaattttacaatttggattgctgttcaggaagcaaggttaaacaaataaacaaaaataaacaatgacaaaagccttttaatgaccattctggatttttttttcattttaaaaatgaatgctcaatgtttcttcctcctagtgtattgctttacttccttaacagaatcctattttattaagaagactgtgaagacaaattttagactgaggttctgagagatgtcttagagccagagaaaaatgaaaaattccagaagtctacagaatccaagtaaagaagactttgtttggaattggcagcaatgacttccactagtagcttaccatgctagtgtaattaatctcactcccatttctacttctttttatggcagaatttcttaacctcagcactgctgacatagtgggtcatatacttcttcattgtgaatggctgtcctctgcatggtagaatgtatagcagcattcttgggctctatccactaaatgcccagagcatcccccaagttgtgacaataaaaggtatttccagactttgtaacattactctggttaaccacagctagagattacctcaacttgtgatacttttctgcttattttggtgttaattggtatctgccattgttgctggtggtcatgttattgttgttgctttgtcctttagtaaaggttccttctctgcttagagacaggacatgcttagaaccctttgggtcttaataaaacctcttttaatattcaaggtatagcagtgagatataaaaatgattgcatattgacatatatctaaatattttcactttgatttcagcattgaatcaacatctctatcagcttgtcttcctggagaaggatattttttggaggttctggtcaagctcagtggttactgaagctgtcgggagtcttaccaccttggggtcactgtggaaaccagaaaataaatggacaaagctgggattgctttttggctagtataatatttccagaatccctgaggcttgcttttaaatcagcataagctggttttgtgtctcacttttgtgttgtacaattacagaaagcagcaaatacttatcttggcatgtcctgtcatgacatgagccaaaagctgtcatcctcatagattccctgtctaagggaatagttgccctatcagcatttgaaagaaacactcctgaaaccttttggagactctaaagttatgtactgtcatttgatggataagtgactcaaaattcatattgatcacatcatttcaaattcttacctgttagactggtgagagaactctaggtactttgttgggaaggatgatggagaagagagaagtgaaaatatgaaggattacttataacaaaagacttgagaaatattttaggcttgagaagcattttataagggaaagatatttgtgatggggactagtaagtaccacttttcacctattgccatttgaaaattgactgtttgcatattgtttttttctgaaatgccgctatgcagtcagggatgagaaggggattgtgattgagtaaagatctttcttagaatcatgtcctcatttgtaaattgtgattttctgtccattaagaagataataatttctttttcctgacatggccttgtatttttaacttcttgctccacccatactcaaatgcaggttgatttattctcctttatgctaggtgacttccccctgtgtatactctctttcagaagtatttctttctatctccctaaaatcaaaaccaatgttcaccttaggttgtgtagaaaagtctctgctaaggcacctcacacctttctaaatcacataagttataacttatttatatatttactttgaagtaccattcctgaatatctaatagtgagattaatgagttggttaatgtggtatcaatttagggcagaaatcattttgaggaactcataaatacctactattatgatgtatgaagcttcaggtttttatggctgccactcaaacaaagaaatattatttggaagatgtgatttgatgttagtatttaatcaaatgtacttatttcacctacttgctgaataagcacccttctttactaccatcactggttttcatattgaggtatgtggatttatcctttatcattgctcacctttgaagatggtggcataattaaagaattacaaggggatttcagaaagttgtagataaattgaactaaaagataaaaatagaaaaaatttatttctcaacataagctccatcgggttcaagacatttttgtaagctatgataccagtgatttagtccatccttaaagaactgaaggtcctgaaaatataaccatactaatgcattctttttgacattattacctgaagaaaactgggtgccctttaaagaggttttaagattaggaaacaaagttaggaggagcaaaatcagggctgcaagatggttgcctaattatttcccatcaaaactctcacaaaattgctcgtgtttgatgagaagaatgagcaggagcactgttgtagtggatgaggactctctggtaaagctctcctgagtggttttgtgtttttgtttgtggtttgcaaaagctttggctttctcaaaatactctcataataagcaggtgttattgttctttggccctccataaagtcaatgagcaaaatgtcttgaacatcccccaaaactgttgccatgacctttgttcttgactaatctgcttttgctttgatttgaccacttctacctcttggtagccattgctttgattgtgctttgtttttagaatcatagtgatgaagccatgtttcatctcctgttacaatttttcaaagacatgcttcaggatgttgatctcacttgtttaaaattttcatttaaagctctggtcttgtcttcagcttatctgagcacagtggtcttgacactgattgagtgaaaagtttgctcaactttaatttttcagtaagcattgttagtgaaccaattgaggtgtctatggcgttggctattgttcatgctgctaattgatagtcctctccaattagggtacaaaaagattatttttttcttcagaaattgagtggatggtctgctgctgtaggtttcattctcaacatcattttatcccttcctaaaaatatccatttttaaactgctgatttattttggccatcgtccccacaaactttttgtaaagcatcagtgattttaccattctctcacccaagcttcaccataaatttcatgtctgtccttgtttcaattttagcagaatttgtattgctctgataggagcacttttaaaacaaatgccttttctcttactccctcaaactagatcatgttcagacatgttataacaagttagtacaagtttattttgctacaaagccaaatagaaatttatgcatttttttcttatatgcgttttccacgaacttttggaagacccctcatatatccatctacatatatggccagtgctaaatctcaatggaaattgaagacacagcattactcattggaatgaaatggcttgcaggaaattcccaaagctggctagaaagagttgaggtaacctcttccctcttcatggttccagtatcacccaaagcttttcctcctcagcactaaatctttgctgcaatactccttcttcagaggtgcttatgaaatggcctcatttcaaagaatgaaagttaggttgtagcaggaattttgaagcccagaactttaacataaatagttgaaaagaagaaaaataaaaactctttatacaaattcttaatcttagtttactctgtgtgttaaattgtcattgccataatgattttagtcctttctctgacctggattctcccactccccagcttttaaatttagtccattctatgtagtgcctcttgtaatttagcacattgtaggtgccccattagttttgttgctttattcacctgcatcctcacacatcgtgtgattgtgcttgcagagcacactgaactacaacacattctctcactctgaaatctgtcaccataaagcataaagcaaaatccttccctcctttactgaatggatggctgggtggatagctgttctttgcacatgttcgtgttgagtaggtgctgtataaaatcacttgttctttttttaacgtgactcacgaaaaaattatcccagctttcagtaatctcaaggaaaaaaaaacacttgccatctgcaatttactgcttttaacctgaaaaataggatctaaaatgatactcagatacttaagaggcttcacgtgttgtaggcagaagctgacagatggcacatggtggtaggctgttgcctcataaggagggaaggcagaagcaagtagacagtggtatggaaagcttcttgggaagaggtcatgacaacgcttcaaccagagataattaattatttgctatattctgtaactagcctgtttatacaaatagctggtgtgctcagtacaacatagcagtgaatctatggaaaaggaatctgtaaataataatgcaagggaacttctcttacgtctattgctaaggggattatcatagcattcaattttaagccatgtaacctggaatgcttactaaatgtgtaattcttgttcttcctcttcatataatgcacagacttgaattcctatattgagagaataacttacctcttttaaataataccataatttgccttgaaggtagggaagaaagagagtgaagtggggaaaatttcaaaattctgtcttccagggagcatattcctactcatctgtgacgtctaatgtaatagattttgaagaattatttgtaagatagatacttggagaagtttatactcacttcctaatcccagactatagaaacttctgcattctagaatttcagagaatgtgtctctgtcaattgtattctgaagataagatacatttgacatttgattgcttcaatcaacattctccaatgcagatcactaggcagaaacatcttgacacggcatatatttgatacacaatgattatttgcattgacttttaacaaagtcccatttagaaagattgaaagaaaaggcaaatgtgattggatgtatgctaaagcgtgttcagtatgtgttttgaaatatctttgaaagttcccaggatgtggcacgtatcattcacttgaagctgaaaatctctcagttgagcaaaaacaagtatttgctttgttccatgatgcactccacgtgtgactaaaatggcaaagtgaagcctctagtttgtagatacttgctttgggagacagggagctgtccgtcgtcctgaacgggtcatgctttaatgaggatagacacagggtgcaaaggaaagtgactgggatcccctgcctgcactgactttaacaataaagatactggaataatgagatcccatggaatttagcaaaatacgagtagaaacaagtggtaaagacagcccagactgtagttcaaagtctaagaacatctaagctgcgggttcaggtataaaattagggccctgtggcttatctcaagacagtaactttcaaaggggggtttgaatagtctttccaactgtagctacattacctgaggcaattagtttacttattttttgtttttgttttttttttttgtggttagcttttctttttttttaatttattattattatactttaagttttagggtacatgtgcacaatgtgcaggttagttacatatgtatacatgtgccatgctggtgcgctgcacccactaactcgtcatctagcattaggtatatctcccaatgctatcccgcccccctcccctcaccccacaacagtccccagagtgtgatgttccccttcctgtgtccatgtgttctcattgttcaattaccacctgtgagtgagaatatgcggtgtttggttttttgttcttgcgatagtttactgagaatgatgatttccagtttcatccatgtccctacaaaggacgtgaactcatcattttttatggctgcatagtattccatggtgtatatgtgcatccatcaaaaagtgggcgaaggacatgaacagacacttctcaaaagaagacatttatgcagccaaaaaacacatgaaaaaatgctcaccatcactggccatcagagaaatgcaagtcaaaaccacaatgagataccatctcacaccagttagaatggcaatcattaaaaagtcaggaaacaacaggtgctggagaagatgtggagaaatagtttacttattttttaaggcaagcaaggtgggcctgattgttacatgaattaccaaatctaatgacaaagccaggtgccctggtactgaggctgtgtctcctctactccccatttcctcccctttccatcactattttctccaccctgcctatcctcatttctctttgctcctcctctttttccttctactctcttctatcctcccattcttttatttctcctctcttacatcccttccactccctttccttctcttcctttttttcttctctctgtctctctgcatgtgtctgaattaactcttgagtcagcatttaaatttggtaattgaatgttatgggtctttatgggcttcactttgggagaactgcttttcaaacagagaacctgataagtggtggaccttagggttactttgacatgtttacaaaaataaacttatcagtagttttagagactgccattggagcaattatagtctatgctcacagaggcttggtaggcttaccacaatccaacctcactctcccatcattgattctctgctctgtgaaacaagtactgtactcttcttcaagcccaggtgaataaggcttttctaggaaattctttgggattataataaaataattccttctatgagaaaggagaaaatggtggcttttggtcttaagtagattatttaccatctctctcaagagagataaaccataattcttaacaaaaccatattctaatgaagtcattggtcacagtgtcttctatcccaagagagatgcaaattactaaattcctgtcctggtacaaatataagaaatccagtcatggcctgacaagtttgaattccttcttgtccttgatatactctgtttacccccattgtaatttatctcttccttattcctccatattatttaatttagtaagcaaatgtcccctggtataagctgtgtgaatattataactgaattactgtctgtttgcttaactcattacagaaaactatgataaggtttttaattacaaaattagccctgccaaatgaatttctttcattcaatgaactgcaaaaggtggtacagtgaggataaaaatcatgtcctttcccatgttatttatagtacttttttctaaaaataattgttataataaaaaataatgccaacaacaacaacaataatattttcttcctcgtctgtttttgtgtgattcctttaaactgttaattcatgctgaacttgttcaaccaagattccataaagtaatcctcttcaacctacattttattctcagccttgtcttgaacatcttactctgacctcactagctcttcacttaccaatttgtttctcatcttctccttaataaccttatgaataagttttctatgtagtcccttgtattgctctttagacctgtcacttatcacttcttcttcttaggatactcttctccactgtaattcttatgtctactctaactatatatctttgaattctttagcatacataaacatatctgataaagcaggatcaagcacaaagatgctgtatcttgcctgcatccaacagactgggattattctgagctctcaagcaaaacatggttaaatcctgacaacaaaatgaagtgacatttatgcttacatatatccttccttgttttctgcattttcatttgaaaagtaaacatctagtccattttgtttatgtgtctaataatcattttattttactttaatttctttggtaaaagctatggactatggccattgcagaattatcataatttccatggagaaacttctgacatattttaccaaatatttttgaaatgctacactcacagttaaacctagagaggattaatttgggaaaagggactactttatgaaaatgtgggaaattatttctattctttcccttttgtcatgcctatttccctaaaattagattatttatactatacaagtaattaaacttatttcaaaatctaaagttaagagaaattaacaggtcattgctcagaaaaatgcatagtaattgtgagttttctaagactgtcacaacatttgaccaacagtctccttactgaaattttatggtttctttctctagacaaggccacatgcatatgaaagcagacttaaaatatttttacctatagctggaaaatcaaatcataaatggcaaactatgtattacttatgttataattttggagctataattttggagctataaatccaggatatcagacttttttcccactaatattgtagtattaataaaaaattctcttaatgtgtttgcaactaaattggcattaatttaatgaattctttctttgaacattcctcatttttagccagcggttggtggttgagttgcaaatggttattgcctagtaagagatggcctatgaagaataatctatttcactggatcccttggttaggaatgtagcatatgcttgcccaggtccacttctaaggaccaggtctgtttctccttgctactgcctgaaatagcataataattaattcaaaagttggctgcttttcactagaagtctttaggacattgtaagacaattaagtctgtagaagaatgagaaggaatcttttatttgaggtctagaggtgtcataactgtgaatcacaaagttgtggcacaatgcattcacctcagaaaattttcttcatgaaattaaagtttcattttgtcttaaagaaaaggttccactctcatgcgattttgtgtgttctcatcaaagcaagaatctaacttcctgatctggttactgggaatctatgcagacacacacaatccaacctctggggcctgttttgcaaacagtctttatgtcatgatttagaatactgcataagaaatttctccttgaagagagatgactgcttttgacagttggcttttcccagtgcagtcattagactgcacatgactgatgtgtgtgcatggacagggaggggtcttcattccctggaactataatgtcaggtttcatattgtctgagatcagcatctcttcagaaacaaccatgtactcctttctccccaaaccaccttccctcctgaccataactggttatataatcttgcatcttctattaccctgactgctgatccgtgcctgatggctatgccaggtctcacaacaccacgagcttttgattgctgcactctaagctgcttaataagacaattaaaaatgatttacaaatggccatcacaatgcaactggggatcaggaagagaatgttctatttgctccaatattaaaaacgcatgcccttctacagttccttctgcagctgcctttgatttcagtactggtttactccctttttagaaattatttttttgatgaatatcatgttaaaatagttcctcctaaataatgtatagctggaaataattcaagggatgtgttacacatgctaggtggtctgaaatcttcttccctttggtggggtaaacactgcctagaattctggagtagttaaaaagtagtacaaatgatctttcatcatgccggctccttctcagtttgagggtcaaacctaatttaatcactgacacatccatcttgagcatttcctctttcctcctattgttgcattgattaaaatgggcaaatctcccaaagattccattgtgagtcacacaaacgttcatctataaaaagtggaaatttatcagaaatgatgaccttgatattttgaatgtaataactgagaaattcaagtagaatctcatctagtatgtgttgaaaatgctcattttttgtttaattttgtttagtttttttttcttgtccagaggaatgaaaattgatattggcccaaatattaagaagattctctatttttagtgctgagacccaaggattagtaagatgggcattggcagggttaccataacttttcttaggaaggatgtgtggaatagattttttaaaaagaaccatctttgaagccagatatccctgtattttattcttgcctttgttacttagtaaagtgtaggactttgagcaagatgctacatctatctgagattccattttctcatctgcaaagtgaatacactaatcttaacattcagatttgctatgagaattgcatatggttatctttgtaaataaagtgcctggcacacagtaggtgctcagaaaacattgatttcttttaatcctctcattcaagagcacagatgataaaatatttatcactgttagtggtgttatccctggtatatcctggcaaatgcagtgagatactaagaagtttgatgctgaaattactttttcagcactagattattacatttttatgacaatttgaaaattaacctatcctatgtgtatcaatagcccagttttgtgctattttcaagtaatatgaatgttacagtgatggtggccacatgatatgttatgaaggaattttatttacatcaaacttcccacaatagcctgtttattgaattatccctgaaataaaaccaataaacctgtctttggaaaccagtgaccactgacccacttacatgttatggatggtttcttttctgattgccagttagtgtgattggggtaaggaggaggtaactagtgtgactttcttcagggctccccttatactctatgtgtcttctctccctagctgtctaaagttctcttcaccttgaagagcctcccatatttaacagtttatgatggatgaccagcccacattagggcactgttcaaatttcagatactcaggaaggccaatcctcagagtgtttctgatcaaaacattctttcttatctgttctgcttttttaaaattgcttttacttttcttcctttttttgttattcctaccaggttttgttgttattttttttcttcaatgatgtctaattgcaggttaccatttcatctgctactttattttttatgcctcaacatttggtcttctcacctctggttcacttctcatgggattttcttcacctaaagttacaacttattcttccttgtcagtcccacctctctggagctgccaaaagctccctcttgcccctacctgcttcagccagcattatctgcagatatatcaggtaccatctgggtcctacccttctcatatagatccaccccaaatctacctgccttttcttttctttctttctttccttgttttttttttttttttaccttcaggacttatgattctcagagaaaagagatggagaaaccagcccataacttatctatctgagctgaaacagaatcaatgacaatagtggcataagtatccaatgattttgagctaggccttgtgagtctctgactgtaaggtcaccctccttatctcaccagtgtgctgagccttacccaatcctcagcatatcacacccatgtactgagtcactctgcatcaatcccacgttggggaagagagcaaatctattggcaggggataatacaggatggaattagcacaaaggctcttctagtactacaaaatggctttcttgccatctacttgacccagcaaaactgttgtgtgataatatttaccttaaagttggttgttagagggagatagttgatattcacatattagatctcaatagaaaaaatagatagtataggggaatattttttactccataccaaacttaataatttaccattttctatgaaagtgtcttacattctacttctgtattttaataacatgttaaaattatgataattatatgatgtttttaaattttttaggtgcttttctttttctaccatgacaatgctaagtttctcttcctgattattcttgataatattctcccccacaaggccaatgttatctcctgtttcttccctccactctacctaggctggtttcctccctgttgactgtcctatcatgcgtgttcatctttgtattcttcttgaagcctgtgatgactttcactacattctctaccttcgcaaatgcagcatttccttcaaaagtcagttccaagtctttcctggacacaaaaatcaccacttatgtttctgtatgtgaaatttatcatgaaatgtaatacctaaatttatagtatgtggtatcgtttcctgtgctactaagtgcattactttgcctccttcattagagtacaaattcctccaagttaagggaacatggagactatgggcacttctctgattcatgtgatgttctcacaatattgaacatagcacatgaaagaatatgtgattatcagttggttagtggctggcttgctttggatagtcattcattcattccttaataatggttttctagactgtgggttacagatgctcccttccatcctcagtcacccttgaaaatatgttgaattacatcttacactttgccttagattagcgtttgttactatgaaagaaagaaagattttctgcctttcacagcctggatcctactcactgagactataggctgtcagaatgctacatgctcccagccctttaactcttttcactctgctatggccacaactggaatacaccttttcctcaattacaaaagccacacaagattctacctgcagcctcagtacacttcaacaattctcttattagtccttttgtaaacttactacctaagattttgcagtccctttgatgtctatatatcttgccaatctatcacttgaaggtgcctgttttactccaatgacaaaaaaaatccaatctaatattttttcaccttttctttctctgcctcagagttgataatacttacctttgtcactttcgtctcacctaggtccaggcatgagcatagccctgcttcatttcaacttagcctatctttatggccttcaggtctcctctcatctggaattgagttctgtagattttgtcctgtatgcccataatccactaaatagtgttcccattgttttcaaatataattcacaggggtaaagatagaaaatgtattttttagggctttttctaacaattatattttccatggaatgctgaagtcccacaaggaattctgaggcccaggtaaggaagaagaattagggaagacacaccagtgggaggttgcctagggcacaccaaaccattgcaaaagtatagtaaatccaggccaatccacaggtgagattgagactacagaatacattgttctttggttagaattggcttaacaacaagtcaatgacctaagctagggtaggcataagctggcgtgtcttatctcttatgcaaaattgtaagttctccgagaatagtcttccacacttagcatattacttctattacacattttaaaagataattttgattgtatgggttaagttaaatgtactccatgctcaacgttaattgatgaacacatatctattaagcactattgtggaaaatctatttggtgaggatacacaggaactccaaggaagggtaagacctttattctgcattctaggagtctgtaacatagctgaggagaagaaacacccagtaaaaatgtgtcactgaaacttaaacaaattatttaacttccttaaaaagtagtttttaatatgaaaaatgggagattaaagttggtcttctaggttccttagaattctagaactccaagtaaactagatatacatgtgtccatacttatgtcagatgggtgctatccacagtaggtgctacagttatgcagaaaataaagagatatctggaaactggggtagatatacattcatggaggtgttggagtttgaactgagccttaaaggaatagtcttggaaggaaaaattattatccatcactgaataacgtgggcaaaagtacagggaaaatacatctctacttttttttgttgttgttggggcaggcttcagccaaaagagcatttggaattgtctcgacttttccctgctctagacttctcctgtctctgcacatttgtttctgcattttcagaatctagctattttagtgtaccaaatctcttaaaaggacctgtattcattgtgatacaacccctataggaacttgagataatcagaatttcaagagaaaattatagtttcttggtgcctgaactgacccaacctcatgggtttaggatactaatcagtggttccctggatcagttatctgatcctgtcaccaatcaaggacaggactgtcacgtctcaaaatactactttttcaaggggaagaatatttctcctttagtatgtctcagcggaggtggaaaatgcaaataacctttttaggagccctttaaacacatagactcctcacttagggcccaattagtaggaacaaccaacctactctacaaggttttactcttcccttgaaattacacttcaaaaaaacatgcactgactccccccaggcatagaagcaggatccgtgttttaattctaaccttaattaaatctttacacaaactcactatttggctgtccaatgaagaagggcaagtagaaggaaggaagtgaagagcatttgctcttcctctgtcttccgtgagggttatatacccaaaactctctgtcttaatttggaatagggggaattagattttgtcataaagtcataagagttgtgttataagagtacgtgtatacagtagttgaaatgagtgcccagaaatcttcctagtttcttccccacctgtcatggagtttcattgtattaccttgcacttaacaaagccaaatcattgaaagatacagtccctccatgaacaacaatcaattctgtaactgatccttacccatctatttcaataccatgcataatgacactatcctttggaatgcagggaaaaaaattccaaatgacaatttgtcttaaatgtagacagtgctttaaaatatatgcctgatcataagagtggatatagtatttaagtgtgtcagaactttcttgctcttctaccttcctcctttttggttattgttgaaaatatatggggaaaaaatggcaaaagaaataggccctacatctgaattttaagttcctgttttttgagagaaagaaatattttgtttattttatttgttttttttttctttcccattagtaaaataattccaactaaggtaaagtttagtggaactaaacttttactgtgtgcaactctgactttcaagagtaaaaggaaagtaaatgtaataccccagtacacctaaaaccaggattaatgttttactttatcttgcaacagtactaaaattaaaagcaaaacaagacacattttagatatgatacagtgagcactagagaaaacctcttttattgatgggagcatattttaaaatatcttctcacctttagtctttgggttagtctcagtccctctgcatagggagcaaacaatacatgaagaactatttgggggaaattgctataaagaaacaataacttgctagggaaaaaaaaaacaattaactgtgaagcatgtatccctgaatctgaatcatggccataatacttattagtcccccaaatttgagcttccattgccttacttgtagaatggagaaaaaaaattcctcttgaggtgtcagtaaaagaagatgaatgtatccctcatgtttattctgatcagattatttttattttttgccttatggcatttacctttaacaattttgaatatctctgaaagaaagggagaaaggatggaaggtacgaaggagggtgaaaaggaaggaaggaaggaaaggtctttgttttccttacctggcacagctaaatattggcaaatcacaatagatagcaaaaatctaaaatacctaggagtacatttaacaagaatttatatttttaaactataaaaatgaataaatactatctaaatcaaagactatggttttgagtggtgacaatttaatatcaaagtaattccccactacatttctaagtaaaatctccctctggtgtctttttcttaatttcccagtgttcttaaaattcctatggaagaataaatatctgaggatagccaaggaaaatataagtaagaagactttgagtaagaactatgctttataattctaatataaaaccattgtaataaaaaataatgtatgaacctggcatgaaaagtgggcaaatagattaaaggacaagaattgtagctcagaaattttccccagcatacatggaaatttaatcacttccaaagctgttatcacaatttagtggagagatggaaagtgtttttttggcaaatggtagaaagataaccaaccatccatatagaagaaaataatgttggtgcctatctcacatcataaacagaaataaattccaagtgaattgaagacttaaagtttaaaaaattattaaaaatattggaagaaaatttggactagagatacaatctagtgattggttgaaacattgctaaccaaaacaagaatcctatatgctataatcttaagagaaaaaaggtcaacatataaaaagtttaagagaaatttaggccaggcacggtggctcaatcctgtaatctcagcactttgtaaggccaatgtgggaggatcacttgagcccaggagttggagaccagcctgggcgacatgatgagaccctatctttacacaggcacacacgcacatagctgggcatggtagtgtgtgcctgtagtctcagctattcagaagactgaggtaggagggctgcttgagccaggaggtaaaggctacagtgggccgtgttcatgcccctgcactccagcctaggtgacagagcaagaccttgtctcaaaaaaaaaaaaaaaaaaaaaaattacaataaaagatatcattgccaaattcaatatgtaaattatatatttggaaatgtaataaaatgtgtccatgagaattacaagtagttataaccaaaaacccaagtaactgtggcttggacaaattaggtgtcttaatttttgacatgtaataagaagttggaaggtaggcaatccagacctcatacaatgactccatgtggtaatcacaaactgagctcattctacctgtctccttagctgtcctgactatataggctttcatcctcatatttgtcacttcatgttcactgaatggcttctccaccttaaggcaggaaataaaagaaaacaggaaggtgaaagcaaaaaatgtatatgtgggctaagtttgtatcttttaaaagaagagacccagaagtctcttctagtaaattatggttatatatctttatccataaatgtgtctatcccagttgcaaggacaactggttaatatgatttgttttgtaattgtttttgtttctctaatctgggcatatttgcaactttagcattagagttattttactatggggagaagggcaatattaattccagaaaggtggctagcagtgcctgccacacaaatgaaggtagcgttaatgtctagactctacctaaaatttttgcaaattgataactgaggaaaacaacccaatagaaaaattggtgataaatatgaataaacaattcacagaagaaaaaattcagattatccttaaaccaatgaaaagatgcccaacctccttcatcgtcagacaatttcaaatttaagtaacaatgagatgttttgtattcatatgattggcatgaatttaaaagtgtggtaactcctattgccgtttgagatgtagaaaaattttaaattgttacagcttttttttaaaaaagattaacttttgaatggcagtttctattgaaagttttatatatatatatatatacacacacatatatatgctttgatcagaaatcctaattatgagactctcatagaaataaaaataccagtatctagctatacatacccaatattgcatcatattttgcggtggtttaaaaaaaaaaaaagaggaaagattaagtaaatgttcactaatagaaaaatggaattaagtaaattatagtaaatccctatcagggactattatgcagtcattttgcagaatggacttgatctgtcttcatctaaagcagatgacttagaaatatttccacaatgtattgttaagtgaggaaatgagatagtaatggagaaagataagaatgatgcaggttattaatctgggtggccagcgcttggagagaggaaggggagcaataggggaatatggaatggggaaagcaaaagaaatcaaattttagatatgtacacaagtaaaataacttagaattcagatttcctttttttttttttttttctgaggcggagtctctctctgttgcccaggctggagtgcagtggtgccatctcggctcactgcaagctccgtctcccgggttcacgccattctcctgcctcagcctcccgagtagctgggactacaggcgcccaccaccatatgcggctaattttttgtatttgtactagagacagggtttcactgtgttagccaggatgctctcgatctcctgacctcgtgatccgcctgcctcggcctcccaaagtgctgggattacaggcatgagccaccgtgcccagcccagatttcttttttaaaagacctgaaataaggaagagaaatcatagcataaactaagtttaacaagatcagtgtgggataaagaacagaagattgagaatttttttggagctgttcctgattagatgttagaagattttggttatcaccaatccttttcagagaaaaattttataaacttacaagtatccattgcacgtgctttacatttgttttatatcaatatgactgtaaactttatagagatctttttaatacatgaataggacatcttatttttaaggcaggtaaatgtgctttttctcacttcaaacaaattatgtccacaagctgaataatgagaagggtacttcatagtgtatcacactgccgaattacacgttcactgttttcatccttgaaaaccgtgggctgcttcagagtgggaaacagtcttcactgcttataactgagttccagaattttcccagccatctgattcccaagcccagagcttcggcttctgggttctgttgctggcagtgaggaagtgggatagcacattgtttaaatcacagcacttctctgtttcctggctaagttacaaaacagtgttgtagtcgtgaaactgaatatcatcagcacacatttgtggcatgcacagagcatgcacgactctgtagtagcgctctaggcaagcttatgatggcttttaaaagaggtgttgttgcttcctttaggaagtttatgaactaaaggaagacaaaaaccaaaccaaaccaaacagaaagcaatgcattggactttccatcacagcaattacatgtctgattctgggctttgtgcctattaatactcagtaatatccattgaatatgtgaacgaaccaaccacgttaacaggaactgtactgttatagcaattcttaactggaagttttgtcttctgcctcactccactagaatctatctccatccagttgaatgcaaatctgataatatttttttcctatggtttccagatagctttaggaatcagaaagaggcactgattgtaaacctgaaagtgtgctttgtggagcctgcatgatgttttaaataattgaattagaatgccttttaatgagcggcacactctctagttttcccacagaaaacctctagcctatggtgttgaataggtgatcccccagctacaggataaaatcccaactcctcagtgatgtacagactcttcccactttatcccttgcttattatttcagtcttgagtcccaccattttgctatatgcaaccggcactctagccatgctggattgtttgctgtttcctgaatatgctgtgctcgttcagtcctctgcaaatgtacttatgctacttctttctcctgaattgcttattctgtctcattaacctagtgtactccctcctacccattcatgttcaattaaaatattactgccctcataatatcatttttaactgacctagaaaaacaagttagatattcacatcttcaatattccatctatttatcaattgttgcactttttatattgatacttatctgactcttcacccatcagaaagatggagttctctctttgtacaccttgcacctatcactggcttcatcacaggatccctatcacagtctttttgatgaagcattgttggatggatagatggatgcatggactaggtgataaatgaatgatgaaccattaagtgaaataaggagtgtggtatagacttggaaaagaaaagttactgttgaaatagctctagagaaaaatattttttaagagttgtataggataagatgaaggtgaggatgacttatctataattttatctttggaaattgtgagttaacatttgtaaacagggtggatattttggagagaaggtgctacataactacagcacaattatttattatcctctaaaatagtccctttctttggcatgtttaaaacctaaagtctggttggcgttataaatatgcatgagctgttgggggaagagagcataaagtgtgaatcacacttcaaacagacccacccgctcactcccgacttcaagtttttcagaagtgtgaaatgaaaatgctttaaaattagaaaatgtgccatcagaacttttatcagccctcggagaaaataaataatctctaaatgtggggaatgctggggatatttatttagttagtttcacagctaagatgctttgataaatttttgtgtcataaaatgcacaaattaattttaatgaatgtggaaacaaataacttctaaaacagcctgagtacccaaggctgcaatctagggtttctgagggattattgaaacctaatctatggacaaattgtctcaatggggaaaagaaactcttacaggtgtctttccctctgatacatttgcatttgaagggtgatcttgtagcatttgaggagtgggtgaatttctggaaagagacacttggatcttaaattgctaaatggtaacgaaaatgagagaaaatagtacagttagctgtttgctttcgagtttgtggaaagtgattttctaatcaatgttactcttgatttcttaagcataacaagattaaaatgagtgtgaatataaaagatcatgataaaagataaaggatgatgacctgagatcttctttattttttattactaatttgtttgaagaatagtccatcatttccagtaactttttgaccaaaaaaatggctatgtggttgttgccatcaaggccagtaatagagaagagggacaaagagagaggtgctccattggtatcctcaacctgtgtgtagtacataggcatcactgggtgggctggagctagcccagatggctgggctccacccaggtttcctgatgcagtatgcctggggttgggcagcctgagttgcatttgtcataccctcccaggtgatactgatgcacactttgagaaacactgctctgttccaatacttacatgcaatttttttaaaaaaattatgtaatgaccatctgtggttaaatgctgagctcattttataaaccttaagcgtcttggcaagtgtctctgtcttttttttaattgtctgataatttaaaataccattttattagcctactattgtggaagttgaaactctattatattcactctgttattgttaaccacctcacattttctgtggtatcgtagaacagaaattgttctaaaggaatggaaaaacaacatttactttcatcaaattgttgtctagcctcttgattgagttatagctattgttactaatttattgctagtttttacaacatgcccatgatttttttctgtttcagactgaaagtaaatctgaatagatgaaatctaatttaagtacatgctgttaggttctgtgttttgggggatagattaaaaatacaagagaaagcacaagacaacatgatctctcacatgtatacatatgttcaactgcatgtcttttgttgataatctccaaaacatacatattttgacttcagtaccataccagatactggaaaccaagtgataagatgactttactctgggatgtgaatgtcattgagtcagcagctttctaccaaatcattaatctctgcccaggtccaaattgcttcagtgattttcctaccactcagcattttccttggtgaaggacccttccaatacaagtcttctggcttttctttctactagagggaaggctttctctcagcagctatttctaaaatgaggctgatgatgagagtgatagatgaaaaaactcatctctgaggtttgtcttcttcttgcatctgctgatagcactcacttctcagctcctctttatacctaaaagatgtgcttctctattatttcaataattctgatgctgctcattctttacttattttcagagatgtttatgagatttcaagctccttaactagacatatacaaagagcaagaaaacaacaacaacaaaaaattctccctggtcttttctggaactaacaatagaatacttgaccaagaaccaagattgcagactatctcagtgttagtggaaccatttcacttctcgatgttttcttataaaacacacagtttgagctgtattgttaatctacttggaaagatattatcattttttaaaacaaatatctgctgggtgagtgttaggcaatggctctcaaagtgtagtcccaggaccagcagcattagcaaattcccagttcccacctcaaacctgctgagtctgaaactctaggggaggaacccagcaatttgcgtttcaacaagccctcccagatgattctgatgttatagcaattcttaacttgcttaagaatttggaaagtcttacaaataagggcaggactgggtggagaaaatggagaggtctgattatctttcatgtaatccccacataatttggtgtctgcaggagacacttttatttgtttgctataaataactgggagcttgccagtggtgaagaagatatccagagaacattgtgaatatatacttagtttctccaacctggacagaccaggagcctttatgtcaagatcctgcacggataattcccctcaggtggagagctggtggtttttccaagcacccagccacaactgccactgcattctatttctttaatgctcaatcagtgcccctggccatttgatgatcattcctccctaatgttgtgaggtatttagtccaaatagtacaatccatgtttgctttctttctcttctagtaaaatgtataggttgctgtaatagcctgtgtctgccccagaccacaatcataaaaataataataaattacctcgctgtctctgggttttctttcaggctcaacatgtggtttgtggcttatggggtattgattgtgcattatcagtttagctcacacactgacaattacatgtagcgccaaggtagccgtgacaatgtagtccagttgccatagcaatgaaagaaggcctattgctgctacctgcaacctgctttatagtgataaacgtgctgcttatttcattttaattgaaatttgaaatcatagtctctagcaagaaataaatggactcattccccatttttcccccttggccacacaaaaacaagtattagtaggaaatatctgagcatttttaaaaagtaaatatcaaatttttgacagtatgttttccagtagtttcactggtactagaaacagatgaagagtgatactttgctgaataaaaattgaattagctctcatgtttttgcattcttaattaactgctattttttatttccctaagtccctcatcttaacagcttaccctgcatggtgtactttatataacagagactttaatggatttacttgctgagtttagttcatatctaaaaactcacagcagatatcataaggtacttgaaaattagaatcacagggcgctgtggaagcttttacataattgaaaaaattgataataataataaatatttagccatgtacggtttcacttctatgccagtgcctcatctatgcctcagacctaataatctttatgtgacgtcattactacgtactacagtcatatacaatctatagtgctatatgtagccaagagagagagatactgtgaaatatggtcaggaatgaagagattctatgtcagtcagtccaaaaaagatagaaatttagtacagaaaaccaaccaactatggaaatgaatagtaagatagtaactaaatatgtatagatgtgtgtatatgtatgtgtctgtgtgcatatatatatatatatatatatatatgcacacacacataggcatgaagtgccaaactatttttaaaagtatgaacttggtctataaagattctaaataggtcagtggaagactgggtcaaatctgagattccactttgaccttttgatctttatctgaaagaagtcagatgatttcccttttctggtacaagcctgtaagttagcacaacattttatttccctggactatgtgaagtatatagtagatatttaggacagagagaaacctatggtggggagtaaaatttaactagggtaatataaaatataggatctccccttaaagagcttatgatgacatgtggctgggcacggtggctcacgcctgtaatcccagcactttgggaggccaaggcaggcggatcgcttgaagacaggagttcaagacaagcctggccaacatgatgaaaacccgtctctactaaaaacacaaaaattagccgggcggatgagggttcctataatcccagctacttgggaggctgaaacacgagaatcgcttgaacccaggaggcggaggatgcaatcagccaagatcgcgtcactgcattccagtcctgggcaacagagtgtgaccctgtctcaaaaaaaaaaaaaaaaaaaatcttatgataacatgaaaacttatttttttataaagtgacctcagaaaatgtgcacagggtggggcatctcatgtgaaaagcatctcaatcattgattccagccacatgccatcataagcgctttaaggagagatcctatattttatattaccctcattaaatcttactccccaccataggtttctctctgtcctaaatatctgcttttagaaggagtaaacatgacttgggaattagatggctcccatctgtgaaaatggattcttaccagtggtgttttttgggtggttgggttataataaaaaggaaaatattatttcccttatattttagtctttcttcttactcctagttataatcatggtcctccaaataattatgatgataataaaatgatcaatatcatgtttaatttattttatgtccttattaatacttactgagtacctagcatgtgtgaagacgatattctaagtcagcagtccccaaccttttggcaccagggaccagtttcaccgaagataatttttccatggactggggttgggggatggtttggggatgattcaagtacattacatttattgtgtaatttatttctattattactatactgtaattatataatgaaataattatacaactcaccataatgttgaatgagtcggagccctgagcttgttttcctgcaactagatagtcccatatggtggtgatgacagacagtgacagatcatcaggtattaggttctcatgaggaacgtgcaacctagatccctagtatgcacagttcacaatagggttcacgcttctgtgagaatctaatgctgccactgatctgacaggaggcagagctcaggcagtaatgcgaggagtggggagcggctgtaaatacagatgaagctttgcttgctcacctgctgctcacctcctgctgtgtggccccagtttctaacgggccacagaccagtactggcctttggccacgggtttggagaccccttttctaagtgttaagacaagacttggaccttcatggaacctatattctagtaggattaagacaggcattaaacaagtaattacacaataaattacttaagttcaattataatgaaaaatactagattctacaagaaattataaaatctactataaaattctttagtgttgttagcagataatttactcaccatttaaaaattatatcattgattaaatcaattttaaaatgggaagtgactttgagaaacagacttactacaaacagacacataaagaaaaatctggtacatgttaaagagaaatattgctataaaatcagaatacattatatgaagtctacatttgaattatgccatgtgtcaagtttgttaagcatataggtaagatgtaattattattttgctcttgatctacttttattttttatacccttaattctaaacctttggattgtattgaactttaaaatacatatatttgattcatttaattttaaataattgaaattattatcaaaacctcattgctctgcttgaagcagtagctctacttccctatacttcagtttttcatgtgttatagcaagatctgtactagaattagccagttcaacccaaccacatctttctgtttcgtccttgccttgactgttaattagctcagtggatttttatgtcatgaatgcatttgttttctaatacatcttcattttaatgtaagatggttgaaaagaaggaccaagtcctctgagaaccccatagtacaaagtaaaatgcctcacatctgacaaatgctcagtaaacatgagtagtgggaaatcttgattatatgctcattaaaaatatatctatgtatttaaagtagtaagtctggtgttcaaaaggtaaaaccttcaaaattctaacacagttcttgtttggattaactctagtctataatcacaactcttctgtttccttgtctgcactgtgctcacataatggctatgtctcttaccgccaaagcccggctcactgcttacaacggcatcctgtttcttcacctgtttttcttttgcttacctgacaagctcttgcattcataaaagtcgaaaggattccagcttaacgtttcaatcccacaaagttgacttccatagcgtagcctggaacaccttgtctgtgaatagatatggaatcctcaaatggttttgaagccactaccagcaacaggtctgagatcataggacccaagaagaaaattgaggctggggaaccacagagagtctttccacaattcaaagtaataacaaagcagccacaacagcagaggtggggagagatgtaggcatcagattgcctagagctctaacaacctaccctccacatagaagctgctctctgcttcaggcttcagatccttaaatatgggtggggtccttcatttagtgtcaaagaattgattagaaagctcctgcaatgtaagctcattaatgaaaccattttggcaggccagatgatataattagcccaaacaagatatgaaatctacagtgttttgggcaactgttcagtaatttttaattttgtaataaaaaagacaaggaaaggaaacagcaagagaagatgattcatgcttattggtgaaaaagaataagatataaagaaaaagattccaagataacatttgctagatgtggatagtaccttcaggtttccatcatccttctgaagacagtagcatttacaaaaactgtatcatctctacctttacaaaagtaggtgctatgtcaatagtgtgtttataggatgcatggatattcttcaaaccaaagtataatcacaaattctggtctcgtcacagacattcatttaaggaacatctccctcccctgcccccatgctaacctgagctttctggaggatgataaaggcgacctgaataatgaagtacccaagtctcactactgaggcgagtcaggggtaaagagtttagcactgagtggctgaggatacgtatcaagggaaaatgtcatccttgggacttctctttaaataccagaatatgttttgttttgttttgatttgttttcctatcagggatgtgtctttattggcaatccctaatggaaattgctctctaattttcctctagtcttcttatttgtattgtttgtatatgaaaagatgagatgaatagttaagggtactgcacaaatactttgcttggtcctataggctctcaggtttttttgatatcatgtggcatttgtgtcaaattgagttgtgctgtaattttattaacaagcttcacatctcagaatattttacagagatgcacctaacacagttgacatgttgtctattaaaagttacatcatcttaagaagttattagtccttttaaacatcattttcattctaataagctattttttatttctaataagctatttcttatttctaataaactattttttatttctaataagctcgtgtcttgagcagaaacactaatacccaggaaattttctgaggactggctcacttaaaatgaagggaagtcactccacgctctgagttgtcttctctcatcttcttcatgtgaaatcctggacacttgcagattcatgacaattcagagattattaatccaattgcttttaataaagactgtcctgaaagatacacatggtgaaacattctaattgtaaaagattcatagagcaaacaattctgtaacatctatttccatatgatttgagcaatttcacacttgggaatttttttttttttttttagatggagtcttgcactgttgcccaggctggagtgcagtggcacaatcttggctcactgcaagctccagctcctgggttcacgccattctcctgcctcagcctcccgagtagctgggactacaggcgcccgccaccacgcccggctaattttttgtatttttagtagagacagggtttcaccatgttagccaggatggtctcgatctcctgacctcgtgatccgcccaccttggcctcccaaaatgctgggattacaggcgtgagccaccaccgtacccggcccatacttgggaatttttactacagctgactgaaattttttatttgaatcctattttatatatgaggatactatttcttctttacagcattaaattttctagattaaaaaatactcatttccccccaagattttataaaataatttctggcacttctctaggttttctagctgtatgctattttgagatgacttggagtcaaactgtctgggttgaatcaaggctgtccccaccagttactgtctgtctgaccttgagaagttatttaacctctcagtgtggagatgttcatggtacatatctcatagggtttctgagtggataaaatgttctgatacatgcaaaatagttagaatagtatttgcctggcataccttaagcactcagtaaattatagccattctattttattccattccatgttaatggttcaacatgaaatagaattgcatccaaacaaatcgtgacgtcaagggtgttacctgaaaaaaaaaggtgtttcttacttaaatatattaagtaaatatagggttgtgtacaaattttaaaattttgctttactgtgggacttttagaccttttcatatataaatatgtattgtgtatatccaacgtggctaacatgccatgtctctctcttttttatgaatcacccactaacatctccagtgaatcaaatttggaaacaatgggcagtcacaataagatacatgtctgaaaacccaaagttgattttttcatgctttcagtaattacattgaagttgtcccaaaggcagaagaaagaaaaagaaatcaagtctccaaaatttctctatcctttagaaagaaactccaccttaatttttggtgaggagtaacagatctcacttgggtggtagttacattttgtgatgtgagggtgtcagctttttctccaaggatgacctcccaagaagggcagggtcactcacttctgctacacttcccagctgtctcttttggctttgcacattcctgtctcatgactctacagggaaatccatgatgtagattttcctgtattcaagcaggcaaagatacgggtcaaacatttaaggccgttaacaagaagttaaatcagcaacaacatttatatagaggcattaattcagggtgaacgcaaaatgtgttgcagcatcgattctggcatttttctctgctcctaatagctctgagcatttgatctatatgttatatggacctaaatgaagggaaataaacatctggacagattccttccaatcgagtttccttcttaccatttttctgctgtgatagttaaccaaggccatgggcttcgttcacctagaaccagcctaaaattaaggatgctggccagagtacccaagtgtgatgcttgtagcatttaagcatacagataaattctttttgaaaaatttcaaacaagtgtaccatgagcggagtcagagcccctcttgaaagcaggttggtaaatttccagaaccacttagcagttttcataggtggcaaggcattgtattgttatttttattattgttaggagctaacatttgtttccaggaactgggctaaatggttcaaattcattatctcatttaatctttacaatatttctgtgaggtagaaagtattgttatctccattttagagatagcagttatagaagaggcatctggagctaaaacagattaaatgaccttttccctcaggttcagagtaagtgtcatattgcaccccagaataattctgtgctcaccataatgatttacccttctaaaaggtaatataatgcaatttcagaaattaatgattcttaaaaatgtgtaagcatgcagtgagccgagattgcgccactgcactccagcctgggcgacagagcgagactccgtctcaaaaaaaaaaaaaaaaaaaaaaaaaaatgtgtaagcataagaaaaaatagcgaatgtccttttctagcatcacactagattttacgggtgattacaggaagacccttttgagattttcagcaatggacttttcttggatgagacggaagatgctctcagctggtgtgactaaattgtttgcgacttgaggacatgggtcatgccctctgtgtgtaccactcactatatcctcatcacagttcctgcataaagcagagattcagaagggtcagtcgagaacatggatgacaacccaacactgtaacccagcagcttgtgtcttggtgtaacattggtaggttttgtttgcctttacatttttaccataagaggtcaactagagtttctatcttgttacaagttcattacacaggtatcccttattccttcattcaacattgcaaagaaaacatctgtaacatgctttgagtcattaagagacattgcatacagtcaaaaaatagcatgaatttattaaattcagtactttggctgataaattgagaggaaacctttattgcaatttggtggtgatagtggagagtctctttccaaatataagacctagcattaagaagtatttccaagtctcctattttaggaatctcaaatctctaaattcgagatatgtggaaaaaataggcaattttcaagaaaatttgtgttgctgctagccctttggcttgtacaatacatatttttttttttagaatatactggaaagatgaaatctctaataggtatctttctggagaacagtctttatagcaaggttttctttacacagagcaaccatgcacatgtagttaatggatctccagacaaaggccatttcttccctaaaacaaagccaacaaggcaattgagccaagtaacttcaaactccccagaggggacagcagccattcttaaatccaccatacttttgaatagctatcattggtcattatcttccaaatggctttgtaagtgtctaggcataatgtgattgctttggaaattctccatttttcagggtgctgggaaggacatgaacagacacttctcaaaagaagacatttatgcagccaaaaaacacatgaaaaagtgctcaccatcactggccatcagagaaatgcaaatcaaaaccacaatgagataccatctcacaccagttagaatggcaatcattaaaaagtcaggaaacaacaggtgatggagaggatgtggagaaataggaacacttttacactgtcggtgggactgtaaactagttcaacccttgtggaagtcagtgtggcgattcttcagggatctagaactagaaataccatttgacccagccatcccattactgggtatatacccaaaggactataaatcacgctgctataaagacacacgcacacatatgtttattgcggcactattcacaatagcaaagacttggaaccaacccaaatgtccaacaatgatagactggattaagaaaatgtggcacatatacaccatggaatactatgcagccataaaaaatgatgagttcacgtcctttgtagggacatggatgaaactggaaatcatcattctcagtaaactatcacaagaacaaaaaaccaaacaccatgtattctcactcataggtggtaattgaacaatgagaacacatgaacacaggaaggggaacatcacactctggggactgttgtggggtggggggaggggggagggatagctttaggagatatacctaatgctaaatggcgagttaatgggtgcagcacaccagcatggcacatggttacatgtgtaactaacctgcacattgtgcacatgtaccctagaacttgaagtataatttaaaaaaaaaaaagtccctttcttctttatctcttcctccctgcccctttcactgttctgcccaacacaaagttcaagtcgtctagagacgaatatggcttttgcttttgtagggactttttcctgagtcccttcctagcagggtacatgcaatataggcctgtgagaataactttctgcggtgacacagaacagtgaaaactgtaagtcagtctatggtgagtgcaatcctacattatttcatgcataaaaaagtcatacatctgtatacatatataacctatttcacagtaacaataaaaacatatttatcgattcatcagaggatagacagatttgtgtgtctatccaaatgtattacactgtgatttttttcttccttgagaaagatttccctgaagacaatatttatggcagggcaggaatttatattacacttgaatatatgttctgacaaagaagcacattgcattttggaattgggtgatattggacattcttcaaaaaatcttctaaagggaaagaatgtttcatctactcatttgttcagatttccctataatttttagccagcagtcctttatggatcagatattgcatcaaaaaagaaggggaaaatattcttgtcatggagacattttcagattaagttgaaaaggtccataatccttacggaaattttttttttaatcatcatcaggctattcttgacagtcagtaaaatatcaggtctttctcatttaactgacagatttcttctttttgctttctttcttccctctctgtatctatatctactctctttccagggctcacggcatatagtaagtattgaaaaaatgaatttaagtctaacttatacatacttgtgaaacctcattccttatgataaagaccttaagcttttctaaatgcagaatcagccactggtcatttttaatggacacgtagtggttgctattttctggagtgcaggattcattagggtcattgctggcatttggctatgttcagttgccccggtgtgctactgaaggcaagtgtccaaacgccaataatgtttggtttctctcgatattccgaggttatatatcaaaagaagccgtgtgtatggcttccagttacccatccagagaattcctgaaaaaagcaaattattcttaagatcccctggaattatgaatctcttggtggagatgcatggtagggaaaagggaaacttgatctggtttattctgaaccctttcttctcatcttatccttctactaagtcacttgaaaactgttaagaaggagaacatataggcattatgaaagaaactatgttgtagcagaattcttcaaggtctcaggatttacccttataaaaactgtacataatctaaagcataatagccaaaacaattcagtatgaatcagacgtacacatacataattgtctcattgagtttcccatctccactaagtcatggtcactgttttgccttggttatggtaactaaaagccaatggagattaacggaaagccccccaggagaaaatactcttttgcggtctttggatgaaggcctgagtatcagcaggactggagttctaaagaaactgctatgcccattgcatgagacacatgaagtaatgaactatagacaagtcatcataccagtatttcagaaagtgaaactgatataagaacacaggccagacaccaactcaaacaaactatggaagcagggagagcaaactgaaatacaaaggcatggccagtagccagagcaggagtgcctcagaaattgatgatagatgaagacaatttatgtagcagttcgtctaatggcagttctgcagggaggcatccttttgaaggtgatggctcaggttggcctacatgttcctgcccaattttaaaggtgtcataagccagtgtaattggggatctgtctggcttctgacttcttgcataactatgttcccacttacattggggtcttggcataatttgtctcctgacaaagagaaaatagaaaatatccaaatattccagccttatagcatagatgggtaaatataagacctttccttttagcattgatgacagtaaacacaattaatagctttctatttgccaggcatgtgacatacgactctgaaatcttgcaacaacccagttagaacgacttactaagacttgaagttaagtttgcctaaatgtatacagcaggtgattaaaatatggatttaactgctgatttgttcatatttaagatccttgacctttccactgttataatagtacatattgatattccactggcgatgagtaagcatgccttaccacttcacaaatagataaggtggcttctaagaaaatctcaaatagaggtggtcaggaagccacaggaccaaccaagaacccagaaacgacagtgcttactagatgctgcttgcattctaccatgtggatacaatgagtaaaacttgggtactaaagtcaaagtgcctgccaccacacctggctaatatttgtatttttagcagagatggggtttcaccatattggccaggctggcctggaactcctgaccttgtgatctgcccacctcggcctcccaaagtgctgggattacagatcccaactggattgggatcttagcacttacttgctgtataacttctccaggttactgatcatctctaagtctttgattcttgttctgtaaaatatgataatagtaggaataataatagtgccttctttagagatagttgtcaagattaaagtgcttagctcagtgcttgacatagggtaaatattcaacctatagtcaatcatcttaagtactcttgtctcaccgaggaaccatcaggaggtgtaggtaatatgcaaccttgaattagatgtaataaaatggaccccacaggaagtatttggggatattttaggcatattttccagtacacatatgcaatattagataatattttccaaaccaatgctatttaacctcaaatccagcacagtgaaaaaacattgaaaggtaaaagaaaaagtcacttcacttccatagttctcagaattaccatgtagatatcaaaaggtctcttccaactctgaaagtctgtgactaattttgttaaacccctactgtgtgcaaagtttgtcactgggacgaataaggttgacactctcagagaagcaatatgtaaaaagacatgtacaattctcttaatttttttttttttttttttttttgagacagagtctcgctctgtcacccaagctggagtgcagtggcatgatctcagctcactgcaaactccacctcccgggttcaagagattctcctgccccagcctcctgagtagctgggagtacaggcacctgccaccacacctggctagtatttgtatttttagtagagacagggtttcaccatattggccaggctggtctcaaactcctgaccttgtaatctgcctgcctcggcctcccaaagtgctgggattacaggcgtgagccaccacgcctggctatgtacaattcttaaaataagctaaagtgataaacttaccctatggctttgtcatagaagggttttaaagacaaaaaaaaaaattgaaaaaaattgaacttctgagaagaatggtgatattatagatatgctatagcctctaaataagaatagtgatgtttaaaggaatataaattaaagagaacactaaagggaaaagagagatggattttaccctctggatctgactttggttttaaattgcataggcaagagattggttagagagatttatttcaacctttagtagtgtattagcagtgtcacagaacaagggatatggttaaaagaaagaaggtgagaaatgcgaacaaacaagatagtgtcttggaatctgatttatttaaatttagattatattgctgttgcattaatctttgtataaatcatagttctaagcacattaaacttacgttgcagtcaatttttaattttgcaaaccttaaccgatgtttattattataagctgtgaacatttttttaatcattgagaaggcccctctcaagtgaaattttggttccaaatggccaaagtaactaatgggcagggaaaaaaatctgcttaaactctcatttcaatcacagttatgtggaaacatcttgaagacaacagtaaaggaaagagaaagaaatcaggtggatggagaagatacactagaggaatgagatctcctacatgagtaaagtgttttctaatgtgtttttcttgaatgatagcatcttgaatttcctacaaagtatggaatagtttacctctgactagcgctgccctacagaacaatgtcaatttattctaagactgcaatgttcagaatgcagatatgatcagttcaacccagatgagacaatcctataaatgtaataatagaaataactatttgaaacttgaaaatcagaagtgttttaactttcttcaaacacttagactataacaacatttttagtctaatgtaattagcgcaattttcagaggatatgtttatatcaagaatattcctgtgggagaaatagaaacttttaaggagaggtttctaggattcttagacaactaaaactttcgtttgactcagaccctgatattacattttcccaggattcctctcacttgtgctgttttcagtgattgctcaggttatttcgaatgatggcatacatatatcttctctgacatgcaaaaatgccagaaccttctttttcctccctctgttcccagaaagaactaagaacggtctagctttgagctaaattgtacagctgactgtttgttttgggaacttccaaatgaacatatttggtgttgcactggtgcatcccaggaacagaactgtctgaccagaagagcaattctgcttctggaaatttctagcacataagaagatagctggagggtatgtttgtctgtatagtttagaggctggctggtgctataaaggaaagtaagaaaaaggcaaagatatccttcagaggattcccccagaagaaagtagcagttatgaagttttattcctgaggtaggacaggcagtcagacccaagaggtctcagtgtctctccctgtgttggatgtaattgcttttcattgtcaatactgaaagaaggcacacaagagacaaatgaaatgtgtgtgtataaacctggctttggttttcagagacagtcttcttacaccttcagatctcctagatgagctgggccttacagaaaatacaagtcttgagctctatttgtttacagttttcaaattctcagcttctgcctgtaagatatctcatgtgattaactgatttttctaatttaagggagttattttctgtggaggaagaggctataaagtcacatttttatcttattttcttttttttttctctgatatttcttctctgttttccacattccttgtcactgtcaaaactggtaattaatcaagagttagtcatggatggctccttttccctccccttcttatccttcattttcctgcctgagtgataacgaatgatgtctcttgtcctgtacccctggcttcctctcctcagagcattcaagccagaccccatgacaagatgctcccagtgaagggagaaaactgggaatgacaaatgtgagtctgggaacccaggcatcaaggggtggacttcctgatctctaccacttgccatcatctatctctccatgtcaggaggcctttgggaaaagcagaaacaaaagagaaaggaaaagttctcatcccagcattttagcatcatgagaaacctggaagtacctttgcaatagcactaaaatatgatgagtcttgagtctttcccaaggttttgatacccaccagcccacgagtatacatgtaggcatacttttactctctactttctccagcttaatgtttttccaagtgtctggaggaaaataagagcaaacatctttgtaaaattggacacatctcttctttcattatatgattggtttatgtgtctgaacaccttaggactcagtctttactcttatttaactgaagagattaggggaaatacttcctcacccaccacagagtctgaaattctgctattagagactcatgcctttaggtgaaaatgttgcatctccaagaagacccatgaaaacagaagtgattctaggtagaatgaagatacaatataagctaatcgatgatatcctcctataaattcctttggcagatctatttactatggagatccctagtggagaggatggccttaaggaattgggaaataaaatagttaacttgagataggttgaaagagaaaataattcctgagaaaggaacacaatactgcttgaaaatagtactaatgtatttttacagattagtttttgctggttcctgaaccaaatgactagctgggacttcttattctcagatttgcctcacacccacttaagaaaaataccagattgacatcctcaagttataatctaaaatcccagggagggagcacactagtcaggggtgagattaaatgaggcaaaagtgactgcatcacatttcactgtctatagaggctattggcagatttatgcaggctgagttaagtgaatgacttgatagcctggatcacatctatatgtgtttttcacaggcatcatgtcttagttagttttatgttgccataacagaatgccccagactgggtaactcaaaatgaacagaaatttatttggctcacagttctggaggctgggaagtcttagtgcatgaaactgacatctgacatgggcctttgtgctacatgatcccatggtgaaagttatcacatggcaagagagcatgggagagagccaaactcaattttataaccaactcacttctgtaataatgacactgatccattcatgagaacagagccctcatgacctaatcaccttttaaaggtcccattgttcaacactgttgcattgggaattaactttccaacacatgcactctgggggacacattcgaaccataccaaacatccactctgtagaatgttgcccttaatatgctgtgattgatatagatagatagatatagatatagatttttttttccttttcagtgtgttttagtatattagttgggtctcatttgcttgcttaaactgttgtatgaaaaaaaagaaatgtgctgcaaagatacagaggtatattgtgcagctcaaattaggtcaggaatgttattaatttaattagttatccatgcaatatgctgcataacaaacaaccacaatatctccagcagcacaggacaataaacacttatttcttatggagctgtgggttgcttgagggtcagctattgcagcttgagactggctaaatggctccactaatctcagctgggctcactcaagggtctgggggtcagttgaggttcaggttatataggctttgctcaggtgggctaggtcagctctattacacatctcttatcctatttctgggtccagcctgctagcttgggcaaattcttttctgtttctacaggttaattttggctggttactggaccaaatgtctctgtggaaattctccttctcaggtttgccttatatccacttaagaaaaatgccagattgacatcctcaagtcccagtctaaaaacttgggtaggtgcatggtagtcaggggatgaggtcaaattaggcaaatgtgacttcatagccctgctgtaaccagctggaaaataagagaatgaacagacaaaaatagacttgtaccacattaatgacatactgattatttgaattagttaattttgctaggagtagagataataagagtgtggttctcagttgctgcttaccccgaacaagagtcttagtaaattgaccagctgagtcatttgaacttgattcttggtaggaagacttttgcgtggcttatctactgttttttcttctctttttcttttcttactgtatctgtaatttctttttttttttaattccatgatttactggaaatctcaaaggatgtttgaatgaactctaattatccgttgtctttgttgtcgctgactccactgtcaaaaacccaagccaggcatccgcttggtttggtgaccttaaccacaatttgaaggctgctgactgatcagggcagtggttgcggaaggttggggtggcaaacaacaaagatgtttcccgcaaggaatttgagtcttcctttcatgaaagacttctttgtagcatgcgatgctatttgatagcattttacccactgtaggacagctttcaaaattgtagtcaatcctctcaaaccctgccattgctttttcaactaagtttatgtaatattctaaatcatttgttgtgatttcaacaatgttcacaacatcttcaccaggagtagattccatctgaagaaactactctttgctcatctataagaagcagctcctcatctgtttaagttttattatgagattgcagtaattcagtcccagtcccatcttcaggttccacttctgattccactctgccacacatttctctgtgagtctgttaaaatatggataatccaaataacttctttctaatgtgatttatatgaaatggaagcatgttctccttcccccttatgtgctcttgttttgaattgcaaatattcagttttgcatatatttaaaagttattttgacagtatgtaatgtagatttaaaacattctgaagttggctgttttcccttgatcaattcttcttttagaagaaacactgtaaataaaccaacaagtgtcagagcatacagtatagggaacagccaaggacaatctgttatgatattctgtgtattaaaaaccagtttgtttataccactaggagaatttcattttttagtatttggatttgatggatttagtgagaacgatatgatttgcttcattagacagctatgccacagctgaacgatgtgcattactcttaatgctaaagggagataaatgtaatgatagaaaaagttaagggaaccaaagaggcaatattcctagaataagcagatgaaaatttaactatgatgcacagaagttaaatgtcagtaattccattcaactaggtcagtggaattggggcaggaactttcttcattgtagcagtgaagctgttagctggtttacttagaaaccttgaatctgaggaatcatctccagagaacacctgatataagctacagttttcttgactcatattccaaaatggggattgaactgtgagaaagactacaagtaatttctgagttactgaacttagaaaaagcaaaactggccaggtgcggtggctcacgcctgtaatccagcactttgggaggccgagaaaggcggatcacgaagtcaggagatggagaccatcctggctaacatggtgaaaccctctctctactaaaaatacaaaaaaattatctgggcttggtgacatgcgcctgtagtcccagctactctagagactgaggcaggagaatcgcttgaaccctggaggcagaggttgcggtgagccaagatggcgccactgcgctccagcctgggcgacagtgagactgcgtctaaaaaaaaaaaaaagcaaaaccttgggacttctttctttcccttcttattttcacctttccttctcttccttcttctctttctacttcccttcttgtctctctatttttaccttattcatttcctctcgtgcctttccattttttatatcaggaattaaataccctctagagtgaaacgatgaataaaatctactagtcctgtgagaaggacaaaattaaatgtgttgggttgtgtttgtgattgtgctgatgacagcaaaagaagccacactgaggattgaagatgagaaaaaacaaactacaatgttcactaacgtaatttttaagggagaagatataaagattaccagagttcacactttcaaattgtttgcaatcaattgaaagtcgaaaaaagttatatgttgaacaacatatgagaaaaaagcaagtgaccatttaaggtgatatgtgttaagagcaaatcaactgatagagatagaaatgtggatgaggaagaccaccactattccctggggtagtcaaaggaaagttggcctggtactggattttggataacactgaataagattcaaacagacaaaccatggttggggcccagcttgagcaaaggatcagaagcagcagtattccagacatgtgagaatataaatttggttcaagtagaaaggtttcaaatggcagatgactgtggaaaaataatttggtgaaaacttataaaaggcccggaatgctgagatagaaccttgggttctattcagtatatattttgagaaccactgatggtcactatggagaagaaagacgtgtgctatataatagaacaagaattgagaggtcattgactgggggagtttcctagacccagagaagggtaagaagggatacattttgaaggctggtacataaagagaattaagatatcaatgagacatattttaaaagccaagagaaggagaggaaagtggtcattttcagttctgaaggtgagagttttgaggtttggatgactatgaaataacccagtgagaatacccatttatcagtgggaaatcctgaactagagtttgagagagtctgctaagctaaagttgtggatttgcacgttagcctcctgaagaggatggttgaattcataaatatggatgatactctacagaaaagaagtttgcttagaggatttggcatatccatgatgagagtataccggggaagcaaggaaacactgaagagagaaggggtggtcagaagaactgtagaagtggggcaatatgtggaatagtgagggtctcagaacagacagaggacctgggccttgaaggccagctgcgtcatctggagatgaagatggaaggaaatggggatcattgaggatgaagaagaaaaggagccctaaaggtctcttacagtcatcactttgtccgtagaaacacatctctgggaaggaatgagttaggtttttcttattctttcttcattaataaaaatagaaaaacaggtggtgaaacaaattggaaaacaatgtacacacaactaatactcttgaagaaagagatttcacactgtgtcctgctaacctgttctgatattcaatggcacttgttacccaggagttcttttttaaatcactatctgaaatccctattgctctcctgtgagctgtattttttttttttttttttttttttttttggctttcctctgtttatcctcaggggacagaaagaacatatggcaactatctctcaagtaataatccttcaattttggaaatacgtattatataagatttttcctctctagccttttattctttgagctaaataatactaagaaatttaggctttctttatggtcatttcttcccaggacaatggcacagactgagtcaaattcagttcctaggacttggataaaatttatattgaagccactgctttgaatcagcgagcagtactgatgtcaagtttgcctattaggtagaaattcaagaatgaaatgatgatgacccttttgggaacaactctgtgcatcctttgtatcctgagagcacttatcaaaactaatagatgagtaataaatctttcaaaacaaagaaaaccgatggacaaagtggtgaaaatatagcatttgtctcttattgccaatgcgtggcacataccaactcaattcatatttgcatgaatttatgaaagcaaggatgaaaaaatatgtactaagatataaaattagcaatattatttttaaaaggttgttaaaagtcaaggccttttgggccaggctgttgggctgtttcttaaggatatgatattttatttattttaacatattcagaaacacctagtggtattaaaacctctgagattggcagcatttggccttttagagaatgttgactctactttctttctctagaatttattctatcattttttatgacagtcttaataaagatgattgaaagactctgggtattaattcatcaaccagtatttgttgcaggccaactaagagtttggcactgtgttccaaggggaagttaagtaagcacaaaaatcacaaactattaaagttgataaagctgctgatttaagccaaaatagtaattctcttgacaacataagagtgaatgtttacatagcattgaccttttgccaggcactgttcaagcactttctacgtcactacatatttcttttaatttttacaacaactcattaaacaggtactattactatccttattgtacaggcgaggaagcacgtgagaattggctaaagccatatagttagtaagccatagagttaggatttaaacttgggtccaaatcctgtatgcttaaccattactgcaccagagaggtcctccaggcttcccttgagtaatctgaggaatgaggtgtgtgttatcttttttttttttttcctcaatcaattgaggttttattgagctagagcttgagggtgtgcccaagataaacaagagtcacagaaatcctctgtggcttatgttctccctgaagaggttttcaggaggctcagttttatacatttccttgggggaaaaatgtgtgtaggaagagttggggggtaggcagaagaatgattgctctcatattgtctttgttccatacctgagaaaataaggattattagtgtgaagtataataggcatatccttgttttgtgggagaatatacaccttttttaaggtattaagattatttttttctgtaagttattgggggtacaggtggcattcggttacatgagtaagttctttagttgtggtttgtgagattttggtgcacccattccccaagcagtatacactgtaccatatttgtagtcttttatccctcaccctcctacgactcttcccccaaagtccccaaagcccactgtgtcactgtaatacctttgcgtcctcatagcttagttcccacatatcagtgagaacatacgatgtttggttttccaacctgagttacgtcatttagaataatagtctccaaactcatccaggtcacttcaaatgctgtgaattcattcctttttatggctgagtagtattccatcatatatatataccacagtttctttatccactcattgattaatgggcatttgggttggttccacaatttttgcaattgtgagttgtactgctataaacatgtgtgtgcaagaatctttttcatataatgacttcttttgctccgggtagatacccagtagtggcattgctgggtcaaaatgttgttctacttttaattctttaaggaatctccacactagtatacattccctccagcagtgtagaacttccccctgttcaccgcatccatgccaacatctactgttttttgattttttgattatggccattctggtgtccattatcttttaccagaaaactcctcctgttgaaatggaatctttcttcccatacctttcctttattggtctaatttcactgcctggaggaagatggagattattttctacagagcagactctggatctgaagacagccttcaaactcctccagaaattgtttcttcaggattaatattctctccttaaattgctacatatgacatttttcatttgtttagctttgcaaaacttgcctattcaaaaaaggatattagatagttcacagagatatacacaacagacaagcaagataatatatatacctccaggttttgtggcatcaatagatttgataaacatactttgtgtcttcattagagcagtagataaatgaattagggctgtacagagtataaatccctgcggcacacccctacatatgccccatctagaatttctcaaatatccaggccacatctttctgtcctagttacaatgttaattgccaattagcatgtttatgtcaagatttcctgtgatagcatttttctctgggatctaataacccagtaaccttggacaccagcattatatagtgatatggaggtggattttggattcaaaatgtgtgctaaagctttgcaataatagacaacttaatttctgagcttcagtctccttgtctagcagagataacaacaggtaccgtgcaccttcttaaggctagttgtatggattaaatactatatacatgtaaaattattagcagatagtaggtgcttaattataattgtagacatttgtcaagaatgactcatttggccaatggagtgttggcaaatgtttacttaataattaattggctttctgagagaaaaagctctggtttggagcatttgatgatttccctggtataaacactcccaccaaagcttttgagctaccatcatggcatcatgaaaggcagagttgggtagcgatatatgcagtcaaatggctcttgggagacagtgccagccagtgccaacatccccctgtgtgtggcccatgctacactcatactcccactcacaagtaagattgcagcattaatatgtgagtaaaaagatacaaagaaaaaagatttccattacaaagagctcccgtcaggtgctgatagtgcttgaaaaagagatggttattttagttacatttataattgtgaagcttcttctgcttgctctggtatatggaagtgccagttattctttccaaatgtgcttggttttgtctttctttacctctttctccctcaccctccctcttccaacaaatgcctcatatggtaacagttaccaagcaaagtaagggattttatgaaaaattccaaggtttgagtaaaaaaatgaacaccaaaatacccattttattagtataggtagcatccagttaagagttgggtataaaaagaaacatttgcctacccaaagaaagcagcatcagaatcttggcataagaaaaatagcattgtttagtatttgggtgtttacatattccttgtgagggtgaatgtctgaatatgctcattttcatattttaagtcatcatcaattaaacatttgtgggtgtatttcttgtgggctgactccagtggctgtcagtgaaaccaagcagctgttgggtagatatggaacaaaaacaccctgaatgttacactcctgattgcttcccctggcacaggtagaggtacttatgcacagggaaggaaatgaagggcatgcatccaggttcctttctagctgtctccttagaaatcactgctttttggacagtactgaaagtatgacacagctgagacttggtgtatgtacacacacagtatcatatttgattgtgttggttgcttccttctggcaatcctttggcaggtggtatcacattcttccctctaaagagcattaccaactgagatttccctttgtgcttagtaaatatttaggcattgtagattgtgtcagcaatgattccttttatgtttcaaaggctggaaaatttttcttccttgacacttcactgttgttgatttggggaagaggtatgagccaaatggacattggacaaggaattaaaatttataattgccgcgaatagtaacttttccttagctgctgcttcgtacttgaaaatggaatgccctgtagcttgggaaccgaattttatggtggctctgcttttgtgatatttcattcaatccatttaacagttagttgtatttttcaattctaattaacattggtgtttttaatatatatcttaaaactataatttttgagctaagaagccttacaacagatacaccagcaaagatgactagaggtctacaagagtgcatcataagtagagcaatttagatggacttccttctgaactgctgcctaaaaagtttgttactcaatcttatcaccatagttcagcacaaagttaatgaaaatagggctgtataattttgttgtaaaacatcaagtacctgataattatcatcaccatccatctttatccaccatcatcaatcaccattattgtatttttattgcttggattaattcagtcctaatagagcataatggtatggaaattatttaattacattataagtacacactctatcaagtcagaaatcatttagtcctatgacagaaatccagcaacaccacctcctggtaggattagctatatatgcctttaagatatataacttaagcatgcagagggatatatagattgactgacagctgacttttcttctatttctccatgttgctacacttaattttgcctctatttcaaggaacttcaaacacagtgtttaaaagaatcatttaggctctccctgaatatacaaattttggtacctcatcattgtagttctctgataaggctcttggaatccctatttttgacaagcatgccagatgcttctaataacttgtctggaagaacatgcatggaggaacacaccattctgccctcataaaagtcattcatttttctgtctgtttttgttatatcactgcccaaatggaatgtgactatcaatacataataatttcagttactaatatataaattattagcattaatttgcatcaagttatactcatcattggtaattaataatgatgatgaatgatagcagatgtatatatggtgcctactatgccagacattcttaaaggatttgcacgtattaatccttacaagggccttcggaggcaggtaatattatatccccattctctagaggagaaaactcagctgaaggaggctggtcactgaatcacagaaggaagagagcaggctgtagaatcagatggcatgggctctatgtctgcctgtgccacttactggctgtgtgtcagtgacaagggtccatcatctcttcttgactataaagaaaaactggggatacagctgctgttaactccagagacaggtggtgagaattccatgagctgaagtatacaagtatttaaaggctagcctgaagagtaggcatgctctagaaatgttaactgttatcaccttttcttgtgacaaccctgcctttccaataccttttctaatgagttattgtcaataacatcccagtgctgctttctgaactgtgactatctttagctagtaaggagtgtttggtgtctcttttttagaatttttcttttctttttgaacattgaagagcgttcaatttttaattaatcttaataggcacacataccaatattaggcataattaataaccttattatctcattagaaaggcagaacacaatgcacataaccaggaaactaacgtacaagtcttagtgttcattactgctatgatattcattcacatgtttagtagaaaagaaaaaaaacaaaaacattgagccccttttcctaccggatcaagttacagatgttagcctgttcacaaactttcccacatccaggggcgatgtcccccagcacaccatccctccccagctgcttcctggccctcttgcctctgaggcatgctcacaaaaacctgtgagttttgaaagtattttcacctgccagcatcaatgagaaatcttctgcaagtcccctccccatgttcatttctgtcagttccttgggttacggttctcagtacataagtgtcattagcttcacctgggattttttaataaacgcaaattcctgaatactaaattcggattcagtaggtctgcaatggatctcaggaatctgagaacccccaccccgccccaagcgaacatgacacttctcttcgaaaaacactagcttcaattgtagagaaaaccaaaagtgcacatgaatggaaatctgggacatagtaagacaaaagagactgaagtaggaatagcaagcatttcaaaggaaaatgaggctgtcccttctgaggatttcatattaacaactggtgcaaggaaagggaatttgcagcagagttcagaataggggcagtgaggaagtggagttgaatctgagaacatgaataaggaaaccactctgaagatgagcatgtggcataagggaaattgccaccggaatgtaccctctctacttccctaactcctctctttacttctttggcccgttctttctgccacaacctaccactaaagatcctgctttgaatgaaccaaggtcccaggggattgttgcataggcataagggttgttcttggaagcctctgggtttgttgatacagaggatccctatggctccttgatgataattcagttgtgaaggtatagtattgagaaactggtctaaagtttttatggtatatatattttaaattttatttaataaatatataaaaagcactgttctatgtgttttaaaaatactaacacattgaatcttcttaagtactttgtggagtaggtaacgttattattccaatattacagatgaggaaactaagaagttaagtaacttgcccagagggtataaagaggaagggacaaggtgattgttccatactttaaaggaaccagattatcatatttgtagaaagaaagactacattttgagtctatcccaaagagtgttatttgaagtaattagactgtgtagctctgaaagaattggaacccgcaattcaaaacaatttaaactgttctggagacaaagctaactctctggtggggtttctttcttctgatgataaatttgggggtcacttaatccaggacagttcctgcatttatggaaaatgagcatatcgaggtaggattaaagaagtgaattcattcattaggctctatgccatcatggttcatttttttctaaagctgagccaagaacatctgtaccccaattttttattttcttggccaaaaggggacaaataacatctcacactaagaacattaaaatatttaccaaaggtcttcttttagcaaagaatatttcttcattgcaatgcctctgaacatcttcctgaatcaattaatattcatctaaacttttattttctatgactaagtaacagtaatattcataatagcaactgacattcagtgagctcttattctgtggtcactgtttcaggtgttttacctatattctattgtatgaaatagcacaacttactctgattaactcaattttattggatataacagttatttttcaatttctattatgacaaaaaatgttttattaatcatatctatagctaaactatgtaaaaatgtttgtaattatatccttagaatcaattttcagaagcagaattgccagtgtaagagtatactttaagaaaaaaattcagcacattttaccagttttcctgccaagaatgttataccaatctatattcccaccaacaatgtagcaagacttttgtgaaaagtttttttgtttttttgttttgagatggagtcttgctctgtcacccaggctggagtgcagtggtgtgatcttgcctcactgcaacctccacctcttgggttcaaacgattctcctgcctcagcctcccgagtagctgggactataggcacgtgccaccacacctggctaattttttgtgtttttagtagagatggggtttcaccatgttagccaggatggtctggatctcctgacctcgtgatctacctgactctgcctcccaaagtgctgggattataggcgtgagccactgcgcccggtgtgaaaagtttttaaagtaatgaattgctagttagcaacctctgagttttttaaggtgttgtctagcagtctttattaaaaaaaaaaaacagaggtccaatcacctatttccttagaagagggaatcaagggtatatttcagtctgtctataatgcactgctatgtaattactagggaaacttctccaaaagtcacaatgggtaaagtgttataaattctgagtcataagtaaagtttctactatgtgagagactctcattccctgttgtcactgagatcattaaggtctcagttcacatgttacctttgagagaagtttttcctattatcttatctaaaatagtcttcccaaggtctattccattactctgtcttgttttcatagcacttactaattatctttgtttattactttattgcttgtctccccattataacgtatgcttctgggagtcaggagctctttcttataccagcgattttatcacaagacctaaaagagtgcttggcacatgaaagatgtctatatatgatgaatcagtgaatgagtgatgaatgaataaatattggtcctcttaaatcccaaagtcctctgtttactatttatgcacagctattagtctgtagtacaacactgttaagagacaaaatatgcatatggggcaaagcaatatttgtaactctaaggtactcaaccttgtagatgaagataagtgaggaagaaccagttattagagtatcaatggcattggtcatttggttataagcgtaagtgaatttccccttgaatttaccctgtgagttgctatttaatggtgttggacagttacagataagtttggtagaacttttctctttgtttccttaagggttttgcctttgggtaaccaccttaatttcttcagtccctgtcttccatggataaagtcttagcagagctattaaagatcctaatgtcaacttctcttaagattatattgtccattaatgggtgttctgagagatgttattttgagatcaagtgctaaagatttacaatacacactttaactgggagaatatgcttgtttcactaggacagatatgtttctctatggtatccccagcacttacagtaactggcacgtaggaagcattaagaaaatgttgaataaatgaacaagataatcaaattctgtcttgtgaagaaacccatttgggatctattatatgttctgggtaattcctctgagcatcagcgaggatctgtgcaactaacactctggtttatatctaatttgaactgctgattgtgggcagtagaaattatttcagtagaaacttagctggcttgaatttatgagatattattagtctcattaagaaaaatgtctaccgacttctttaggaagctcatgtcttcagaaagtttctttgagatttcatatagaattccttggttttaataaacgttcctgacttctgcatatttgctattgatgcaacaatgatgcttggatcaaagttactttgtcactttctaattcatttattttagattactcagctagtagaaaacaatagagtcactttgttgctgtaaagtctcttcgtagtatttggtgggattgtgctattcttcagtgggctggtaatccctataaagcttagagaaacacagggctctttaaacgatcctttttctcttttctgttttaaatttcatcacttggttatttttgccacctgcttggattgcctccttacccaaatctaaaattcctacagtaaaataaatagaaaatgtggtcgctactctccttcaaaataatattttcatttctttggacaagtatgttaatttcttcatatgcagttgtcaatggtccaggtttcggaaccaaatagcctaaatttgtgtctggaccccactacctgctattattgactttgggcaaactagttaacctttctgtgcctcagttttctcatctttaaaatggggctattaagagtacttctctgtattgtcattgtgaattatgaatcaatacataaaatgagtttagaagaatgactggcacttcacaagtgctcaatgttaaattgtttttattgggaagaaatgaaaatacttccttgcttaatgttggagaaaagaatcactaacccatcgcatctctaagatgatgatgataattgcagttgccatttattacatccctactgtgtactaggcactgaattcaatgctttgtccaccttatgtaagtgaaatctcacagcacagtgaagtattattattattccatgttaccaatgaggaaacaggagaccctaaaaactgagttctttctctaaggttaaacagctcataagggatggagttcagatgtgaatccagttctatctgattttaaatcctgttctcttaattgttatgtcatgtcatctctacagtcttcaataattgagacttaatgttctttgattactaacatccagtggctattccaagggaattcaaaacccttgtcttcatgactttcaaaagcaacccaagtcctgaaaacaacatttttgtgaagtatattagtgtaatccaaaacatgataaacactttttaaagatatttgcagataagactcccctaccctcactgttacagtaacagtgtaattttccctggtattgctctgaacattaaggaattaaaacacttgaggctggacttgtcaagagacctatttttgttttgttatgttgtaatagctgttgtttctgatatttttctttttccttcattctgctttttctttctccaatcttggcttaaagggcaacttcctgtgcatgttcaggaatctgtggcaaagggaacaagtatgataatttgtctgctaccatttggatgttactattgtctcagcagccaggaaaacagacagagcccctgtgagcatcattgtgtttgggctgcggctttagttgccaaagtgcagtttttactgttggcatttccaccacctgctatgggcaataaccatcgaaaggacaaatccccttgtctgtgatttttctttctaggcttctttggagaaagactgtgaaatgatttattcctctgtacatatgaagctatagtgtattctccactgcatagttttggcctctgatactctctgttcttaggttaatccattaacttgcctgggggaaaagggacaggaaagatggatgaaggtgttatgaaaacagagatgagaaggatcttaaaaaatcccaaccactgccttttcttccctgttcccatctgctcctgagaagtccttcagaggatgccaggcctgttaatacctatactttatacctgttgttttaaatgaggcagttcttcctcactatatggatataataaacagttaagctgtcttcctctatgcccctcaaaaggagacaaacacacaagccctacacaaatggtatcgtgcccaaatgagtgttggaaatgctggataaaacaaaggtaagtaggtcttttcattgcaggccttctcagagccttaaaaaaaaatcctcactcatattttgaatctctaggagagacatatagtatacaacattctccaaatttgtttgaccttggaatgcttttttttttttagaagcaacttgagggacaaaagttctgtagaacacgctttggagagtattgggatagattactttcattgcatttttgcaatttggtttataaacttaccttggagattgggcaaattggctggttagtttagatacaatatatttttttcgggttgcaattgtatttttacagtagctagcagaagctgtggttctgaaaagatactataagaacattatcttgtgttctagaaaatagaaaatactctattttcttccccacctccatttttcccctgtctttagaaaaattaaagtatacttaagaagaggaaacaaagtgagtggtaaaggtgtatgcctctatagatggacaggtgtgttagttacattatatccaagtaatgtgtaagtgggccttattaatgagatcctaagaaactataaaaaatgaacataccccagatttctctttgtgtacactttgaaagtgtttttccatttctattaaaaagtttaatttgtcatgctcatgaaatcaacataaatttatggaggcagaacataatacagtaaaaagacaatgtgatccttttcatgtggcatttttaatacattgtatcacaaattacttcaaagaaacaattaaaagaacaaggaagaacttaggaggttcttaaaatagtatgtagcacattttagaactcaagtgacagagctttcctgatgggcccaagtcctgtctcctctcaccctttttttttgggggggggtggcgggaacaaaacaataaacacctttattacatgggtgaagacaaaacgaggatttatttgcctttccgggccttgatcttcctaagatagaactccaactctttgccctctagcacatagccatctgctcggccacatccacacagttctctcactctttcaaaatgtcagcaccagttccagaaggagggactggcccttgtgatggccataatgtaaagtgttcacacgaccaggtagcatttccattcttagaaagctacgcttcttagaaagctacgctacttgattctaagagatcagtcatacagacgtgtttttattcctttcagaggcaattcatttcatgaaaaaatgctgaaatgaaaacactttatagttaagcttggtgtagtcataaccacacatagctgtgttctgtcataatttgtaaattgagctctgtcataatatctatttttcaggaggctctcagttaaattttcttaaaaagtctttctgattatgaaagtaatgcatgcattgccctgtggcatattacatattactctctcatagaatatatagagagaaggtggcagtgaggacaattctgtggtcacctggaaggttttcctctggcacaggaaagacagctgtcctatttctagttgataaagtgcctagactgtgcattagaggccaaacattgaaggaagtcaaattgcctttttgttgattctaaagtggtctttgtatcagaaagtagaatctgaagaaatatgctgcaagccaggatgattatagttaacagtaatgtattatgtagtttcaaatagctagaaggaggatgttgaatgttcccaacacaaagaaatgataaatatttgagatgatagataggccaattactctgatctggtcactctatattatatgtatcagaacatcactatgtgcctgatagattatgtataatcatttgtcaattaaaacaaattagaaaacaacttacttgtctttttgctaaatctggatgtggatccagctgaatataatttcttcctagttctatgaataggatataggtcttggtttccatggtgttgtgtgacttatacttttgcttatctttgtcagtacttttgtgggaagaagataggggctctatcagaggttgttagcttggtgatgttttcacccacaaattcttcatttgttcttagaagttttctcatttctttgaactttccattaacattcaatctttcacttatatgaaaaatattttccttcctcctctttttcctcttccgtactttctccaaattcaggaggcagataatggtaattgaaagttctagggacacactgtgagctcaaggtccagaaaggttagggaaagtctttattttgaactgtaggtatgttttaattccttctggagactagcactcctcagggatgctgagactggcactggtgctaccggatattaaacagaatggatttaaagtattctcctgtattaagaagattattttcaaaagaaagctctattttgtagttattgtcactttcctaaagatataactttcctggagctgtggatcgccacaatattgatggcccatcccagcactatttaaaggcagggctttgtcatattttttataatatttgcagcttggtcaaataatatttattaaatgattaaataaattcaacagcacttagaaacaatagaggcagaaaatgaagttgtggagttggggtgtgtgtgtgtatatatatatagaattagtacattttcacactgctgatacaactgagactgggcaatttgcaaaagaaagaagtttaatgtactcacaatttcatgtggctggggaagcctcacaatcatgatggagggtgaaaagcacgtctcacatggcagcagacaagagaatgagagccaagcaaaagtggtctcctcttataaaaccatcagatctcatgagacttattcactaccatgagaacagtatgggggaaactgcccccattattcagttatctcccactgagtccctcccgcaacatgagggaattatgggaactacaattcgagatgagatttgggtggggacatagacaaaccatatcatacatatacataggtcagattggtaaaagttatagaagcaaatgttagaaaactattttgtaaagttggaaagtagaaacaataaaaaaacacaattcaaagagataagcattttcactggtgtttttttctggtgtgattcttccagagattattctggttatccattgctgtgtcacagaccactccaaatttagtggattaaaaatgataaatattttatgatgtcatagattctgtgggccagaaatttggacagggcacagtgaagatggtgagaacagtttgtctctgttccctgatgtctttgatctcaactgggaagaactgaggagctagaagtgactggcatggctgagacctagaattacctggaggcttctttattcacgtgtctgtgtctgagcctggaatgggatgatttgaaggctgaagttagctgagatggtgtggcttttccatgtggctcaggcttttcatgcatggtggctgcgcttctgagagagaagtcctgagaggaagtatctggaaagggagccttccaagagaaccaggtggaagctgcattgccttttctgacctatcctctggaggcacacagttacatttccaccacatttcattggttacatgtgaatcagaccaaacagattcaaggggagaaagaatgagcctcacttctttgcgcaggagagtcaaggtcacattgcaaaagagcgtgttggatggaagatgttacatctgattttgaaaaatatacttctctacaatattgtttggtcatcttataaaagtaaaaaatagtgtacctttataatatttcattgagaagtgtattaggcactttatcttgctaatgtaagatggttcactttaaagtgctctgtgtttgaaacattgtctttcttcacctttctaaagaacgctctaagatgatatatggcaaccaatcaatattacttttttcatttgtgtagcttatttaactacaactatttaataaatattatagggacattgtgttattccattttgtgaccctataaaggaacacctgaggctcgataatttataaagaaaagaggtttaggccaggcacagtggctcacgcctgtaatcccagcactttgggaggctgaggtgggtggatcacaaggtcagcagatcaaggccagcctggctaacatggtgaaaccctgtctctactaaaagtacaaaaaaattagccaggcgtggtggcacatgcctgtagtcccagctacccgggaggctgaggctggaggatcgcttgaaaccaggaggcagaggttgcagtgagctgagatcacaccactgcattccagtctgggtgacagagcaagactctgtctcaaaaaaaagaaagaaagaaagaaagaaagaaaagaggtttaatagccaaagttctataggctgtataggaagcatagtgttagcatctgcttagcttctggtgaggtctcagggaggttttactcatggtggaaggcgaagcaggaacagcacatcacatgacgagagcaggagcaagaggagtagtggggtgccacactctcaaacaaccagatctcatgaatttgcagagagaactcactcattactaagagcagggcaccaagccattcatgagggatccatccccatgacccggacacctcccaccaggccccatctccaacataatggattacatttcaacatgagatttgaagggaacaaaacatccaaaccatatcaaatatcatagaagaaaaaataaacatatgggaacatataagtgagaaaataagtttgtgaattatcaaaaagtggaaatagtaatatctaggcaggttagcatacataagtgatgttctagtggttctcaatctttgtggcagaatataatcatctacagaattcaaatcaaaacaaaacaaaaaaaactctggtaccctgctccctcccccagaaacactgatttaactggtctaaggtatagaccaggcatcaatatttaaaagttccctaggtgattgtaatgtgcagccaatcttgagaaccattgctttaaacagtttgtaaaatgtacgaaacagggaaagatgtttaattacaatgtttagttacatgactgaaattttatcaataagatctaaattctaatctaaacagaaattcatttgcctcttcattcttcaacagattagttcccagaggacactgttggattcatatctgacacgtaaataaagcccacacaccaatatccaaagcagaaagctgaaagggacctgtttccttgataatatcattgaaccattgaaatattgaccccataattgttccaattttgacttctaagaatgtagaatatttgtattttgtttcaactagatgttggaaaattctatagtttgcacccgaaagcgtttgaaacattcctttgtataaacacattttcttgattgtgtggtcaatctgctggacagatccactatgaattcagacagatctgggtttgaatcctggctctgctaccgtttaatgactttaacaatcttatttcatcatgcctccaaaaactgggagaaaatagaatacctgtttcagaaaatgattataggaattaaaagcatccattcttttattcaggaaacctttgagcacatgagtattccaagattgtattctgtacttggagtatataggaatgaacaagacagccacacttagcagaatgggagagggaggcaataagaaagttaaagaagagatgacaatgtcggtttctgatagaagctgggataaaaaaaggaggtagcaaaaaagtgtgaataggacaagtctgagactcaaatgataaaaggtagctctgcaaggaccagacaagcacatctaagtcagagaattgttaatacaaaagagtcttatggcaaaaataagattggtttatttgagaacaacaacaaaaaaggtcagagagcctggatctaatcagtaatgcagtggagagtgagaaaagtaagattggacgggtaaacagacgactgattaggtaagccaggaagaggagttgggatttattataaatctcatgatcagcatttataaaactttaagcaaggtgctaaattatctaattttatatataaaggggtaagagtgaagggggaaacctggttagcaaggtcttgtaatagtcccagtgagatatgatggtgccttgttttagggtggtgctggtggaagtgaaaaaatatatgtttaattttgctgtgaacccaaaactgctctaaaaaataaggtctattttttaaaagtatataaatgttagtaaaacacatagatttacatggtgggcactcagtttattagagatagggtctcactctgtgccccacgctggaatgcagttggcatgatcatagctcactgtaatctcgaactcctgcactcaaacaatcctcctgcctcagcctcctgaggagctaagactataggcatcaaatgcccagctaattttatttattatttatttatttttttgtagagacagggtcttgctatgttgcccaggctggtctcaactcctggcctcaagcagcccttcttccttggcctcccaaagtgttgggattacaggtgtcaaccaccatgcctggccagtaaatgctattttattcataatgttatcattaccattagtacaatgtggaagcaagatctggctctgtcattagcattgctttggtggaaagatttactaaataaagcagagagacttttccaaattgtatttattatctttaaaggctttcccctgaaggtacactgggatactaagaagacctgaatagcttaagatctctacaaaaggattccacataccggtttgggacttctaagggaaaatgcaaagattcacaacttttaatagacagtgatttttgtttctatatctgacggtcatataattatattttagcatcccaacacagttttgccataatggtgtgactctatgattgtgttgtattatgtaccacttcaacccaaattagtttaatgatgctatagaggcagagttgttttcccatcaaaatgggaacaagtatgcaaaagcaagataaacactatctttcagagtgatacattcaagcagcattggttttaagattaagcaaattcccactgccttgctttattagtatacttatgagaagctactttataggtcatataactgaagtgagtttataattatggcaatgggtctacattggaatgtagtttatagttactagctcaaatatctctgcctttcacgttatgttggaaaactgcatgctatctttatttcttagtttcacatctgtaaactgagattaagatctgcttttctgtttaaagactattgcctacatcagagaaatcatccttcagcacttgaaagactttgaaaacagaggcttcctaggcagataatattttgtttactatggttggttttcttttttccttttgaatagactttattttgtagagaagttttaggttcatagtaaaattgagcagaaagtatagagttctcataaacctcttcctatgccatcacacatgatagcttcccccatcaggagcattccatgcctgagtggtacatttcttacaattgatgaaacagtattgacacgtcatcacccaaagtacatagtttacactaggattcactcttggtgttgtacattatcttcatgtgtcaccatcataatatcctacagaatagtttcattgccctaaaagttctctgtgctgtgcttcctcattccctcctaaccactgtcaagtaatctttttactgtccccatagttttgcattttctagaatgtcatatagttagaatcatatggtatgtagcttttcagattggcttcttttacttagtaacatgcatttaagtgtcttccatatctttttttaatatatacatatatattttttattatactttaagttctgggatacatgtgcagaacgtgcaggtttgttacataggtatacacgtgccatggtggtttgctgcacccatcaacccgtcacctacattaggtatttctcctaatgctatccctcccctagcccccattccccaacaggccccggtgtgtgatgttcccctccctgtgtccatgtgttttcattgttcacctcccacttacaagtgagaacatgcagtgtttggttttctgttcctgtattagtttgctgagaatgatggtttccagcttcatccatgtccctgcaaaggacatgaactcatccttttttatggctgcattgtattccatggtgtatatgtgccacattttctttatctagtctatcattgatgggcatttaggttggctccaagtctttgctattgtgaacagtgctgcaataaacatacatgtgcatgtatctttatagtagaatcatttattatcctttgtgtatatatccagtaatgggattgctgggtcaaatggtatttctggttctagatccttgagtaattgctacactgttttcaacaatggttgaacaaatttacactccccccaacagtgtaaaagcgttcctatttcttcacatcctccccagcatctgttgtttcctgactttttaattatcgctattctaactggcgtgagatggtatctcgttgtggttttgatttgcatttctctaatgaccagtgatgatgagcattttttcatgtttgttggccacataaatgtcttcttttgagaagtgtctgctcatatccttcacctactttgtgatggggttgtttgtttttttcttgtaaaatttttaatgttctttgtagattccggatattagccctttatcagatggatagattgcaaaaattttctcccattctgtagattgcctgttcactctcatgatagtttcttttcctgtgcagaagctctttagtttaattagatcccatttgtcaattttggcttttgttgccattgcttttgatgttttagtcatgaagtctttgcccatgcctatgtcctgaatggtattgcctaagttttcttctagagtttttatggttttaggtcttacgtttaagtctttaatctatcttgagttaatttttgtataaggtgtaaggaaggggtccagtttcagttttctgcgtatggctagccagttttcccaacaccatttgttaaatagggaaatcctttccccattgcttgtttttgtcaggtttgtcaaagatcagatggttttagatgtgtagtgttatttctgaggcctgtgttctgttccattggtctatatatctgttttggtaccagtaccatgctgttttggttactgtagccttgtagtatagtttgaagtcaggtagtgtgatgcccccagctttgttctttttgcttgggattgtcttggctatacgggctcttttttggttccatatgaaatatgaagtagttttttctaattctgtgaagaaattcaatggtagcttgatggggatagcattgaatctataaattactttttatggttcaatagctcatttctcctgactgctgaataatgttcccttgtctggatgtaccacagtttatttattcattcacctgctgaaggacaccttagttggttttaagtttgggcaattatgaataaagctgctatgaacactcatgtgtagatttttgtgtgaatataagtttttagctcctttgggtatataccaaggagcacaactgctggattgtatggtaagtgtatgtttagttttgtaagaaggtgccaaactgtctttcagtgtggctgtaccattttgcattcccacaatctatagatgagactttctgttactcgacatctttaccagcatttaatattgtcagtgttttaaatatggaccatactaattgatgtataatggcatctcattgttgttttaatttgcatttccccagtgacaaatgatacagagaatcttcatatataattattgccatctgtattactttttgggtgaggtgtgtgttcagatctttggccatttttcatctgctgttttcttattgttgaatttcaagagtttttaacatattttggataacagtcctttatcattatgtctttttcaaatatttttcccattatggcttatcttttcattctcttgacagttacatcatgcttttaattgtagaattagacaacaatgaaataaccaaagccttagtaatcttaattagagattatcttctattattttctatttttcttgtttcacctgagttagaaaactgacctgcactgacttcctctttcacaataattccagtgaaatgaaagtgattagaaagtcttagcaaattcaccaaaagttagagccagaagactcacatttcaattctctacctaaagagaaggacaggcagaagccaaatatgtaaagagtttgtcagaagtatgccttggagccatgggcattgttcattactctgctgaatttatcttatggattttcccctccacattaatgtttcaatgatcttggttagattgttgaagtacaggttcctgctaggcatttctaactttttgttttaatattctcttatcctgttcatttactctcatttttccttttagaaatttactgccatcttctcttttagaaattcttttgacaatctgaaggaatgcagttatttatccctatgagcaattaaatacttttaatgggaatgtcatgtttttaaatcacatttcttataagaaaaaaatggtgtttactcaaatgaatgtggtctgatggtgatcctgatctatgagcagtaattgagatcatggaaataaatacaggaaagctggctccctgctcccttcaataaccaaatctatggtttagacattttttagcactttgctccaacctgttacagattatcaacattatatatgatgataataaatcagagcaccactttaaaacacaaaagtggttgcctctcagtgctatggcaaacatagaattttgaactttttgtatgactggtatttttttaagcgactatattttaataacgagctattgcatgtgactttactatgatgctcaaatatgttctatgtatgacggggaggaggaatgatgttaccatatgttggttctgaattcctattttattttattctcaggtggaaaaaagaaagaaaaaaggattcatcagcaatagggcaacttagagcggacacataggtactatggcagtgataagagatgagatagatcatcactatgcccttttcaattcttgggaactgtcttcgttaaacagttttagatgcaagggtaatttttttcctatggtgattgtagaaagaacacccagagattgggactagaagtcaggatgtctttagccttacttggttgtcagctaactgtgctgttttggacaatgcattcttttttggtattctgtttatcccactacaaaatagagatagtgagaattggattaccattgtcaatatgaagcacagatgaggtaagtgtgaatcacttgaggatatataaagtcatttaaaactttaataattataatacgataatatagttgttgatttagtttagtttcttacatatgatattctacatattcttatcacttcacagggaagcattgactggccaaagtaatggtgggtagagggaatcacttaccttagcttaaagagatgccaaaatctaggacctattcagagttatgaattatattttgttgagcagtgttcctccaaaattcatgtccttcctggaacctcagaatgtgaccttatttggaggtcacactggagatgagtgggctcttactccaatctgacttgtatccttataataaaaagggaagagacacagagacagatgcacacacagaggagaacattgtgtgcagacacagacacatgaggaagatggccagtaatgatgaaggcagaaattggaattactccgtaggaaggcaaggatcaccaaggattgctgccaactaccaacagctagaagactatggccatgctcacatcttgatttcagactgtgacccccaaaacagaaatggtgagaaaattaatctattaagtcacccagtttgtggttctttgttacagccgccctaggaaactaatacaggagtcaaggaggctgctgaacccagctggacactgaggggcatccacagaggtcaccaaagtggagtggccagaactagattttggaagccagatatggaggcaggaatccaagaagcagggagcctaatgaggaatagtcataaaaagagctcttggcagccgcctgttccagatgttggtgttgctgccagtttctatctgctcagtacccaaggcactttaatggactgagataggttggacaggttctgtttgaaaaaatcccttacatgcaaagtaagataaaaccaaaagccaaagtatcttgctttaccttgaagaaggaagcaactctccctgatcacagagcttccctacttggccataggatagcctcatgtgcacttagctcaatgttactctgagtttctttctactccgtctttctcgatataatcctaaaagttagggattcccaggaattatcatggaacaactggcttatgtcttagtttcctatcactgctgtaataaatcacggcaacctttgcaatttaaaacaacgtaaaacctattatcttagacttttgcaggtgagaagtccattatgggttgcactagtctaaaactagtgcaacactttttaccccctgaaagacatcaacactttttaccccctgaatctaaaataaaagttgaaattatttttagaaataaaaataaattaaaatgtttcgtaaaccactttggtttcctttctggtgtctctgaggcaaatgttttctgctcatttgagttgttggcagaatttaatttcttgtggttgaaggatggagatctggggtttttttgctggctgaaaactgagggccattggcagcttctagaggctactgtattcctagcccatggtgcctttcttccgtcttcaaagcctgcattcttctgcttctttgtccttttttaaagactcatgtgattagatcaggcccacccagataatccaggattatctccctttcttcaggttggctgctgaacaacctcaattccacctgcaacctaattcccttttaccatgtagcctaacatattcacagctctggggattaggatgtggacgtctttcaggagccatgatccttccttccacacattaactgcagctaagcaacatgactccccatcacgacagagtagaaggagaaactgaactgtgagaggggaaacagctttatcaaaacatagcaaatgtcaattataagcaaaaagagaaagtcaagctgcctataatatgtgcaatatatttattcttttataaacttgctgatatggaaattaaaaattaaatctacttaatggaaaatatttgatataagaacatcagacatatctttgataggcaataaattactttatagaatcgtttagcatcttatcttcagggctattttttggccctaactttgagcacattaattttgagttcctcttgtttctcttctatttgttccctcaaacccaatgtatcagaagttattttaacttaagttttccttgcctaattccatccacttatccccagaattgtttcatctcatgtatttattacactgttcacatatcaccttctattttcatgccccttgtaaacagcctaagaggcacattactggtaaagcctcagggtaaacaggcattgcctcccattttgatttcagctccatttaatgactttttatacccaatgtggacacatactcatttttagttttccaatgcagatttcagctatattttggctttattcctcttttttcatcctttttttctttttttttttttttttttgagacagagtcttgctcttttgctcagtctggagtgcagtgacatgatctcggctcactgcaacctccaactcccaggttcaagcaattctcctttctcaagtaatcctcctgaatagctaggattacaggcatgcaccaccacacccagctaatttttgtatttttagtagaaacgggtttcaccatattggtcaggctgctcttgaactcctgacctcgtgatccgccagcctaggcctcccaaagtcctggaattacaggcgtgagccaccgcgcctggcctacatccattttaaaatgaaaaaatatatatatatgtaatttatttgaagaaagtctattcatttacgtaacacttatcattgagcacttcgtaggtacctggcgttgttctagacactggaaacagaccactgattctgatgctcaagggccctgttggtggcattgcctttggtgcatccttttctttcacctcttatactttcgtgttaatacttccctacatggattgttttcttactttgtcatgtgtacactttccctacatggtgttttcttaccttgtcatgtgtacactttttttaccctttgcattatgaaatttttgtatcctgaatctcgtttggctatgactcaactttttaagctaactctatttggaaagagtctgattaaagaaaatgtcaccaaacggttaaatatgttatttctgtgcatgtttgttatttgtcaaggggtttcattttaacccaaatgaataactttttattggtggattgtacccatcctcgttagatcaccaaaggcagtatgtattctgatagggccactttgttgtgcctctctgctttcttttctctctctttttcttttctttctttttctctctctctcctttctctccttccttccttccttccttccttccttccttccttccttccttccctcctcccttcctcccttcctccctcccttcctcccttcctcccttcctccctcccttcctccctcccttcctctctttcttctcttgcctctttacctaatgtctcaaatggtaagtcaggccctgacctcacatgtgacagttaaaaagatgccagtgacatctttccccaaagcaatagaaaggatatttttcaactaacgatttaaataggtcaaagcaaacaggatactcacattaaaggaagaagaaactgcatgttatagaaagacctatgcattcagatacctttgcctgccctgaaattccatttttcaaattcatttgcctgttagctgaggacctttttaatggaactgatgttagtgatctcctagacctctgacagttcttgagagatagcaaaagctttccctgaagtgctagccatgtagcttatccctttaggcactctattgtagaagtctccctgataaagcttcctgtactcaaattcttaggggcagggaggagggataaacaattggaatacttttttgggatattaataattggttatttcaaaatctaaaaaaaaattaaaaataatcatttgaggaactctgttaaattttttaaaaagtgcattaggtttagatgtgatgaagcaacaaatgcaacagatgttgcaatgccaatcagatacttgactaagacaaaagtttaatgccaaactgcttcaccagaaatagcttcctacctgacagaggacactgaattgtgtcaaagtattagaggaggcaattggtaggtaaagataattaaagggacatccaacatgttttgagttctttctccgtatatatggagagagagaaaagggtatatttgtgccttggattcattagtaaaatgcattagctatagctgactgatttgcaactggtgcctgcctgaggtctccaaagagaggagatttacatttaggttttaagcttgggaaactttgaaagttcttataaaaaattagacagtcatttagaaatgtaaatatactgtatttctttctggattacacatttgctgaaattcaccttttagtttttttagaagggagcggtattggcatacgtgttacacttttttgcacatcacttttgaaatgaggttccagatggagtctcagccccagagtgtaacaaagagatcattggttacaacctccttcttacagactaacacactaaaacccagagaggttaaggaagagatttaaaatcacacaaatatttagcagcctggccatccatgactaggacccaagttaatcaaatttccatcatagtctttttttccttcccttcatcagcattatacttgcttgagtaaacatcttaaatatagaatgtttctccttttcattaagaggtcatctaaaatagtatgttctctattctccattaaacatagtttataagatttctttgcctttaaaatcagtttaattagggtaaaatttaatacataattgatcatacatctccaagttgaaacatctattctgtttttaggcttagtttagtcatttcccatttgtttgatttaaagtagggttgaaggggcacacagccccgggaaacttcagtgtaaagtgccatccaactctagccagattcttttatctaatcaccacactccctgaagtctctgataattatcaataaattgggtggtagataaatagcagtgtcatgagagaaggaaaaagctgaaggcacactagcagtgactctttctacctgtcagcaggatggaggagtaaagacagatctgtcctgtttgtcaggagcagaaagtatgctggcgaaaacgaactcctgggaagggaaggtgtcaggaagatgaattaccccaggaagccaggactgctctcccagtggagagcagctcacttggatataatttgccagctgtccgtcttgtcctcgtgcgtctctgtctttttcctcctttgcgctgccagcaacaagcctgtgctgtgtagatctagtgcagccacagaaccttgggactagctgaagggccgctagacctaatggcaggggtaactatttttgcaattgtgaatattcagcatgcacaggcttcctatcagctctcccaggagctctctgagagatggaccctgtgaggaaacatctttaaatgaacaccttagtagagaatgatcctgttaggtgaataaaaggctgattacatacccagaggtgagccataatgaggctcagagtaactaaatgcagcaatctgctgcactttgtatctggacttgagcctgagcatttcaaagtagcatctggaaaagaaaaaggctctggggaaaatcacacagtagacttgaaatatttcatttttttttctccaaagggaacttagggtagatttcttgggtaacggttttgaagaaagaaggcctggtgtgagaggaacatgttgtgttggcatcaccacctcacataaccaaactaacactctcctatcattgttgggtgctgagagagctggtggtccctgcctgtgtctttaaagtgacaagggttgcctagcctgaagattctagcacaacatcagcatcttacctacataaactgaagattcctcaagaatgttgaagcaatagtcattatgtttactacaggagtaagtgaggcatcaatctaccttctaccttgtgagttagccacataaagcagtgccacaggttgaaacaaaccttcttggtctggtttataatttaaattctccatggaagtagctgcagcttggaagctcattccattgaaaagttcactggctttggtgattcacaaaggagcatttcttatttggtgaattagtatcctaattaattcatttcatggagcaagcatctttgtgattctctcttctgctgcctactttctccctggcaggtacaggtaggattctaaagtataaagaggactttcacctggaaaccagaaggttgagttcttaaaggggtcatgatgcttgctagtaatgtgacctcctgctattcaatacttctgagtctccttttactcatctgtaaaatggggagaaaaaaaaactgtcctgccttttacccttttcttagcatacaagagttactgagaatgcttcagaagctattatgaaccactgtagcatcagctatatttatttaaggcacctattttgtatgttaaaatattctagagtatcttataactcttggttaatgaaactaaggactttctcactccttaggtaaaaaagtagtgtttatttcagagcaagatgttcaaaagcaagactaaacaatttgattcctgggatcatgccatcgggctgtcttgactctctctgattgctttcagtatttttattttattgggtagaagaacttggtaaaatgttaccctgaggctaaagagagctctttaaaatgactttagggatctgaatagaccagttgccatttattcccttaatatgattagtttcctaatagtcaaaggctgagatagcatttatttctcctaagtttcagtctaagccaatgtgggtgcctattagtgtcatagtgatgagtggcacagatgagcaaacagataattaaggaaaaccaaatatccttcccatcccccacctcacacccatttagtagttgactttggtgtaaaagtgtcttcctgtttcagtaggataatttggtgctcatctgtcagatagatggaggatggcaatgctaatttgtttctccaggcatacttgcctcagacttaaggactaaggttaccatgtagctcagagctgaaaggtaagagtcagaggcattcaatgattaaatagtcaatatgttctgacttctctgctaatttagcaaaaggaagaacatctcaattttgtcacttattaccagttgtttagcttgtcttagaaacatgccttgatttgaatagataaactacttttaaagcataagtcagcagccttttgttttatgaaatagtagtcctccatttggggcaattaaaatgaccatttctttggaaataaaatgttaaactggtgatggtagggtgaggtctagggggtgataggagagggaagttgagatttcaacagctaagtgcaaaagaaaattttaaaatacttagtattaaaatttttaacttgctactactttattggtctcatataaggacatgaacacctggggaagtaattggaaagggaaggaacataaaaaatattttatattctgtgaggtaaaaactgaggctaaaacataaataatttggcccaggtcatatggcaggagaatattagaatctggatttgatcctgcttttgtctggctgtggctgtgaaaattgagtccatcagttttcatcccatggcatctggaatcattgccccttgccacgtctttgtgtgtgtgcgcgcgcacgtgtgtgtgtgtgtatgtgtgtgtgcgtgctccaagttcatcccgatttctttaatctagccttgttaaaacacattttaaggtcagtttttaaggcacaaaatgtaggatgagtgagttgataggtagatatctattagcttgaaattgtattcaaaacagaacctcattcttaaaagtttaaaaatctatatcaattacccagcctcaaatatagttttcttctctttcaaatgttgtagaaaaatgcttcatattttctggctactgagcttcttaatattagagtaccatctcttcctacaattcggttacaggttgctcacttttagcgacattggctttctagttggagaaattccttagatttcaggtaccacatcagaatttctttcagttagggtgacagatccaatatactacatgtgtgtgaagtatagatgaaggtaatcagatctcatgcttcagggaataaactgattacccgcgatggtcaggaaggaattttcaccattagcatcctgcaaatacacaaacccaagtgcaagaatccaactttcttctatgtaaagttttcttgtagcacctcatcaagtgcagggcataaaatctaaacctatgacataatgtgctatgtataattgttgtcatacatgcatgactgtttattatgcaccaaaataaatactgtagcagttgagacagagtctagttagataactgagatagtgattcattaaatataaactacttaaaatcttttcatgtttcctccaggaatctcaaagtaccttcccaaaatgagctcattaatcctcatgaatattctgtcacataaattctgttacatttctctgaaaacataggttagtcaatcttactaactagtaagttctagcagcaagtcttcacagcactccaacacctttattgccttgaaatctcattagagatttagtttctaacactgttaatctagatggaattctttcatccctagctcattactacatttacccttcaacaaacatgtggtgggagtcaactgtgcgcaacgtgctgaatatgaaaagttaaatggggctcagggttcactgggaaagtgctggtaagttcattcacatgcactccagtacaacttggtatgcccagtgctgcctagcctagcaagaccctctttaatctactgttgccttcttgtacaggtctttatatcatgcgggctttgacacagataaacctactgtaatccgtgatttggttctaagagcctataatgaactccagttaattcagatgccatttagagaaacttggtcatattctaccttagaaaactcttggaataactttagttcttttgaaaattgcagtggtccagacatttttactctagtataactgctgtgtgtgtgtgtgtgtgtgtgtgtgtgtgtctgttgatcagaaactttataacgaggattagacttaaatttggcaagcttttctagataaattctagagaaaggtcccatgatgatcctagaaaatttaattaagagtaacaattaagagatccttttgaagtgcccatgtttaagttttatttgtttggttttgtatttttttctaaatattctttcagatcaaaccaagtctaaactggttactatttgacttaatgaaaggcctgacatgaaggaaggatgtaaataattttgagagaaaatacttttgaaatgttaaaacatttcttttgagcaatgttatttttattataaaggaaatagcactttcacctctgggagtgaataggggcttctcaatttgatacctaaaggatatttcctctcaagacaaacaaacaaaaatgtgcttactggggctgcaccttcagcccagcattggatatgttaattgctgacatacttgaggtctcactaagagaaaaatatcattagactgctggttcccaaaatacattcccttaaatatcagtcctatggagtggtccttgggaataaaaatcagggaacatattcaatggtaaatatatatatatatatatatatatatatatatatatatatatatataatatttatatatatattatatatgtattatgtagctctttattattattattattatttttgagacagagtctggctctgttgcctaggctggagtgtagtggcatgatctcagcttactgcaacctccacctcctgaggttcaagccattctcccgcctcagcctcccgagtatctgggattacaagcacctgccatcacgcctggctaagttttgtatttttagtagaaacagggtttcaccatgttggccaggatggtctcaaattcctgccctcgagtgatctgccttcgacctcccaacatgctgggattataggtgtaagccagggtagctttttaatactgctccctctctcttaggtattcacagtgcatattagcaaattaaatgttctgtgaagtcttgtattaagtacatcttttaatattttatttaagacttcccaaattcacttgaccattcactttgtaatattccttgacagaatacttgttaatatccagctcctgggaacacaatttgggaaatactacactaggaaaaaaaatctaggttggggaaatctaactaaacaagagtgtttatttacattagtaagttactttgtactttatgtgagtctccttttcaagtgagtttctcaagtgtcttaaaatactattttaaataatttttaaaacattgatatttttttgaaaatacattaagtatgtttttagaacttgaaattgaatgaattcccccttatcccttgtctgccagttctgttagtcttctcttcagtatttgatttatgagagatcaattcatatccaacttttcagagcatgtctcatgtcatgtgaaagacagcatacctatatttgtgtaagaaaggggagaaaacctacttctgagtgtaacataaaaactatgtgacagtcaagtatgataaaaggaaaatactggttatagggtcaagcaacctttatctctttttggcttactgtgagatttgggccaacaagtaacctctctgatcctgcctggataattgaaatgactattacttccctccaccagagagtgaatgatgtgtggattaaagtctgacctttgggcaaatgcctcctagtgacttgaaagaaggtgccctcatttctaacccacaccttacatctgtgtctatgatcccattcacagactggttctgaattaattctgtcagtcttgcattcttgcacttgccttcctgtcacctattcacttgcattctctctctacagttaggacattgtcaacacagattgtgtttgagtaaaaaagttcactcagagaaaaataattatagaaaggaaaagcatagatcaggagacaagtaaagacatacagtgaatctttaatccagagttgatttactcaagccttattgaaagataatcatgaagcaaaatgattaggtatggatgtgtaaatctgtaatgaatgactctgagtaaagattgtactcatcatcactagatttctctcataagtgcattgggttaaaaaaaagaattacctaagatcatttgaaattcagtaataagattctcttcagaagatcttttgattctgtagagaattaacatatctaattattatctgaagaccccaaacaccagatcctccaaaataatgttccttctgacattttcaacttgtataaaatttggttatctggaaatttactgcacataaggtccagcaagagaataattacactttattgatattttctcacaatgccatgagaaaatctggctgaagctgtgaaaaatgagttatatttataaaccagagatgttagctttccaaagtagtttcaaatccagacacccaatacacacacttccactcaccttcacgttctcacaaacttatacaagaaagtactcaatgatgtatttctaggcattaaatatttatatggtgtatataggtaggtatatatatatatgtatgtgtatttatgtgtgtgtatatgtacatatgttcacatacatttatgtatatgtatgtatatatgaatcataatttgctgataagcgttagacactattattataaatttcccttaatacacaaatttctcaatatcttagaagaaaattttcaagtatatgagagctcttctttctatcagcataggtgatagcattaaactgaatattaaccattccccagggtagagaaattatatctcagggtagaaaaatatatattttttgtatggaggttacttcttattgaagtgtgttagatctggccaggcatgctggctcacacctataatgtcagcactttgggaggccgaggtgggaggatcacttgaactcaagagttggagaccagcctgggcaacatagtgagatgctgtctctaaaacaaaaatttttataattagccaggcatggtggcacacgcatgtagttccagcagctagggaggctgaggtgggaggatcactttaacctggggatcaaggctgcagtgaaccagattgtgccagtgcactttagcctgggtgatagagtaagaccctctctaaaaatatatatatttttaaaagtgtgttagatctgcatattataaaatgacatgaattaagattcttcctccgtcatttatttctgttaaaaaaattcactgcttgcaaacatgtacatatatataaaccactgcacactaattatactgtatggtgtcacaagggtgttttttttttttacttgtaatgttttgcctaactttagagaaagcttgaaaagttaattaaaatcaacttatgtctcaacattttgttgcagtagaggaatttggaagaagggaaaagagaatagcaatgaattgattggataagaggcagacacatgtttttaaaaaaggatcagagcttgcccagtttctatttaaagtattgtaaggacctaatagctagctatagtgatacatttaagattaaaatgagcagatttggcggtacaggggagatgatggctagctggggatattagaaacagagctataaaaattcaacacaacctggaaaaatgcaaatgaatacaaccaacagtggggtgcagggttggttgcgggggacaggtggattatcttaggtgatatgctgtggaaggcatggagtttggctgcagggctgggtggtcacctagtaagaggaatgctttggctccttcccttgtctcttggaaatcagaagagacactgggccttttctcctttactccaagaagaaatgctcttttttcatatatctttattgaatacctattatggtccatgtgttaagagatggggaagcaaagagatacaactcatccaccctaccctggagaagcttattgcaaataccgtcaaatgcagtttgaaggaaatagtatgagatttgaattaaggacactaagattttattcatggattaaaatccgtattctgtttcttaatgattttgtgatcttgcacaggtccattaacctctgagcattagttatctgtgaaatgggagtaataattgagtctgcctcatgggaacactgtgatgactaaatgtgaaggtttatgataatgctctgaaaataatcaaaagtgctaaaatgatatggtttttaattatgaggtatttttaaatccaagcttgatagtagagtcagattatatacaaagggatcagagaaatagataagtatgggaggaatgataaatataggaagaacattatatacatcacagatgagttcaggtgcatgggggtcctggacttacaagcgggtgtgcttagtttaatgctctcctatcaccaccttgaaagttttaatattttttaaacaaaaggactcacttttttaatactaggcctcacaaattatgtagttagttctggttgtagacatattgcgtgtataaatacttagattagttacatgcccacaatattaatcattaagttatttgtgtatacatttaacagttacccatctatttatctatccctatagagacatattctcccatgtaggatgtgaggcacttgaggagtgaaacttgcttgaatggatctagggcccaggagagaaggcgaacctgaaaaacagttgttcggtctaatagttatcactagttggaagtcttgtacgttccaaggtcaagcgctgtgatgtgatacattacacacacacacatataatatttatttatatcatggaataaatgtgtaaatattactatattactaatgtatcttaattttcttttttacaaagatcctataatatcagtaggtctagaattaggtcaagaatctgcatttttaaaaaggcattccagcggcttctaaggcaggtggtttctagacaaactttccaaatactgagtgaaaagtttattcatgttgtgtttccattatttatgtgtaatttggagaactgggtgatcttttctccaggagcccctagcaacagatccagagaaagaatgtcatagctagcatttctttgtgttatttgggaccaatttcaaagttactgcaagatgtttgctttgccaagagatatcccatatccagtccaggccctattggatgccaaataactattagtgtacagaagcccccacttttccatgggggaaatgatctaagacccccagtagttgcctttaactgtggatagcaccaaaccctatatatactatgttttttccatacatacatgcgtatatacatagttatgataaggtttaatttgtaaattagtcacagtaagagattaatgacaataactaataataaaatggaaaattatgacagcatgctgtaatacaaacaatgtgaatgtattatagtctccctctcaaaatattttgttgtactgtactcacttatttttggaccatggttgaacaagggtaactgaaactgcagaaagcaaagtcgtggagaagggggaactactgtacataaagaaatagtggataataacaatgagaagatagattggggcctttaattctggataaaggatctgagactcttctcagaaggcaatagggaaccactggtcatacagaattaaataaaggagaaggaaacaaaaggtaaggagatcacttagaggctattacaaaaaaagtagagaagaggtaacaaaggccaaaagtgggcactaagagtaaagattaagaaaaaatatctttaattatggaaaatgtatggagattcctcataaaactaaaaatagaactcccatatgattcagcaatcccactactgggtatatatccccagagcttgaaatcagcgtgtctaaatgatatctgcactctcatgttcattgcagcagtattcacaatagccaagataaagagtcaacctaagtgttcatcagaggataaatggatgaagagaatgtagtaatgtggtatatacacaatcgaatattattcagccttaaacaagaaagaatttctgccatttgcagcagcatggataaacatggaggacattgtgctaagttcagaaataagccagacacagaaagactaaaacagcatagtttcacttatgtggaatccaaaacaatcaaatttatagaggcagagaatagaatagtggttaccagaagtagtgggtagggggaatggagagatgttggtcaaatggtaaaaaattttagttagaaggaattgatgataagtatttaagaaaatggatatattaattagtttgagttaatcattctatactgtacagatataacatcactgtgtaccatacaaatatatatatatgcaattatagtatgcccaaaaataatctctaagtcttctttttaaattttactttcataagaatggtatccatctgattgaagaccatcttctttcttctccatatgcaaatgtattccttatagaaaaatgcactcctgcccccaccccagcaaccatgcttcaggccccaaagaagttttcctccctgttaccttgcaaaggtagcctctcttgggaatcgctcactaattcaccctggaatactcttatgttagtttcccttatggtccctaacagcctttatctgttattcatctcccaggtactcacagcttgctgaaaggctttttctaatcagcattgttttgtcttctttaaaatccttgatcatggccactagcatccttgacagtctctggacacttggtgagaaaagaataaactcaatgcacaccagtgagagatcatgcccttttcttctgacaactttgtggcatctttggctgccctttttatgtgcttgtctttgtgctcccctacatcaatctcataaaacatcctttttttcatgcttgacatattgatatcatcccaccgcagataaaacacagagcagtgtaatatggacaggtgttggaattatttgcaatgcacagaaatctctgctgatgtttaagactaggacaatattaaacacattactttccctgacaggcattttcattacacccatgccatgcaggtgcagaatctagaagtgatatcttgttttccccaatagggtctatgcaatacaatttaaaagtgtgtttgggtgtgtatgtgtgtgtgcatgtatgtgtccttccccctttatatctttatctttgcaacatccacagcctcttgtttaaatcacatctgaattcacttggaggaatgacacaaattccaaagaacctgtagttaaaatagttgctatttaccagatcagtattcttatggttggtagtgtcacatggtcaggtttagagggcaactctgagataggacaagatgaaaaatagcctaggaaagatcaagaaagaccaacatcagaaagccacatagtcctccagagtgagttactatgtagcttagtttcatcaaaaagagaatcatggccaaggtggctgtattagtctgttctcatgctgctaaaaaagacatatccaagactgggtaacttataaaggaaagaggtccagtggactcacagttccacatggctagggaggcctcacaatcatggcggaaagcaaaagagaagcaaaggcacatcttacatggcggcaggcaagagaacttgtgcaggggaactcccatttatataaccatcagatctcatgagatttattcactaccacgagaacagtatgagggaaactgcccccatgattcagttatctccacctggccccacccttcacatgtgggtattattacaattcaaggtgagatttcgatggggaaacagccaaaccatatcagtggcaaattcaaatggctacagtaatgaaaacaacaataacagcaacaaaaggtaatattacttgaggatttatcttgtaccagaaacttttacatgctttacattcatgttgaaaattaaatgctggccaggtatggtggctcacgcctgtaatcccaacactttgggaggctgaggcagacagatcacttgaggtcaggagttcaagaccagcctgggcaacatggtgaaacctcatctctactaaaaatacaaaaattatccaggcgtggtggcaggtgactataatcccagctattcgggaggctgaggcaggagaatcacttgaacccaggaggcagaggttgcagtgagcagagatcacgccactgcactccagcctgggtgacagagccagactccatctcagaaaaaaaaaaattaaatgctcaaaacaaccctatcaggtaaatcactgtaattagcacctatttatcagatgagaaaaacaagactcataaaagtcatgtaacgtgtataaggtaacacagccagtgattcaagcccaggtctatctgactacaaaacttgggctcttagctttttgggattctatactcatggagaggtaaagctcagatcctagaagatcagctggagaagttagtgtatgaagtaggcaagccagatctgaggccaagctaagggcagaaaacaggagtcctgggccactcagcatgcatgctggctcaaaggagtgtgtttctgagcctagaatcttcactgtctcctgctcctgctaaatgttagagacctctaaaataaataattgcagtagctttgtggcgtgttttaattggctaccctctgggttccattagtaggtttacttactctaccctggacctaaagctgcagtgagggttgttacctccagcgaggagagtatttatcatgccctctccagaggtaactgcaattttgcttaagtgtactaatggcatctgctctcagctctgtgtttttcctctctgggtcttctgataaggtcattaggaagtgtgaggcagacaacctgagggctaaagtctcattcagctccatcagtcagattctgctgggactgcacaacccaaggatcctgttacagcatctgcctggaagattcttaagaaggaacttgcagttcattcattacatatgttctatgctgaggcataacagtggaggctgttttacagtgtatcatgccaacagtacatctgctgctggcaattatgctactaacatacaggaccttaagaactcttccttcccatagtttcactgagaaaaacaaaatcccagaagaatattaattgacattaatatgacacaattaaccatttattcaattggcctttccacctagaagtttaagcattcatctttcctgtatttcagatgaacaaaatgagataatgcattcatatactgattcagcaaacatttattatgacttcccatgtactgggtactatatagatatgcgagattaaaacaaagaaatacaatgtaaaaattcagattcttttaaggattccaccgtctactaggggaaacagatgcaatgatgtcatctataatataattttctgtgttgtgatagaatcatacataggacagcatccaaatacagcagataagcaactggctcagctagatttgggaggaggtcaaggcttcatgggggattcaatacctgagcagggtattaactaagagtgtaacctatataaaaggaatcttttttttgagcatttactatgtgttgaactggatgcagagtgctttatgtgcgttgtcataatcctatgcgtaaaacaatccagtgaaatctgtactatagccacatgtctcatgatgatggggatacattctaagaaatgtgtccttaagtgattttgtagttatgcaaaatcatagtgtgtactcacacaaatctagacgatatagcctgttgctatatggtacagcctattgttcctaggctataaactcatacagcatgttactgtactgaatattggaggcatttgtaacacaatggtaagttttttgtgtgtctggatatatctaaacatagaaaagggatagcaaaaacatggtattgtaatcctatgggaccatgatcatatatgcagtttatcattgatggaaatgtcattatgtagtacatggctatattattatcatattataaaatttccaagtgacaaaaaaaatctgaacccctgctctcaggctccagatcccagcttttagcagatatgccacactatcattaactacggtgtttcgcttaggaacatcaccaaacaaagctacttgttcttcaaggacccagtaatcatccttatccttgcacaattatcctggctctatcgtttgatgattttctttctgcaactaatgatttgggtagaaagaaaacctgccgatagtcatctttgatattgactggtcagtcccaagatctaggcattgaagtttctaagagtctctctccagtcctctatattgttctctgcatactcctccaatgtggtactgtactatgcagataagcacatggatgtgacctgatcctcctcaatcctatgctccctgacatctaaaatgggcccagaagcaaaacactttgcctgccgatttgtgcttttcagaagatgagcattttcttttacattctggacacacacataaaaaaacttttctatcattaacctgccacagccttatggaaattctgagaagtccagttcagcctcataacgcgtgaacgttatttatcttgaatgctgcaaatttggcatattggtggggggtgacaaggttaggtagatttattagcatcctgtcaggaaatttcccatgagcggtagaggtttgtcagaaaattcagtgtaattgataggagcaagttggactaattcttagtgctagatctgtactggctctgttcacacctttcctttgcagacaacaagatgtgctgaggagagctcattaagaagaccttcctgcaaacccattctttgcaccaggtttctttttccttcctttcttttatataattatttcagttactggagaagatataagcgtatattggaggcattactgaataggcaatgatttcaactcatttgtatgtatcttttaagtctccaagggaacacttaaactctagggaataaggattaacaagaagccgatatctgttcagtgtttcgctctattttcactaaaggattagaggtttcaactgtcgagtctaaaagccatcaaggcaggatataacagtggaaggaggttagcttttgaattaggattcttgggtcccagtctcaagtctccagcctgcgagttctttggccctgggacagttatttaaacttgctgagctttggtttcctcctttgaaaggtgaggttaatgatgcccatctcacagggttcctaataaatattaaatgaaatgaaaaatgtcacagctacttgacctaagcatctttcaatctctagttccagcactgctgcccctgaacagccttccttgatgtggccaagtaataacagccaccatttattgtgactttatgatgttgccacactctatgcaccatgctttgcatacttcatgtcattgactcctcagaatccagagagacagggagagaccatgggaagagaaagggagagaccatgggaagagaaggagagagagaagagaggagtagggagagagagagaagacagaggaaaggaaaaagaagagagagaaaaaagcgagatgagagagaagaaagaatgaatgagttctcatgtaattatggtcaagatattcatctttcctaagcctcagtttccttatcagtaaaacagtaaattatcacgtcttaactattttgatgactaaacgaggtgatttctgttacatgcaacccacagtgcctggaacataataaatccctaataaatagaataaaatattgttgtttctgatgataagtttcatttttgttgcaagcactcctggcacacattgcattatagattccatccactgattttccgttgtttatttcaatttcttcctcctctactagtctgcaaggaggccagagtcctttttaaaaaataatcactgcgatactgttcatcacacagaaacacacataaattgtttttaaaggaagaaaaaagggaaagaggaaggagtacaggcgcgtgtttggtaaggtgtcaagggtcataggtccttagattctactcaggtttttcttcataaagatgccatttctattggaaagtgatggctctgcctctgaaaacatttcacaaaaaccagaagaggaaaacaaaccaaaaagaaatattgctggaacactatagtgtgggcacttcaatgtagttttcctattccttatatttttccatagttggaattgacactgtaagggacacttttcacaaagtagcatattcccatggctggaacaaaataaccaactttgcaaagggagttgaattacttccattccttgttaggctaaaagccatttggcctagccagggataattttggcctggaaagctcagatttctaatctagcctgactgacctattcccagttccaagattttccacatactttcttccctcactcatggagcgattacatggagttaaatacaatacccttagtggaattgtttggtacaaattgtggtggcattgactctgtccgaggttctgcttacattctgtatgcctggatgctagccgatcctctccatccagtggaatccagccttgtctttatctagcataaacctcacccttcccttgtgatctccaaacatgtgaacagcctttttttaacacacacacacacttctctctcttctcacatcatggccttctttaaatgtcaggtgttttgaaagaagttagaggcctttagaaagtgcaagatacaagttaactctgtttaaagtttaatggcaaaaatcagaataaagcaaaactggatcaggtttacagatgatgagttttgttttccctgcaacaaggttaaaaactttttgagacaacattttaaaattgaatagtgtagataaaaatgagctgtccatgaaaattattagctactcttggcaaatcagaagacattgcaatactagacttgcattcccatgtagcaaaaaatttgctagtgattattagtgattgttttggacattctttgggtatttacagtccccaccattgcctatcatcccactaacaccaaagccaactgccagttctagtaataacaaccaaatatgaaaatgcttgagcaccagaatttgtaaacccagcccatgaatttgcattacctgcttgacctctggggtcgttggttttgcaaaccatactgtaaaggaaagaaaaaggaaaaaccaagttagatgtgttacataatactatttcattatattatctcttttttctcccttctacacttttcatttaccaccactccccaccccctgctacctaaatatctttatcccaatggaagatgcgttaccaaagattcacagtttatggaccagaagaaaaatgtggcttctaagtaagtcctgcagtcttatttctcacttctgtcattgacagccactaaatcaagaagaggttaagtgaaaattagcaaaatatgcattgccatactaacaggcagtaatagaacaatctgttcatgtccccacttcacaagtccactttcccaaaactaatcaaactcttccatctgtggaacttgccacagcaggtctttttcagcaaagaaagagcaacaagtttccctgcacatattttccctggcagaaatttatcaccttatttttctacatttcaaaaataaatattttccccttatacctttcccaatcttattttaaaatggaaacagccaaaagctaggtagttgtcttattctcttttattttcattgaaatcatttcctagactgtatacatacacattatgtatgtaatttatgaagttttgtttatatgagaaagcttcttttattttttaacatgcatttatgttgctttttgggctaatgtccttaaccttttcaaaacccaggagtttttccacctctattcttctgcatcacaagaccttacattgtgtgtgtttactggccttcataaaaaaattaaaaaaaaaacactctaaattcacatttcaccacttgttatctatcaccctctctcatagcttgtgatgtttacaaatgcttctgaagtattcagtccctagagtgagctttctttgactggtgggcaccagtacgatcatagttcacagcagccttgaactcctgggctcaagtgatcattttgccttagcttccaagtagctcagactacaggcgtgaaccgccatgttcagttgaagtccacatatgataacatttctgcctccacttaaaaccctccagacagcccttcaatgacctcggcttacaatacaaatgtgttatgattttccaggcccttcttcatctgctctcccttccttttgagcattatcccatttcatgcccccacacagattctagccataccccatgacttacaatttcccacaaagaatgcactgtggctccactccaggactttgcccatgctgggtccccttcctgaaatgccttctagctgttctctcttccctgtttgctgccatttccgtggacagactatacttgtctttctgttctaattgctctgaaatatacctctggccccccagctttcctgctcccccatcccctgtagtccttctagttttcctgtgtccccatgggacttctttatcctttttgaagcacctatcacactgagccataactgcatacctttctggatgtctctttcagtggaccatagttgcacactctcttcaggaagtgcaacttgtttgtcagtgagtcgccaatgccttatactgtaaccaaaatgcagattcagtcacttgccacctgccgagtccaattcacaagagcaagttctagtataaagaaagtgactttttattccaaagctagcttaagggaagaagtataggcttcctgccttaagagtactgcttacttttggagcagaaagcaggcacttttaaaaggcatcttggcatgaatggctcacaggggagggaaatgcaggtggggtcatgtaactcactgcagtgcctaatctactgcgtggttgagctggtgacagctggtgccttcatgggcagaactaggttgtaaacgtggccaaaactctcctggtgggagacagttttgtagcaggcacttcaggttgtacattgactgttgtctctcgaggtgatctcctggtgagagggagttctgctctggagcttctaagcacatagttagatgaacttgccctgtagggagtgtctggaaaaaggaaggtaaaaggttataattgcatgtctaaagagctaagtaggaagtagggaaaaaagaaaagagaaaaaatacattatctcttataaaaatgggggtactcattacaaaactgtgtctggcacatgaatgttcagtgatgttgactgaccaaggagagttacaaaacaaaaacttggaagtgggaggggcatagcaatcagggtcccaaaggaaagaaggcatacacaaaatggttacatgaagagaaactaatgaagggatttatttcccaggtaagaaaattagcaagtgctggtgaaacacttagggatgagaaaatgtgaaaagtctcaattgtccctaggtttgaatggccacagaagacaattggattccatgaacatggctggtgttgcaaccttgtgagagaggcaactcggttatcactttggtcctaaataaaataacccagctactggcacattcataacacatcagggagggttctggaaggaagaatgaataaatgcccaatgtttctcttattgagctctccactgccaaaatatacaagaagccagaggaaaaagacagtcttatgatgtgatctatacagcttatagcagtcagcctttctagtgggcagagaaggaaaggaagtgaatctgggatgaaagtgagaatatctaacccagtgtacctgcctagcagcagaggggaatctttgactataaaaatgtttcgttgttaaattttgaaataataaatgactataagcttttcataaagtatatacctgtattattaatgttcttatgctaacatatctggttattaaaaaatggtgcttatgcactaataaccaatcagtatacagagagctgtcaagtcactcatctgtaagtgctaccagctggggttaataagcagaactgtgacatgtgaatatttccttcatgcaaacataaacagaaatttgttttattttaaaagatagaggaattctaaatatatagtaaaaatagtaagtgtgtattccagaaaatcttagcaaaaagtcagaactaagtaaatgaataataaatgagtgaatgaggtaatataattggactacagagactaggcaatgtgaaggagagaaatatgatgtaggctttgggaacatgaaaggtagagtttgcttacactgaaagaaaagatagagaaaatgtgaacaatgtgacaaggatggatgttattaaattttcatcctaaattgtaagattcttgtcctcagagaaggaaagagggaggaaaactagtatttattgagtctctatgatatgctgagagcttttacaaacctttgcttgtttaattctcacaagtcactatgagtattattatctcatttttacagtaaggaagccaagacacaaagcagttaaagaactcactggttagtggtaaaaaccaggaaataatcccagattcatctctcagaagcccattccctgtttgcataccatgcaacattcaagaatctagtgaaggaaataacacacctatcaataattatatatccaagacagaatgtaaaaatactatgccagaagtagacagtgccttggtaacacacaggacagagaaactctaatcaggaattctgatccaatttcatgcagtggtggcatttaaataagtctttgagagatttttgaaatttgaatatctgatagacaacatgacttaaaagaaagaatcattttatttatttttgacaccttggtacttgacacaatgtccatcaaatagtaagtttcagtaactcaatcaaaaataaaaatgggaaaaatgacatcaggtgtgttcagggaaatggtgatttgttaaaggtctggtagtgagtatgagggatgggttagagtgaaggctacagctgacatgataggacagggctagtttgtagaggattttgaatactattatgcagagttagaactttccataggtgtgaaataagtagccactgaaggattttgtgcaaagcagtgaaattatgtgggctgcacattaggaagatttctccggggaaatgtagcaggccctattcgagaacagtgttggcagctaagaactgcattagtatgccattgtattcattcaaagaggtactagggaatgaacagcactctgagaatgggaaacaggggccgagctgaatgatgctgtggagatagtcatttctctagtttagatagggagagggaagggcgtctttcaagaaatgacttcagaattttgagcctgaataaatggaaaaattatgatgtcattaactacagtatacaacgtacaataagtaggggtaaaatgaggagtgaaaagtaataaggaaaatgatgagtttggatcatctgtagaaagaggtccagtaggtggttatggttcggattattggatgacatcacagatatagatctggggttcctccacttagaggaagtagctgaatccatgggaggattcacaggtggtgaacaataccattgaggatagagctcagacctgggagagcacatttttaagtgacgggtgataggagaaaaactaatgggatatttgaaaatgagaaattgtcaggttcattgcactattacccccatttttctctcttttattctctcttttctttttgtttcttttcttttcttttttttttcagggtcttgctctgtcacccaggctagaatgcagtggcatgatcatggctcactgcagccttgatctcctgagctcaagcaattctctcacttgagcttcacaagtagctgggactgcaggcacaccatgcccagccaattttttattttttgtagaaataaggtcttcctatcttccccaggttacatttttctctttctgatagtacctttatctagaacactaagtagctaatcctttctacaaaattaaagatagttactttagttgacagttaaatatcctattgtacttaaagttcttgtacattccgacgggttaatcagatgcctccaattccacctctttcaagggtggtgtatctgaatgtcaaggtgattggcataacactaatgcataataaccagaaatcgagtttatcttccaagatcttaatagaggatcctcctcaagagaaaacctttcagacatatcagccttacaactggaatctatttacttttcatttgtttttcaccctatttatgtcattttcctttttaattgccagggatatttatatggaaaagagttttcctcttcttatttctgtcagatcttgtagttgacatcttgtttcattctgtcatgccaatgattaaagctcagtaaaatgtccattttgcatatatggctttctaaagatccatttggaggagatcagatgttaaaagagaggatgtttgttgggggggtggtggtgggaggtgggtagggatagtactttagaaactgtttcagatctaagagggaattaacaggatttcagagggtgcgagaaaagtgggataatgttaagtattacattgaaagcagcgaatgagacctttccaaagtgatgacaaatacaacagaggagtgagggctggggcagtcagcaacacaatttttccactcacttgtggagctagaacataccttccctctgttttgtaaagatgagcctcctccctttcttagaacatttggagaacttcataactttcaatataacattcaagacatacttcaagagttgcccagccacatccattagtctaggtggcacctatgtggttcagtcacatctgtatgaagacttgaagactcccaaggaacttacatcagaaggagagaaaatggggttcttcatggaaacttgccatggatgaaggtacaacatgacccattgactagaccaagtagcgtgacctggatgttgagggaaggaggtggttccaggtcaagtttgaaactggttctgaacattcctagatctgttctcctgccttgtctgtgtgttttggggaagagattgtttgcaaaagaaagaatcctgtcacttgtgtctttactgttcttctgtgggaaagggctctgaaaggattgcgttttgacaggaggaaggtgttgaaccactactcgtagatagacagggaaccctgtgcggccatagtttaggtatggttgccagttctgtggggaatacagtaaaagctttcaaggacaatgacatacgtggcctccagagcatgaggctagaaatctgacatatgcgagaaggtcctctctcacccaaaaacttttacagaaaataactagggagggacatcctagagggcaaaattagacttcttgctaaccaagtgtattagtttcttcttatattgctactcttattcttcttatactacctgaaacagggtaatttatgaagaaaagaggtttaattgactcacagttccacatgtctggggagacctcaggaaacttacaatcatgatggaaggtgaaggagaagcaagcacattttcacaaggcggcaggaaaagaaagagcgaggcaggagctgccaaacacttttaaagccatcagctcttgtgatgaactcactcactatcatgagaacagcatgggggaaaccacccccacaatctaatcacctcccaccagatccctccaacatgtggaaattacaatttgagatgagatttgggtgggaacacagagccaaacgatatcatcaagcaagtgggtgcccaaaacattgaggcaaattgtggagtttctttaagtagaatacatttgtaagttcatagtttcagcttatgaactagctcttatttgatcagcatgagagcatctaaaagagaaataataaaacaaatggatccatctctcattatttccattccatggtctaacttatttttttcttgactacccttcttcctataagaagaagaagagaaaggtctgagaaaaatatgtgcccccataacactctggggcaacctgaaggccatcttccaaaagtcccctctgcctttctcagagaagagattgttaggctgatccatgcttctgtaacacacagtccacaagaatgcatggcatgcagtgacaaaccaagaatattctgataatctcagttgaatctaagcattctatggcagaaactcgcttttagtaatctgctatctgttaaagaaagaacaatttggtctcaagcagtggggaagatcagctcatttacaagactgtcacttaatgaagctccttggtgacttttctgtgatgaatttagacattgaaaagaaatatttcacctcttcactctgctccataggctcaagcagaaaaaatgggagacattgtatttctagtttctttcatccaaagctttgctcacttatgttgacattgtgctgaacagctgacgaacatgcgggcaggccaaggaggatgctgtcttactgttggactcttctctgggcaaagttcattattgtgctggcctcagaccactttagctgccatcagttgagaggaaaagaaagaactgcattaaaaagaatgtcttgcattacaggctttagaggggaaactagtgaaaaaactgctgatgctttgggaggcaatttcttccctccctgcctgcctccctccctccctcccttccttctttccttctttccttctttccttcctttctccctttctcccttcctccctccaactcttcctccctcccttcctttcttccctcctttctagtagatgtctctgattctacctcttttttcaattgatttatgtgcttttgcttggcaagtttgcgctaactcccataattgcttggaagggcggtgttgatttaagccttgtttcattgaaggagaatagcattccttctttcataacagaccaattaaagacgacacaatgacttcttctttctgtaagctttccttgattccctgagccaattttgaaattaaactcttcttcagtcctcctaaactcattgcacagaaacaatcacaaactcacactgtcaggagtggcccaggccatctggttccactgtttgcaagcctccatagtgccgtcatagaggcatttccacagtattctagagacactgtaaaccttctccataataggccagattttcctagcagggactaatactagctgatgatagctaataggtactgattgcttaccctgcctggtgttttacagatagtgtttaaatggcagtatagggttaagagtatgacaaccagagccagagatattgggttccaatcctaccatttaatccctgtgtgaccttgggcaagatgttttacctttctaaaccacagttttcttctttgtaaaatgggaaaaaatttagctactgcaagttgttgcattaaatgagataatttaaagtagaatgtgaatcgtaatacccagaatgttctaaaaattaatgttaattatcatccttattatccattgcttatctccaaatgctttagtgtaattttcaacatggtgctacatagcgaggattatgccctctgaaattgtcacacatcaagactggtggctgaaggccagcaaaatggtaattgtgatcattatctagcacattttcttctctagaagatggattttaagtctctgctcataagctgattggtagtgctgccttagattggtatcttctgttttggggaaagaaggtgattttgccagatttcctcagttttgatcattgggaatatacaataatggaaatttgccatgggaggctgggaacccataactaaacagtccatgataatcctatatccaactcttggaaaagggaaaaacaacacttcatctcaggattgcttcagggtgaatactgtgcctactacccatattaaatgcatttctttatgtccatccctcctctctctctctgtctctctccctctctgtgtgtctttctctctctctctgtctgtctgtctctctgtctctctctctgtctctctctctctctctctcacacacacacacaccccccagaagagcattttggccacttaaaggaatgctgtgaggaattacagattttgactgcgtaaaatattgtgcgttgttccaagcaaaggtaaaattctcaaactgttgaaattgtttttatcagcactactcctaatcataattactgttgtcattagtcagtgttgggtaccactaccttctgtgataacacttaacacattgttagcaattacacagaacttcccaattctgccagctccatgctacatcatcaataccatttcctgtagtagagtgccccctagcacctccacgcttctctcagtttaatttgctttttgagccccccaaagagagactactaaatatcaaaggcagctttcactctttagggacttgggctttccaagtggttaagtgcccagcattaatctcctgagatttgttcatctgacttcacagcagctggaacagggacagagatcttttggacagcctgttctgccagaagcagagcaggtggctttctctcgggtcacaattgaatttaaaaatcccattaattttgtcaagtcaacttaattctcttaacctgataattatcttcctttggaaaaagaacaataaaagagtaggcagacctctgttaagcaatgtttaaagtgtgtgtgtgtgtatgtgtgtctgtgtgcacatgtgtgtgtgcatgcatacatgtgtgtgacagaaagagacagaaagaaaggctgcctgactgattataggtttataaggttcacttcttagttcatctctgaaaacaagagattttggctgctgtcttatttgtccttaaataatttgggtgatccacctgggcattaggtcacagccttgggccctctttttaaagcacttgcatgcctgggaagaaggtggtaggctcttacagcagcaaataagagtgtattgcttaaacctctctttgaaggcagggagggcgagggggaggtgtgagatattttaaaaataagatgtgctgctaaattctctgccaacctccgttcatgctgagtggagtgtaagtaacaagtatcagatagttcctccagatgtcagctatttaaagagtcacatgctagaagttctgtggatagcaattgtcttattcctggtggtggtggtggtggtggtggtggtggtggtggtggtggtgatggtggtggtggtggtggtggtggtgatggtggtgatggtggtggtggtggtggtagtgatggtggtggtggtggtggtggtgatggtggtgatggtggtgatggtggtggtggtggtggtagtgatggtggtggtggtggtggtgatggtggtggtggtggtggtggtgatggtggtggtggtggtggtgatggtaatgatggtggtggtggtggtggtggtggtgacgatggtattaggaggtggatgctgcctcgcagaaacttttatcagcaagaaagtgtgggaatgtgtttgtgcatttgagaagtaagacaaattagaccagagggaaaaaaatgacctaataactcaggaagatcatgatatcaacctttgtacaagtaacatttgatttttaaatgtataaagcaagaagaatgtccaggaactctcaattcctgtaaaattattgtattttccttaagaaattaacttataggccgagaaattatacaataaggaaaatgattcttattcaattttaaacttttctctactgctttacctaaaatagactggaaaaaaaaaagttgtgactgttctcttttgttatctctttgaatcccagtggtaaaggacttcttcctacaagacataatgaattgatctgtttaagttagtaatcactgtgaggaagtggtagggtcaagactgattagagtcttcagaatttccccaccagttcaaatgatgttttcttacactcatgcttaaaagttctgcataagggtcacaaaaattgttaagcttcatttcttctcttctcttctttatttaatttttggagacagagtcttgctctgtcacccaggctgggatgcaatggtgtgatctcagctcactgttacctccgcctcccaggttcaagtgattctcgattctggtgcctcagcctcccaagcacctgggattacaggtgcgcaccaccacacctggctaatttttttgtttttggtagagaccaggttttaccatgttttccaggctggtctcgaactcctgccctcaagttatctgcccatctcggcctcccaaagtgttgagattacaggcatgagccaccacacctggcccattccttatatatttttaaaaataacctgttcttcttcagtttctacaaattctggctttattcttttgcttaatttgaatttcagctgtgttaataaccagagggactccaaaggatgtagttttataatttctctgagggtcagttcttccagttttatatggaagagaaataagatagctcccagctcttggctcattgttggtgacaaactcaagtaacaaacactgcctttctaatgggagatatcattatgctcaattcctcctagtgtctcttctaaaacagatactcagataaaacacttatctctgggagaaacagataggcagagaaaagaagggtatgtgattaagtgaaggtagcatttctagaactgaaactttgtcttttccttcaacttccatggcccttttgagtaatagaacaaagtagagataggtttggttgtgtcaaacacagtgggatcagatgtccttcaaacagactttgagagacagtgtggtcatgggttttattttttttcctcactttttcttttctggaatcttctgcaggcatcccaggttgagacacttgcaaaaaaaagataagaggcagctatacaggggagaatcgcaacctgtgtagtcaccatgtgaccacttgtaaaacagtcccagcatcccatcttagtttgtcccttggtagggcaaggaaggttgtgagcttttgttcgtgatgttaaataaagaacattgtgtgtcaaaagaagtagacttccttatctgctgtttacagctatgaaagaggaggtgttggtctttcttctaagctctatcttccagcttttttttcctaccttctgtttcacatgatctcatacagaaaacttctgactttccaatgtagggcttgttctgttgtcagcatttgtagtcagcatttctctagtgtttttctaaaacccttatctgcagggaacgtcaacgtggttgtagcatcaatagaataaggttttagttatatatatatgtatctacatatatatagttatctatatatatagctgtatatatagttatctatatatagctatatatagagttatatatatatagctatatatatggttatctatatagctatatatatagttatctatatatagctatatagttatctatagatagctatatatatagtttatatatatagttttatacacacacacacacacacacacacacacacacacatatacacacacacttagcttttctgtttcaactttgagtcataatgttgaatgaaaactgagtccaagattgatattctggggtcatctacatggagcactgaactatcttcagtgcattacatgggaaggttagatattggtaagaaagttaggaaatcaatctaatttctcctattctgtctcccccacctttccttttaccgtccattgtgtgcagaattcaagagtgccattcactcagttgtgccagagcataattgctgataaagtagagctgatgaatttgcactatggaatgatcctggtcatatgttttcctgaaattttctcaagttttgcaaatttattttctatttcatacttgtctaatatttttgatatgtacaaatatgtatctaccttattactttagtgagatgggactcatgttctctcatacacaaatacatatatcttatgtatttaaaacatatccatatctataaattatattttataagactcacatatccatatctataaattctattttataagactctagctaaaactgagtagtgttttaagaattgttaaaaaggcagacacgtcttgggatgctagcaggtgggaagtatgatctgtccttaataaaacatgattaatctcacaaaaaaggaaaaactctcccatttaaggcccagagaactaggctaaaccagaaaacagagaggcttgtgttggggagtacttttgacagatccctcacccccatccgcacagccacccacaacataggtgtatattgtctctgtatgatttcgtatctggtgctgttctgcacttctcagtttgggggctgaattcctcagcatccttgccacattacagaaatagaaagcccaatatcatagtcacaccaccaccccacttgccacccacaatgtaacagaagagcaggcagccctcagtttccgaaagggttgtattctcaatgttactttataaattctcagagctcagattatattttccagagaaatggtatattctctttccagaactcaaacacctactaacccagaatattcccaatgtcctagtcaagagatactatagtcaagtacctggccacataggaaatgctttctaaaagggtatgtatttggaattttaggttaggataccaatgacatatttttcaccattacagatttgataacaagatctgggctacccaaacacctacttgctgtctgcaaagatcctaggctagttagttctttatccaggttcatggcaaagtttgagaggagattcaaaggtaagaaaggggctccagctggaaaaggacatggtgaggtgctggacttgatgtgctgggaaggggtgaggaggagggtgagatatatgtgaggggcataatgggagcagtgggaattgggagacacagggagaagaaacgaaagctgaaggagtggactttgagggttaacaaagaagagaagcagaacataattcaattcaattcaacatactttgttgatcacccaatctggtatgtgccagaaaagtgagcaaagttgaatgagatgtgttctccacaggcgagatctcctgtaagggaaggagaaagggacatatgcagatttgcattcttggagcagatctgttcggttccagactagagatgcagaaagggcacagagaaggagagatttatcctgacttgaagatgaggggacgtctcatggaagaggaggcagttaagctagacctgaggatgctaagtgcctcacataagtagggaaagaaagcataagtccagtctgggaaaatggtgagtgagatgaaatcccacagataagaaaggtgctgtgtgtgtgtgtgtgtgtgtgtgtgtgtgtgtgtgtgtgtgatggggtgggggcggggggatgacaacatgcctacagaatacagggggatgtgaaagaacaatttaccttccagaataaacttccttctttagcactatgcacatattatcttggcctctaatgagactgcaatcctgcgggcaagttgtggttctcatgggatagaagaagtgaggatgggagagggtaccgaggaggggctctgggactttgagaatttggcagtttggggctagtgggcaaggagatttttcccacttcttgcttctctagatcaactactacctggcctattgtatgactctcagatgctaatgtggtgggagtaaagaaggaagcatgtccttggagcccagattatatttcagggtatccaaggcatcagagaagggaaacacaggggaaggaaatttttagaggaaatgtggaggcttggaatgctccacatttatacaatgtttacacactcaacattgtataaaaccagtatgaaagacaggattagtctgaatttcatgaaacattctcttgggcccctcctgcccacaacttcttttaaaaggaaaaatgaagtgcccaatcctcacatttcttcccatgcaagtgaacccctgaagaatggatgctgaggttggggctgctctctgatcagcaaattctgagatactagaaaaaaagaaggaggaagaggaagagaagcatgaggaagaaaaagaaggataagaggaagaaaaagagggagaaggaagaagaaaggaggaggaggaagaaggaaaaggagaagaggaaggaggaggagaaagaggaggaggaaggaggaaggagaaaggaggaggagaaggaggagaatgaggaaggagaaaggaggaggaggaaagaggatgaggaaagagaaaggaaggagagaggaggaggaggaggaagaagaagaagaataacaagaaggagaagaagaatcatttttccaaatatttgtcaaaagcataatgcttctattaaaatgttgaagtgcatatttatgtttcaggaatttggggagaggacaaatgtgtacaaggaggcagtcactcctgtaagtgctgcacacatacagggccttcaaagcaaagagagagttctgcatttcagggaaggcaaatggctatggacattcacagaaacctggagaaagtggatggctcctgggtggatagcaacactgataggtacaaagcgaagaaggaggtgggtagctttcggactctactttatcatcttttagggcctgtgtatctgactactgctgggattgaatctgctggatgtctacagctggaggttaggggatttcacacttaaagtatgggtgtgtgcatgcatgctgtctgtggcctgtttgtttgacctcagtcttaatgatgaactaccaggaaaatggaatttgaggcactcactacctcttggccattcctcaagtgaaaggacacaaagactttatattaagatttatagcaacttcaaagctataattttgggtcttgaacacatcctttaatggaattcttttgttaaccacacatatagaaatctccatgttttcagccacagaataccacatctatataacagactaggcaaatattggcatatttcttttaaaagattaccaatcttaccatttaaatgaatatgctgaaatttaagtattatgttcatatctttacactttgaaaaacaggaagacatccctctgccctagctcaggagctcaggtgaaatgataaaatccggggaaaacatgttttggtactttggtaaatgtgtgtgtgtttatctcattcattagtaaccagagacaagcaggaacatgttaaccatcaaatcaggaggtgggagatcctggatctgatttttacttgtttctatccatttttgagcactatgcctttctaggatttgaatttctcctctgtaaaatgagggaggtaataaatggctcttaatgaaaggtaataaatagtaataaatgaagtaataaatggttcttcaacatttctgggtcacgaagttctttaaaaatataaagaaatctttggactttttttccagaaaaaaaatgcatacccaaagtaaattgaatatagttttggaaaggagtttttatcttatcctaccatagatattatgtactacacaactccgggggcacaattcacagactgtggtgtaaatgacaccaccttggaggtgggcaaagaggtgactctctttatagcagtaccttgaactccaagctaagaactcttttgccagatgagctttaagattctctctggatctgaatttcttcaattccagaaatgtcattattattaccaacaaccctatactaatctggttaggccatctttacaaaatactacagaatgtgtagcttaaacaacagaaatgtatttattttattttttatttttatttttttgagacagggtcttgctctgttgcccaggctagagtgcagtggtgactcacatggctcactgcaacttccgcctcccaggttcaagcgcttctcccacctcagcctcccaggtagctggggttacagaagcccaccaccatgcctggctaatttttgcatttttagtagagacagggtttcaccatgttggccaagctggtctcaaactcctgacctcaagtgatctgcctgccttggcctcccagagtgctgggattataggcatgagccatcatgtccggccaacaataggaattcattttctcacagttttagaggctggaagtccaagcttaaggtgtcacaaagttaggtttcttctgagatctcctctctccttggcttgcaaatggctgccttctctgtgtgtttacatgatgtgtgtgtgtgtgtgtgtgtgtgtgtgtgtgtgtgcgcgcgtgcatgtatgtccccaaactccgagtgtttctttgccttcttataaggacaccagtatattagattagtgcctcacccttatgacctcacttaaccttaattacctctttcaaggctgtatctccaaattcaatataggaattttaagagaacacaattcagtctgtaacaaatcccaaactgataaacacattgcagagagtaactagaaaaatcaaaacatctttcagatcccttctacatgcaaataagtctatcaaaaattagaatgaagtatgctacttttcaaaatgggaatttatgataaataaccagaatttatctgctactatgcttactaaaggggaaactgttacagaggtttatttagtattacatatacacgcatgtatatatctagtatatatgtgtgtgtatatatacatttatttaaaaactaacttgatgttgtataaaataaattaacttttaaattaactggccaaatgtcgtatatagtaggacaaagaatgagttaagatggaaaaaattttaataacctataaacattcttagtttttgtttttctttgggtcctccaagtgatcatcttcgtgtaacataaatcaaacaaccaaaaatctcttccacatctggtaagtgagggtaggaggaatgggggttgctcttttttttttttttttttttttttaaattttcctgatttttctttaactataatggaggatcaggggctgagaagaaaaggccaagagtttcttgtcatttttatttatgtatttattatttctcccccagtgccacatatagtaaccaccaccttctgagtaattcccgaagcaacaaccattctacaccccacccccagttaccctagtgccaatggtagctaaagaagagaaatgttcaagaagaagatttacatattgctggatgttcttattcttaaagcctcaccacgattctatggctgtatagtccattcagcaatgagtcaagcctgtgagttagcagtgttacagactcaccaagaatgtatggcaccacccaatagcatactgtcctttcatccttttttgctttgcatgtactgacctttttctctattcatcttctgtacaccgacaaggtatacattttaggaaattacatctatcaggcacaatgactccctctgtgatgtttcactcccacgcaacactcccttggatgaaatggcttgctctctgcctgaattgggctaagatatatgcctgctgagggcttctgccctcccatctctcttctaccacccctgccttgtgaattatcttctttattcctagggaatctacagtaaatactttgtcatctatagtcatttgcttgaaattaacaggtgggtggttggccaagcaaggcaggagagacgtgggacaggaaaaataaatagtaggcacaagcataccagcaggtgttattattccaaagctgtgtagctctttagcccctgtttctattataaaaattaaaatttttaaaaggcacctgggaatctataggagagagtcagtggttaagtgagttgcctgatatctggcaattaatgtttgagccagggactaaaatccagatatttttgattcctaaagtgtgattaaaatatgtctcaaccatgacatattaaactattggaaatcatacgtaatacagtcctttctatattacttcaaaacctggtttaaagaaacaaaagtatgatttttttcatgacttttcaaaagccttctgattttctccagctataaaggttatatatatatataacctttagagccaaatatatatgctttctcttctttctcttaaaggtaagctttatgctcattattgggactgatgttattgatcatatcagacttctcttttggaataatgtttccaggattttcactttgagaggatcaaaacccaaaaaacatcagatgcatttttctggcatttagttcccaggttgggcagtacattttcaaagtataattgattttgtcaaggtcttgagtttgggagtgaagactggagtatcaggaaatgtacatctctagccatcaactagtaacaagaatggcgtaaatgttctagggactcactctgacatccaaagggaagggagcaacttctgagattaagagacctttggttttgtgatgggaacacaaaaagtaaacctatttgtccatatctcctaagactccaacaaattatatgaacaactgcaagttatctgaatatggaatgaattatggatcatcaactaatttaatgtaaccccaggttgcaattcccgtttttagagaggtaacacaaaatatttttaatctctaaattgtaaattgctcaagcaccatgtaataaatatcaatatctaacacaaatgttttggtcatcacttaactatcatatatataattgaaagttgactgtaagtattgcacaggagggcacaaaagatatgtaaactaattattatccagtagtccacactgactatcatttgtatgtcatttgttttattttattgcaaagtaggcatgttgacacgtgtgttgggtgacctgttataaacatatagaaaaacaaaaggagagaaagagagataataatttgatcacagttctctttctaaaagcattgctttaatattctcttatatacaggtagtgataattaaggatatagaattattttctaaacacgcataaatttatagttaagagaaagcatctcatttcaatgataaaatgagagatcatttaattttttttttttttttgagacagagtctctctctatttcccaggctggagtgtagtggtgcaatcttggctcactgcaacctgcacctcccaggctcaaccgttctcatgcctcagcttccctagtagctgggattacaagcatgcaccaccacacccagctaagttttgtatttttagtagagagggggtttcaccatgttggccaggctggtcttgaactcctggcctcaagtgatccccctgacttggcctcccaaactgctaggtgagctaccacacccagctaagttttgtatttttagtagagagggggtttcaccatgttggccaggctggtcttgaactcctggcctcaagtgattccccctgacttggcctcccaaactgctgggtgagctaccacacccagctgagatcatttaatttttgatcacaactattgggagtattttaaaattgtaattgacgtagactggtatgacattggggactgatgatatggaatgttattgctgattcttcagtatgtggacttcttgcattatgttccatatattcttaaaagaatggggctctcatataattttatttcagatatgtccattatttctggactgttagttatgccatttaaattaggtatagccttgctacctttttccagcttatcagttttaagaaagatatggtaaatttattcaactaatggtaaacactttttctaaacattgttctaggttctgaagaatcgacagtgattgaagaaacaaaaacatttactcccatggaacatacattttagtgggttttttaaatcacagatttgtcattttttttagtcagtgtgtgctttatatattttgaggttatgttattaggtgatacagatcaggactgttacagctgatctagttaattgtttttcttcaggatataacgatgtttttagatgtaaagtctattttgtctggcaataatatttccgtatctgttttcttttggttaacatgtttcaagcatattagttagaatatttgtttgacagtatggtagttctgcttctctaggtcacctccagatccaggttgcctttttcttgttgctcagccacagcacattgggcaacctatcagttcagcaaatgttaaccagaagaaaacatgtggtaatgtccacatgggcaaagttggctcatcacctcatccacattccagaaaaggggcaaagagaaagcagaaagaaaacgtcagcctcttaaggtatgacttagaacttgcacacataaattgcataggatttagcaacagaatagtaatgccatttagaccgtagacacagtagataggtggtttgggttcaaatactggctctggcacctcctggctgtgtgagtatagacaagttacaatctatgcctcattttctccaattgtaaaacagagatacttataataatatatatcttatacacattaatcaagtattggttattattattacctttatttttcttctgcagtttctagaatgcctttgtttaatcacttcaaccatatttattttggcaatgtatttcagattgttctattacgtcacattatttgatcccttgttctaccattgttgtggttattaactctctctcatggtggactattttcttactaaatttttatttttcttattttattttattttattttttgagacggagtctcgctctgtcgccaaggctggagtgcagtggcacaatctcggctcactgcaagctccgcctcccgggttcacgccattctcctgcctcagcctcccaagtagctgggacttcaggtgcccgccaccacgcccggctaattttttgtattttcagtagagacggggtttcaccatgttagccaggattgtctcgatctcctgaccttgtgatccacccaccttggcctcccaaagtgctgggattacaggagtgagccaccgcatccggccctatttttcttattttgtactgaagtttatgatactgtaggagctatgcatgcctcactctagaagaaaattccagctattctgacattaatatagcatatgatactaaacaagtcactctcttctgtatctgagtttatcctaggtatctcctgaatagctaacatccttctttttcttaccggcgactgaggagagatggccttgtgttggttagacagagcaaagtagttctgcagtctgtcccacggttctcaggctacacgtctttatttagggtgattcatttttatttatgtttagcccaccatagttccatgctgaagaggtaaggaacaatagggtaagcaagccagccagcatattcttcccataccgatgagcttttcaccagaggaaaatgccctctcagatcacagaaacagtagctgtgtaggtgttgctagtggagaaaaaaaaatgtttggtatttaaaatagaaacataaaattgttaataagtctacagacaacttgtattgcatgcagaaataaaaaatgaagtcctagtacaacaatactgcttagtcttggattcattttacagaagtttaagattcctcacctcaatgaatgagattttaataaacagaagtgtattagaatatttgcagcatccaggcattgggtttgagcctcaaaataaggccagggatgacatttaagtaaattcagaagtaaaaagcaaatggaaaacacttttaatgatgtgtcacataatgtaaaatgtgaaaaataacttagaggttatatactccatcctcttgcttcagggtccctaacaggcatctctcacttgagcataccctgtgatggggagctcactgccttgcagtgaatctttgattttgctgtggctccaaatgttggaaagtgattccttatgagataattgcatattttggaggttcccccaccacacacacatacacagaagaaatgttctcccctatagtaattcaaaatatctcgatagtattgcacaaatatccattaagtgtctcctatgggcctaaaactgtggacaattggagataaggaatattgtcgttttcattttgcctgtgagaaaaagagttttcggaggctaggtaacttgtccaaggaaacgattgagcagagatttgaacttaagctctctggccctggaatttaagctgtctggctctaggactaggccctcattccctgcatgatttcagaattcatgattccatgaatcatgtagggaacccagatataaatcaactgataataacagaatgtggcaagtgtgaacagaactgtactttaggaagctaggaaagaacaactaattctgcctgtccagattggaaatagtaagttttgaagacatagacaccatcaatgccaaagtattgttatcataatgttgtttcacctattttaagaaaaatctgtttcttctacctatgacataaacttacatttcagtatcccccacctcacctcgtcatcagttttagaatgtgctaaattctcaatactactgagaaatgcccttattccccatattgcaaagatttctggggctgcttaataacactttgtaccttctgttcagagaacattcatcttattctcctctcaaattctctgttaagtaaatttaatactacatagcatcaagaggaaagtgaccatttattttagatctgtatctatcttagacgatgtacttttcatggaatagtgagtgagacagacacttgagtcaggtgatgtttgaactaggatgttcccagaattaaatggtagtctcttaaattggatctcatgagtactttagtatctgaaaagtaactacatggaataaattaaacagaggaaaactcctggctatgccattattaaacttttttaaaaatatggtctttatttgacatttctgagtatggcaacccattccttggaaataaagaatgtggcttccaacacatgagtttccccctccctctcccctcccctcccttaccttcctccttcttccttccccttccctttctttcccttcccctttctttcctttcccctttttttcccttcccttccctcccctcccaccccttaccttcccccttcctgtctccttttttccccttccctcccctcctctttcttccccttccctttccctggcctgccctttccttccctttctcccttccctcccttcctcttcccttcccttctcctgccgtgccttgcctttctgtatcccatggaatacctctcttttgcattggaagaaaaacttgatcccttttggagctctttgggctttaaaggtttaagtgccaagtgaacgctgggcttgtttgcctcctttaggaagccccgtgtggatgattccacccctcattgataatcttcttactttacactcccctttctctgccaatttaaaatcattcaaaatcaagttcatcataatagtgaacgtcaatttacaatgctcttttccaagataacttcttttcaaaccctcaaaactattctatgaggtagagatgattcatagttgtacagttgaggaagcaggctcaaaaagtttaaggtaacttgttcaaagtcatatagccagtggacccaggatttgaactctagtcttttaacactcagtttacgtgttaccttgtctatgaatccttcttgatggtccctgctttccctgccgtagatcagtagatcaattccattctctattcccctgtgtgctttgtttatacctttgttctagcacttatcacattgtatttgggaagcagtgtatttaaatggatttgtggctggtctaatttggtttaggtttttttttttttttttcctgttagtttatttacttcctaaggcctgaaatctcttcttcattatttgacctgctggacttcatgcagtgctttgcccatagtatgtataaatttagtgttcatggagaaaatgaatcaatgcaccaaagtgaaggacaggggctgcggtttctttgtatcctgagtggaacctagttcagaggtacagtcacaatcacttttaaaaaaatgttgaataataatgaaatactacataaatccaatagaaattcttaaaatatttagaaggcatgttttctaggaagaaggctaattattagaatttattttttattctagagaagaaagagagaaaataaagaattaaagaaataggaaagagaagtcactagagagccctttcacgtcccagagcagattaggatcttgagagctctaccctactctgacaaataattacttataaaacaattctggggtttcatagcctgcattacctggttccagggaccaatcatgagcttcgttgttttggagttggcttggaggacatttataagaaacatgtgatgaagttgcccctttttctgcagaagataggcaaagagaatcccatgagttgggtaacatgtgggacagattttgcattccgtgatttgaaattatgggtgggggccgggtgcggtggctcacgcctgtaatcccagcactttgggaggccaagacgagcggatcacgaggtcaggagatggagaccatcctggctaacatggtgaaaccccatctctactaaaaatacaaaaaattagctgggcatggtggcttgcgcctgtaattcccgctactcgggaggatgaaaaaggagaattgcttgaacctgggaggcggagattgcagtgagcagagatcacgccactgcattccagccagggcggcaatgcaagactctgtggccaaaaaaaaaaaaaaaaaaaaaaaaaaaatgggtgggagggagggtgtttactccctgccctggagatttgtataaacaggaaaagaagactgttttcttgtttagtcttttaaactaaagacttttctctcatctggagaaaaaaataataatggtagtaataataataataataaaatgggccgggcacggtggctcacgcctgtaatcccagcactttgggaggccaagacgagcggatcacgaggtcaggagatggagaccatcctggctaacatggtgaaaccccgtctctactcaaaatacaaaacattagccaggcgtggtggtgggcacctgtagtcccagctacttggaaggctgaggcaggagaatggcatgaacccaggaggcgcagcttgcagtgagccaagatcgcgccactgcactccagcctgggtgacagagtgagactccgtctcaaaataaataaatacataaaataaaataatttttattattgatcatttttgtgtgtcgggtactatttctagacaatttacatgtattaactttaaacttgacaacaaacctattagatagatggtatgattactcccatttcacagatgaagaaactaaactacaaagaagctaagatcgagccgggcatgatggctcacacctgtaatgccagcattttgagagtccgaggtgggcagatcacgaggtcaggagttcgagaccagcctggccaacatggtgaaaccctgtctctactaaatatacaaaaaaattagccgggcatggtggtgcattcctgtaatcccagctactcgggaggctgaagcaggagaattgcttgaactgggacccgggaggtggaggttgcattgagccgagattacgcactgcactccagtcttggtgacagagcaagactccgtctcaaaaaaaaaaaaaaaaaagaggctaagatcttggccacgttttcacagcagctaacaagcagaatcaggatttgaacctaggccgtggagcaccagagcccattctaaatctgaatgcactctcaaagtgtcttgcagggaggtgagcccagtctgtctctctcagacttcaagaccatttgcagtggtccccatacctattgcaatgattctgaataaagtctcctgtaccaaaaaaataaaaagtattctctaaatctttaatattttatcctagaaacaaatgagattattccttcttttattgtgataacatattatgataactcattttatttgattccctaaaaccggacagagatttccatggtgctgaggatacgaagtttagaccttcgatagctagtctaagcttagtggagatctgatatccaatctaagcttagtgaagacaaacaggttgtaaatgcccaaatctctctatgagaaactaattaagccctgcctttgagtaaaagagaaaaaaaaaaaaatgcttctatattaaaataacttcatttggagttcaaaggaagctaaataaggttttcacaggaagagttcatatttttttaatccttaaagtaatgtgtataagtttcaatgaagtaaatgtcccagctacattattcaaactcaagagattaaaaatattttttttccaacatccaaactcctgatatccctatttcagccacagggaggacaagggcataactatggatgtttattagaaggataagttaaagaggcagaagcagtatatacattctctaaactatacatttatacaaggatgccattgtctttttttaagcaaatacttgtagaagtgatgtctaaaagaataaagcttctcttctatatctccaaatagaaaatataatcaaaatccgcttttatgtaggatggcttttttaaataaataagcagaaggatgaattatgtggctataaataaatctactgacatgtaataaagcaaagtcgaactgttttatggtgtcactgaaacccttagatatatttatagccatgttaacagtccccagtattttttcaggacttttatttcatttcacattatgagagtttagttgtttgtttttctctccctaaattgccttctggagccctttgtagagatagaaagtaaggatctctactcttcatatttggaaaaaaaaagggtcttcaccgaaaaagcttagggctcacacagaaacagtcggttctgatgctttctggtctgcctgtttctgtgcagttcatatgagatgtgcctgcgaagaacaacttgacaggtagctcctgctggcagcaaagtggcaagtcagagtctatacaagtgaggagaggcctgtgcagagataaaatgtacagtactgtagaaaacaagcagatggacagagcaactttgcattagattcctgatgcctgacacatttaaatacaatcacaaggcttatttcagaagccaaagaatctccagactatcacatagccgaggcacagaccaaaacaagataaagggtctgatgggtaaagatgctcacaccttaccctgggacattctcttgcagggtgaggatggggggggggacatttaaaaagcaagaggagaaggtttataataccagttctaaagcctgaagtaatataggggttttttaaaattgtattccatttagaaatttcaggatccaaagagtatggttaggattccgtggggggtttattcaagtggagctaagcgtggttgttcctgtgaaattatttatatttttcaacttgaaatctgggtgagcatagtgtttctaaatctatttctcttcttttctatcttaaaagtggactctcattttcatcctgtagctatacacttgattcccaagtgttatcactcaagggacccactagaaaagccaactcaagaggaagaggagagcttttgatggtaggacaagggatgacaaatccttcagctggaactctagctacaggcagtatttagaaagtatcactggagctaaaaatctttaaaaatgtatttaatgtgttagactaatataggctctaaaagacctaaaaagaacaggatccagaaaagaagtcgaaataggaatgtgttaactagagggaggggcaggagggataagaaacacatgaaaaaattaacagtggggtaaattggagagggacattcattttattaggataattgggggttgtctctttgtagtggaagaagtaaaatagacctgtcttacatttgtcctctgaagagtcttctcagtatttaactgtgttcccaaatggaatcagccttaccaaaattcacggtgacttcttttgacattttgcaaaaagtaaataaataaattataagtatgacaagtgaaatgaatagttccagctgtgatgcaccagcagcatttccagattttgtactgcattaaggatttattttctctttattgcctagcagagaattaattggaaggtccatctaagcttcccacacatcctcagaatgaagtcaaagcagtctccaatgctcaatgccaattaaaaaaaaaaaaaaaaaagaaaaacagtaagtgggtaggtggtcagtttatcaactctggaaaagcttgtctttgaggattcacactgctaaagccagacaaacgcatcagcaaaattaatggcataaggaaaatgtgagtatgagattggcaattgattcactgagttcgttcattcagccagtatttactgagcccgtatgatgtgctacctattttttcacacacacagaaaacaggagaaaatgaagactcagccctcagagagcttataaccattttaaggagataaactatgaacaagtatacagataaaataatttcagacactggagagtgctgtcaaggaaataaaacaaggtaatgggaggggatgccttccaggggtggtggtcaactttaaatgaggaccagagagggtctctgaggaggtgacatttgaaatgcacccatcacatgaaaatcttggggaaaagccttccagacagaaggggccaacaatgctataaaggccttgggatgagaaaaaacttcccacgatcaaagcagaaagacctggggaactagagagtagggaggaatggggcatctggcaggagatggagctgaagcattagagttaagcagagtcatctaggccgccttaaggccaaaagtgcagtggaaatccacctggggactaaatcaaggagtggttgaattgagtggaaattatcatggatatttaggatattaagaattttttctggcttttctagcaataatagcataagaccctaaccatgtacttaacctgttcttcacctttttagagcttcagcttatttttctagtggacaaagaatattgccactgtttgtcaggtgctctaccagatactgtatattttctcattttaaacccccaacaacctcgagagggaggcatattcctcattttacagaggaggaaactgaggtttcaatggaatgtccataaaccaccccttccccttgctgtggtgtccctgagagcatgctgctggtttaagacactgcgtgggggcacacccaaaagtatgcaagaccttgtcagagggccatttcctggggggctgtggatcctggaccacccttacaaatgagagccagggcagttagggtgactgtgtgcatcatttactacgggcagcttgaagcttttggaggacaccaatttcagaaccagaataccagttcactgccataaattctgaaatggacttgatgtatgaccttgaaggcaaatcacctgtaggtttggtctttttgttagagagacataatgctgtttcctcaacacctccttggggtgtctcaaggatgaatagggctgtcttaatccctgttctttatcctcagggggtttgaaatgagagtggagtatataataggtgctataagctccttttaaaaaagcctcctaaatacaacatatatatgttttaaccagcaagtattgttcactcacctccccttcctccctgcaaatgtaatgggctttttacccaaggtgaatggtaggagggagtcaaagctagcaagacctgtgtggacaacaacctggcctgagagggcagcctgttgggtttgtccttcctgcgcatgagacatactggaggggtggatgccgcctagtccacagtgttaccgtgtcctggcagagccttgggtcagtcccctcctggagtcacagatggccacgacagaggacaggtgctgccattctggctctcccctgcgtgttcagtcgtgaggtaaacaccgtgctgtctttgatgcccagcgcccaggggacttcacccacctggggcagcccttctgcagccagttccggacaggcgccagtcacttctctttgagccagccgacttggccctctccccttctgaagttttttgatcaggactacaggcgcggacgataacctctggattttgaatcccaacagtgtcctatccaccaccgggggtggcagccaccttctggaaggactgccaatcacggagcccttcaccctttggagtccccaggccaccgctccaccttcacttttgggagtccggactcagattcccatcattcgccctgcgggaggggccctgggcattttaaccccgggagacacacgcgcctggagagtggtcgcccaagccaccgccaggcagggaggagcgcgcgtgcggcaccaccgcgtgcagcagctccagcgctcgcgctgcctcaaggggtttatttttatttctatttggagctacttcggccttagccgccgcccttacttttcctccgaaattgtgagaaggtgccttcatggctggagtttggtttcacgcgcctgggagaagagcagggcacgggtgataaagaaggcgcagtgtcggtctgtcggtgtcacacacgcgcgcacacacggcggggcgggagccgcgcgagcgagaggagggcgggcggcgtgtgctggaggctcgcgcgggtgtatacgagcctgtgcttgaatgggaagggccgggattccgggtcgctctggcccctccttcctccggagccagccagtccctcggcagagcgctggggctgcactgatttgctctcgggagtgcgctatttgcatatgacttgcccatttgtgaatttggctccccaactcctcgcttcacttcacctgtgcctccctggtccgcgcacttcgcaggcgcccgcccgcctctcggccacctctgcagcctgccaggcacctcctcttgcgctctcgctgatttcgcccacccacctccctccaccccgtgccacgttggtttgggtggctgctccgcaccgggttcctcctcctctcctctttccctccagtccttcttattctcttcctctggctgcggtggctgctgctgctgctggttttcatccagttgggaaacccaggaagccggcggctgctccgtggcgctagtccagcacgcccagggttaaaagcctcgcgcccttccgcggagactcccaggaacacccgaagaactcttccacctgcagcccccttttgcctggcagttctgcattgcatctcatggaagtggaaacaggaaaataaaaatgttcaaactccttggatgttgggataaactcacctgaacccacttgggttcgggctgcctccttctcttccttcattgccacctttcctctgtgtggctcccgggagtgtgcggttaagtcatcagactcgaagtgcctagagatccggaggaagccgcgccggtcttcccctgacatgcgtggcatgccggggctccgtaggaggtttgctatacctgggaggaccctggcattctaaatttcagctccgggaaagagaaggggctttttgccttttatcttttttttttctttctttaagtagtaattttttaactgattcattgtttggaaagcgcatattgcttccctcttccccgaattctggcaactcttcctcctgctatgatgggcccttgggcatcatgaacttcattactcctcactggctggaattcaaactgcccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacggtaggtctctctgctctttatccttttaatggggcatagcaattcgctaacccactagccttgcaggtagtgtcaaaggtgggaagggaatttaaaaaaaatgaatttaaaatgatgaaaagcatcgtatgtccatgagggaagcaaatttctactttctcataaaggttagtgttttctgcccctagcctccgacaaccatctccacttttctctaaagggttcttttccccttagctccctcattcatagctgcacagacaccacactctctcttttgcaaccttctactctctccacccccacggagacaggcaacttatcaggtgagtcccagtgctgtacttggagaaatattcattcaccttgctttcacccttctttgctgtggtcttgcttgggagctagtgggggtggggtgggaatagctgacaacaggaatcaggttttcagcctgaagttgattgaactgttataaagtagcctgtgtggtaatggtcagggaaaagtagccgaacataagaaggcagaaaatataattaacaacctgtggccatttgtgttgaatttggcagctttatgtttgtccacatatctagtggaaaaagcagctatctctaaaactacacatctactattgctatcagaaaggaagcaatatgtaagataaggctaagttcatttataatttacccaagtgtaaatgacagtaacttggattccccgtgtatgcaaatgttatttcatctttaggtagcagagatgggcttgttcacacaatacaggtacgatgggttttactccaaacaaccctccttacatggctattgagggaagagatctatggctctgaaaatgatactcagctgttagccggctgcctctaaaagggcgatgtctgcagctaaggtaggagcttgctgtggtaaactgttctaaagaaaggagcttcttaatttgtttactatgcactccactctgatggtaaggagagtaggacacacagaaatggagactggtcttgcttgggagctagtgggggtggggtgggaatagctgacaacaggaatcaggttttcagcctgaagttgattgaactgttataaagtagcctgtgtggtaatggtcagggaaaagtagccaaatataagaaggcagaaaatataattaacaacccgtggccatttgtgttggttttggcagctttatgtttgcaggaacagccctccagggaacatgagcgtgaaccatactagggggttcctgcccttgtattttgaagactgataacatccagaccctatttggaaagttgattcttcctgctgcctcctagccctgagctttggctttatgctgtctgtagtgtaagtggaagcacattgagaaaatgccagcacatactctggctctttttgactctgtctttaaattttatttgatggagttgtcaagcagctcacagcttgtaaggttggtggagggggatggtgaaaagaagggattgcttgatcttgatctggtggctcttttctctgtgactcctgctgggtctggtgttggctcccttaaaaaagaaagaagcaaacaaacctaggagaaaaaagagccacaaccaccaaaaaagcaatttcattgacatggaaacttagctcctaagggggagagggactggggggagcgggtaagacaggaaaaaaagagggagtgggagataggggaagccagagagactgttactaatagccataattaaacacggaaatgctcagagattagctaaattttgctaattactgtaaatgatcagcagggagaggaagattatgcattacaggttatgggtggcagggtcttgatatcttttgttcgggttgtaaacagttacagcagatactagtaagtgatggaatttgcagagcagtacttccctagggtccctaagtcagagtcagtctctctctctctctctctctcataaaggggttgagccttgcacaggttaaacatgaccctttatttagtttatttcttcaacgattggttgctcagtctcctttaaatctttttgactggtccccagtctagtttctcattaacctacatctgataaggttcagtgtgatggaaaataagaagaaagtaagtaaatggctagagaccccagaaaaggccctcagactcaccagagctgtagagtacagtgaactccatccagggtctggcatggctgagataagaaaactcatgaattcagctcttcagaatcctctttcaatcctgaagtcccaactcattgatttggggcttggagagtgaatgcatctgtattaagtagactccttgcatatttaattggtgtttttgagcataaaatcaagagaagcagcaatcaacaaaatatccctacctctggcttccatcctgcacccaagctgtgaccctttgcgtctctaactaaaaggaccagaagaccccacagagctttgctaatgcacttctcattcttacttggtgtacacttgctttttcctagtccaagacaaagacctagctaacagcaattgttttaaaaaatatttttggatggaggtggtaggaggcatggcaccaagagactgatggttgttattgatgatttactgccaatcttattccagagttaaaggcagcactctctgttgtctgtgaaaaagtaaatgcccttgattttggtatgaaagaaaactagagccttgagtccaagaatcttctttggacttaagagattgttgtttttttaactacacttgctcttcccttgcccatttcctgagaagccaaagtcctcaaagctgctgttcatcagttggtgctcccaccccctttctctactatccagacctatagagagattcatgctaagacagatggaagaaacagaaatcctccaaatagctgatattttacctacacttttgcctgtgcttggttccaagctttagaaaattggttatattatagatttgcttaaagcctttatcccaggacagcctagaggatgctgggattctttgtaaattagggagactaaggccacacttacctggggtgcccccaaaaaatctcacattaggattgtgtttcaggataggattaaccttcttcttaatgggaatctagtaggctcttccccattctgttagagtcctcaccccactttcatgctctcttctgttcaccagtcagtcaatactctttgagcacatactctgtgccaggctgtgggctactgctgaagatacagaaccgaataagacattgtggtgttcagctaggaataattgcaaaagtatatatatatatgcttccatattttaaaaagtgcaaggagtgggtggagatccaaataccaagcgaaattaatacaaaatcaaaatatcctttataaaatgaaggtttacattatcctgttatttaaaatatccctccaggttccttttcatccttggctttatttccatatgtaaatatcattttttatcaaagtgcaaggtagtttagtgattacagatatataaatagtaaaatatatttgtttaccaagctttaattacataagcaacttttgtatattttttccttctttttttccctctctctcttaaaggtcattggacctttaagaaatccaatgtgtctgggcatggtggctcacacctgtaatcctagcactttgggaggccgaggtggggggatcacctgaggtcaagagtttgagacctgcctggccaacatggggaaaccccgtctctactaaaaatacatatatatatatatatatatatatatatatatatatatatatgtatctccaatgtacatctgcctaaaaaatgcttcagtatttatagtttaaatgcaggtttctctaaggattcaaggttttatatgtaccttaaatgctattctctataaaacagcagactttcctgcctctgtagacgatttgtggggactagttgaggacatggaactcttggaaagctcagttttaaaagggaacacaccacgctatatttgcaggaagaactcttgctcagaaaccagggtgtgtgaaaagggggagtataaaagtcctattcaaaccatcttagcagaagtggtggtgatgggcccccttgtgacacatgatcctggagtctttcttggactcattccttgtcccagggatccacccccaaagttttttcagccttgggggcttgttttgctttgatctattgagtgccttcttctgctcagccagctgctttctaaccactttctttatgcctgccttcttgagattcagggagttgaataattcatagtgttggttgacagatcaaatgataagatttatatatctttggccttggtgatgaattaattagattggtttctccatctttggctcctctagatgcgttgtttttcttctttaaaattcactggtgagtggtgggtctggagattaacttgttcttgagagaccaccataggatgattataatatcctagtgtcaatttcttcaggactttcaacatggatcactgggtggtgtggagtaggggcagctatatcatagagaggagagataagatcatcagaacaaaaaacaagacgcacacacacacacaaaaacttgccgatactggctgcgggatgaaattttacagtaagaacttgattgctttcacctcagattttgaatctaaaagagaaatgtatttcattttacattttagtaaatgaacttatcagcccaaagaagtttgctttactagaactctgggtgaccagggagggaagcaaatctctgaagataaatcttgaacttactcatactttcctccttgtattagtttgctagggctgccataaagtagtaaagtactatagactgggtggtttaaacaagagaaatttgtttgctcaaggctctgtagagtaaatgtctgagaccaaggtgtcagcaggtttagttctttctgacatctctctccttggcttgcagatggctgttttctcactgtgtcctcatagggtctcaccttgatctacatgcatgcatccctggtgtctttgtgtgtccaaattctcccttcttataagaacatccatcagattggattagggtcctccctaaaagcctcattttaacttaatcatctctttaaaggccctgtcctcacatacactcacattttgaggtaccaggaataaagctttgacatatgaattttgaagagacacagttcagcccctaatgctctttctcctcaccgtgcgctgccccccaccgccccccaccatcccccgcccagttattgggaaagaagtaaaactgtactgttcagtgaatacccattggactcaaactttcacagcagaaaaataaaacttcagtgacaatggttgcaatttacaaaattcataagatagtgccctaagaggtaatgttgtgtttacagatatggggaaaaaaacagctattggttcagtgaagacttgtgttttctttcttctcagtttatcttctgtgactgagtccagatctttatttgcacatagactaattctgtctgactgcagacacatgctctaatgtccacacattaaagctttctttacctagacctgctacccttctgacccagaccctccactcctgccactgactcctttatgaactacagttgtttgctctttgcctttcctgaaacacaaattaccaactactttcacatctcagcctttggtgaaaacaagagaaaaaataggttaactaagtataaatttctcgtttttcaattttcatatttctcaattgaaaaatatgttaaataggcatcagtttaattatttttctcttcaattttattttttgaaagttcatctgaaaatataaatatgaggtaaattgtctacttcatgacatggttatgaagcttggtgagatgattgagagaataatatatatatatatatatatatatagtgtatatataagttctggttgttctaaatcctaagcaaagcattccatctttggggaaagggtatacctttctttgtctgtttgtttctgtgctcaaaatgcgtgctgatgttgataatagataaataataatggcattctggtggacagtgtggtgttaggtgaggtgggaacaactatggttggaggaaatagccttcaacctcaacctttggttctaagaaactttgtctctaagaaactaagttactaagaaacattgtgaacttaagtcacaatgaataagtcacttggtttcactgagactcaatttcttcacctttaaagtgagcaataataatagttaaccatacttatatcacagaaattgtatgagagattaaacaagttgtattttgtacattctaaaccaatgtgtacaggttaaatattttatgagacatattttcatgataaggctgccctctttgaattccttgcacaaagaggagcttcaatgttgatcatttgctggttggtagatagtggttaaagaacatgcatctgctggttctcctcattttcctatctatacatacacttttttgcctcctagagattatttcatttacatagtactctgagtaaatgtagatgagaaacactttactgtattttcatgtttatggcactagaacacagcatgggacaaaagtcagcttgtgatttttggtaatggtctgcttaggtagaaagtcatgccaggcaaattttagcatggaccaacacattatagcaaatcatttagaagctcagggattcagtaaagtgaaaagagaggactccaagaaatactctgagatcattttggaaattcagaattggatcccatttgcagtaaacctgtgcagaattcaaacattcctacatggttctcagtgtccattgtaaactaagatttttaatctggtttgtgctgggaagaagcaggtgtttttagggacaactaccttcagatgtggaagtgaagtacttcttttaatgcaatttcttaggcttactagggctcaaagtttgtagagcagataggagcacaatattatgccagaactcttagaattgactttgtgaagcctgaatttgaaacagaattcttactgagagacatggtcctgatacatagattttgccccagttttctccctgaccagctctgtaactttgaattataacattatatttttaaattatattcatcttttaacttttagacattctgtgtgataccttgatttcctaacctatattcttggctttacctgtagttttctgcatggcatgtagtatgaaagctccttaataccatagctggggaaaactttccttttcatatcttcatcatttgtacaatgagagatttgagtgagatgatctctccaaatgttttccagcactggaactgcatgagtctctgatttgtatgtctttaaagacaccactgtgcatcttaaacctatctgagttccacaagtctgccagtattttataggtctattttcttgactatcataataacttatgccaaagccataagccaggttttctcttttcccctcagacagaagcagcataatgtaccagagtggcacactgtgatgttataaagcccacaatccaacttcagtgcagtcacgctgagatgggaagaatgcagctttcatttaaacacaccttaataatgctagaaaggagctctatgttatgtttaaaatattctgctgtgtttagccatatcagagcagggggcagactagcaactgggtttataaagaggaaatggtttatttctatttacagttaggattttgagagagacttgcttgagttatacaccaacacataatgtacacccactgtgtgacaggtactcttccaaatgctttacatatgtgacttcatttaatcctcactagcctttgaacctaataaagtgactattttacgattaaaaacattgagactcagagaggttaagtggcttgattaacatggtgttaaagccaggattcaaacctggttgtgaccagaaaactcttggtctttctgctgtaccacacagtctgtcaactcaggaaacagactacacaaacacatcaagctcttttgtcaggaatcaagtacacagattgatgaagcactttgattaatgcagctaacacacctttccaaagcatctacaagactttccaattcctaataagtatttgaatgttttccaatctgcctgaacccgtttcaacccaaggagatagtaaataaaaggagcagactgatgaaacactcacacttgatatgtctttttttttgaatgaatgaatcaatgaataaatgattgagtgaggttccacatgatcaaatctcttgcactaggaaaggagggatgctagtttataaaagaagcaaaggcacaggaagttatgcacccttcaaaagcacaccaatgggctcgtagaacttagagatataagagagctcaatgttccaggtaggcagggtgaggactcaactaagagcatccagttagtgtcaggactggtcaggagcacagacatcatgactctgagtccattgccttttctttcctctacttctcagtccttcaagacactttcttaaattacaaacttgttccccatctctctttcttcagagaaatctccccttatccagattatgtcctgcaggcacatattctgccagtgttggacttgccaggccttccattaaaattaattattggctgggcgcagtggctcatgcctgtaatcccaacacttgggaggccaaggtggctggatcccctgaggtcaggagtttgagaccagcctggccaacgtggtgaaaccccatctctactaaaaataaaaaaattagctgggcgtggtggcatacgcctgtaatctcagctactcaggaggctgaggcaagagaatcacttgaacctgggaggcagaggttgcagtgagccaagatcacgccattgcactccagcctgggtgatgagagagaaactctatctaaaaaaaaaaaattaatcatgagaatccttctaataggttcctggctttgtgtgccaaggtagggtttcttggtgtgttctgaaggcttcctttgtataggaaacctcagtgtgaaaaagtgctcagattcggggttctgtgaaagatgcttcctgtcctggttggatgtcacttgccagaaggcaggaaagaaatggcctgtctgttcacctgttgctgctcctcatctggaagttgtgaccaggatcttgtttgaagacctgtccccagccccagtcctgacctcttgcttaccagctattgagtggctatgaaaacataaagcccctggaaaccagcaagccacattttctgagatactgtcctgccctcccttttttattgttttgaaatattcctctcacccccccacgttaaaacataaccatgtgtattcactcctgagtgactttcccccaaactatgaatttcaactatttccgaggcagtcgttcagaatttgaatataattacactctttgggtgaaaattgtggtttttgctacataaaaaactaatggaaatgatctgcctgttcctgtagtttacagattatatgcttcagaactgacgatatatatttaggctgcttttctgtgtggcacatttaaatgaaaatgaactcggggtgagccaccatggttgctaggcaatagagcgggttgatagagcacggtattaaactgaacccacattggtgttttacttaacatctatttgcttagcacctttgtcatctgtggtgtcatagaagggaaaggaggaggagacaggcagagtctggttatctgcagagactcaaacaagtaggagaaataatcatcccaaacaccaaagtgacatgagcattttcaaaaatttgaggttgcagcacagtcaactcatttaatgaagaacatgcaagacctgaagaaatgcataagcatagcagacatattcatggatgtggtagcaagaggaactaaagagattccccaggctgggttttgctctggtggttccagaaaaaaaaaaaaaaaaaaaatagccaccacgctggttgaaaattttaaaaatgcgtctatgggtcatttaatttcctggcctaaaatcccagatttatcatgagcaagcggtgataggcagcaaaagcattgcggcttctttacaattgataactaatagaggaactccaattgctttgaaaccctggttttaataaaagctgaaagtctcttataagaaaacaactggatcacaataaagcaaaacctcgtcagactctttgggtccattctagccactttctgatacatttaaaagtttgaaaagatgattaaagggttaaaactcagctgtggggagaatttggtctcatgaataatttgggcagagagaggatcctgtgatttggatagccaaagttttattgtttattttttccaggagccaattattatatatcttttttcattgaatcaatatctctgcataatggaatggtcacctttgaatgttctcttttcttaaaacaaacttcttagataagttaaacacaagatgataggaaacctctattttcataagaatgacaataacatctactttggtttttattatagcaattgatcactttttattatgcctaacatttttgcctttcaatatgcctgacatttctataaacgttatagttcatttaattctcccatgaagtaggtggagttgttttcccattttttaagttttagttatttattttagcagagatggggtcttgcggtattgtccagaccagtctcaaactcttgggctcaagtgatcctcccaacttggtctctcaaagtgctgggattactggcatagccaccatgcccagcccattttcccactttaaagaggcagactcggaggcatggaaagtttgagtcagttgcctaaggtcttataggtaatataaggcacaatcaggttgggtatttaagcagtttgaacctgtcctgttcaaactgcttaaatacccaacctgattgtgccttatattacctataagtatatactgaaattatactgaaaacagtatactgaaaacagtacaatatttcataaatactcttaaaatttcagtatttatgaaatattacctgaatggtgggaaaaaatttcaaagtggtattcttaaatggaatactgggccatttttaaaaggacctcttagggtctacctagatacaggataaattatgaagacagaatattttctaaacaggtaaacacctacctcatatgaggtattctaacaaatactttagcttactgcatttaatctttactgaccatccttcaaggtaggcactattgttatcatgaatttacgggaacagaaactgagccccagagggttaagcaactcactctagttcttccacttactaagcagttagcctatagcatctgttgaactcttaggtcaggtaatctgtgcaaatgtagaacagttcccggatactgaaagcaactaatcagaatgcttccctagattcacaaattctattacattataggagaggcttttcaaaacagcctttggaaactcacaccagttccagaatctgctggcaatgaatagttacatctttacatcttcaatcaaggacccaagagtgagggaccccctctcctttgacagggaagcccattggtgcctcattctcctcatgtttaattcactctaagaatccgtttttttcaggaagtttcttttccagtaattacgataggctttctccccaacttatgattttaggcaagcaaccaaactttcctgattttaattctctcacctgaaagacagggaactgtgaggtggcctgccagctttgctttcaaaagtgtggcattcatctttcattaatgccaaaaggcaaaattccaatgatttctaaaatacttcctcacccttatcagatcttattagatcaccttgaatctacttttaatcttggcccttcatacatatggtagtagttctttaaatatgagggtgaaactaatgaatacgttaagaggggcagtgggtttccaacttgagtgaatatgtgtgtgtttgctttcacatgtaggtaaatgtgtgaaccaaaataaacgatgtaacagaaaaccttcatagcagcccaattagttcctagcttagaatgtaaagatcagacatgagaactaagtctgccgtgcattacagacgtagggaggtttcagtacctgcttcttactgctctggtatcatttatcagtgcagtgttgtcacaggctcatgtcaacatgtcaataataatctcaggagaggatagcttttatgtgaaataggaaggtaaacctagagtcttggccttatacagacaacccccttctttgggatgactagtgttttcatgtttcttgttttttccatgccagggagccattttatgtgtgtgtattggtaacctcatcaactgttagctattaaagactggttaaactaattattattaagaactctctttcagaaaatcctgagatagttccttttacttcccttcacaaagtaacttgatattggtccctgagaaatagatccacaacctcatcaccaagttctccaggccctgaggaatgatcatgcccctaaaataatgttctgatgaaggactttctttggactcaaaatctgctttgcatttgtggaatcatcaaatgcgaaacctgcaagaggtctttagaagcccttttcaatcaagttatttttcatgtgaaaaagctaatagaccagaagtttgtgaatagttttcccaaatcacacttttcaaattagaggcaaggcgagggcaacgtgcaagctttcagcttcgctgtttagtctctttctagtctctttctactgcatcacaatgttagcactcaggctttccaggtgtcatctgttttgctgtggactgggaaactgggattgtctccagcaccacttggataacaaatgagcacagaaggagcagagagcagcatgacaaccaagatactccaaacactcgcactgtttcctgtaattaccatccagagagcagctcccactccgtgtcaggcatgtcaccccctcacggggtctcctgctttctctctgccccagcagcctagaggggaaattcagcatgctgcatttcaatcaaactgtttgatgagagcttttgagcctaattacatggaaggttttatccagtgaaaagaaagaggaaagagaaagagagaaattaaattgaagtataaatcagtcaagagcttagatcccgcgcttgctttctttttaatcaagagtgaaatgagaggagagttttaaggatcatcacaagacaccattaactacccaaggagctcttggctgaagatggtttgtcataaaaagaaaagtgtacaatctgtccataaagaggaagtatctgagggtcgtgctgcagtttaggagcatgacactaaaaggaaggacgcttggtttttccgtgattattttatctttatttcccctagatacctagcatattttctcgcacacattaggtgttcttgttctgtattttaaatcaatgacttggtaaataacgtagtgtgttaactcaggtaattattacataggaaagggtatgttatcaactcattcaatattagatacaacacatgaaatcagtattcaaagttttggccagtttccctttgtggttgatgtagtttgggcatatccctctaatattactgttatttatagaatgctttacagtgttacagagaaaattcacggtaattatttgatccacagcacagccttgtgtggtaggaggacaggtagtatgattgttatttattccatttttttaagctgatgtaatcaaaaccaaagaagcataaatgacttgatcagagtcatccaagtattaagtgacagagcaataactgctacccagcttctattacatcaccctgtatgacctagaatcttgtacagaatttctgggttcttcagtataagaaggataggtaaacagcagagaggagtgtttgcaaaagaaatgcattggaattcatactttattattgagtacttatgatgagcaatgcaaggcactggtccatgctctgaactggaatgtgaaacatgagctttgtccccaaaggcttacagtgtggttacaattcattaaaatgatacttagatctatcctttccatctctattgcattttcaaccatatcacctaaacagttgtgacaacctcccttaacagaccttccttagcttctgtttttccctcctgtccatgtttccctcaccattggagccatccatctgaaacaccagtctgatcatgccgctcttccatgggctcttcgtgtcatttcctctgtactcagaacaaaggctggccccttatctttatgatctggcccctgtgtatccccaacttcacctcctaacatatttgactaccttggccttcatctttttctttttccttttttccccccttgaatatatcaatcttgctactaccatagtgcctttatttgatcagttccttttctctgggatgttttcatccagattgccgtatggccactccttcttcttatacgtcaggcttcaacttcaatgttatcccctcaagagcccttccttaatgacccagtctaaaaagcactcttttttagaaggatcaagattatatgaaaaaatttaaaaaaataaaaaataaaaagcactctttcaaatgtctctccagcataccaccttgttttgttttcactgtagcttgaatatctctgttacagttccttatgtgtgtattgcttccattaacccactagaatgaaagttctgagagcagagaccttgctgatcttgttcatggctggactcccagtacctaaggcagtgactggcaaagactgagttttcataaatcttgctgagtaaagggatggatgaataaatggcatagatgcttcacaaatatgggctcccacctagcattttaacctcaatactcagtaggccctttaaaaacatcagttttagtttgtacttttcccttgattgagaatctctcctatttggtagactgctactaatttttcacgttgcagctgactccataatatctggtctgcaaagttttccctatctcccactgcacagtgagtttcccagccttctgtgtttacttttttcgctatagaagttttctcattgaataacaaaaattattaaacatatattcagtcttctactgttttccaggcactgtccagggtgtcagactcttaaacatacatcagatttgggccttgcctacaagaggttcacgccttggtggaagagctcactctcattttattaaacatgtaacattgcattgctgttatttattgatggtgattgttttcctcattaggctctgcctttcttaagggtaaggaatgagtcattcatttctatattttgattggctgacatagttcttcttttacaaaaggtgcttaatggcactcattaatgaaaaaatagagtgagtgggctgaaaaggtaagaacatacagtattttaatgcacgttgtagtgtgacaaacatcatgagataagtagaaactaccgtggggatttagaggggaagatgtcacaaccaattaggtcattaaaaagtgcttcatagcagaaataaactttatatcatgttttgaagaattatttccacaggcatgcaggagatgggctgaaatatacttgggaaaaaaaaaaaaaccagatgttccagaatcagtgactccatttgctgagttatgggcttgtagagctcagttgtgagaagggctggtgaaggagtttggggctctttgatggaggacgttgagtaataactataattataatggacatctttggcatttacagtttgcagatcagtaatgtaaatactatatgacttgtccctttcaattgccctgtaattcttttatcatgatcactatttacaagagaaaaaaagggtcaaggctgagaagttgatgcttaaatcttataggatggtgctgtatcttttcaaaatgtaaaactggttttgtaaatccctggcttaaaaagataaaacaaaagcaaataaataaataaattaagcctctttcttcactgtttccagtgccctctaaatcaagataaaaatgtttaatgtggcctagcagttcctgcgtgatctggcatcactagcatagcacgtttagcctcatcactcaaaggtccttctgccttcttgattccagcgccctggccttctcccaaccattcatattcaccactacagacttgcctttgcttatcctatttaagcagaatcctcacttcttcctttgatggtcacctactcagaactaagaactcttctttagtgtagcacctcctcaaggaaatccccctgccatttctttgagaaattcaaattcccaggccataggttctcataaccttctagaactctctcctgttgctcatttcacaattcctttttatacatttggttgtgagattatttgattaatatccatttcctaagtagattccactggggttagacagggttgttagaaaataaaaatgcaagacagccaattaaatttgtattcagataaataactgactttttaaaagtacaggtatgtcccatgcaatatttggaatatacttataatttaaaaattttgttgtttatttgaaattcaaagttaactgggcatcctatattttatctggcaacctatattttatctcatcagagactatatctgtttttttcttctagcataatcactggggttgtaacaaacaggtaatcatctaatgttggatggataaataaaatgagtttaaaaaatattctggcagcgcatgtaggctgaattggaatgacaagagactgaatttggaaggactcattagcaaactttgaaaatcatcaaagggaaagttaaggacagggtggtggcattgaggctagatagatggagatgtatagaaggaacatttccaagtggggctcagaatttgcacaggtgttattgggtagcaacccagcactgcgaggaagaggccaaagggccatttcaaattattagtgatcaggattaaaaccagtaacggagagaaaaataaatataatgcctctcatttatatagtgcttcacaacttttaaagtgctgttttatgttccccattatgccccttggtaggagagtattgtttctaaaaagacagccatttaattatcacttttctttataaattcaattacatttcccagtccatgtagttcatcagttcagagatgtttgtcttcatttctgtctattttttaacaggtttcttttatttaagttcctcatttctcagtcctgaatcctttatttctgaagcaccaggtaattttgtattacgcataacaaatctgaaatttatttgtatgagcagattgattttatatccatcagattttctaaaaatgggctataactggcttataatgacatgaccagccagaggctaatttctgtggtatttcttcctgatgccagaataggtagacaagtcagaagcacccacttcagataataaagatataattccagttattcaaatttgtgttgaaagcaaatcctttcactgcttatttttcaattagtgccaagtgtggctccatggcttctagctacagaaggccaggtgatcgagcattcttaaccagatacatgaatagggagaccacggttctgcagttgacatttcttcagctgctctttcagaggtcttaacattttttctcaccagatacttgcctgtgagctgctatttgaaagataaggtgtgctgagtaaatgattaagcaagtgagacaataagaagcaacgtaatctcatcagagactacatctgtttttttcttctagcgtaatcactggggttgtaacaagcaggtaatcatctaatgttggatgaataaataaaatgagtttaaaaaatattctagaacaggggagaattctagaaggttatgagaacctatgttctgggaatttgaatttctcaaagaaatggcagggggatttccttgaggaggtgctacactaaagaagagttcttagttctgagtaggtgaccatcagaggaagaagtgaggatgctgcttaaataggatgagcaaaggcaagtctgtagtagtgaatatgagtggctgggagaaggccagggggctggaatcaagaaggcagaaggacctttgagtgatgaggctaaacgtgctatgctagtgatgccagatcacacaggaactgctaggccacattaaacatttttatcttgatttagagggcactggaaacagtgaagaaagaggcttatttatttatttatttatttgcttttgttttatctttttaagccagggatttacaaaaccagttttacattttgaaaagatacagcaccatcctataagatttaagcatcaacttctcagccttgaccctttttttctcttgtaaatagtgatcatgataaaagaatcacagccatgtagaggacgaaatgtgagcttttaactccacatacctgagtgtcactgatcactctctcagtaggtcacccagaggttagcaaacttttcctgtaaaggaagagagtaaacatttccagctttgcaagcaatatagtctctgcctcaacaactactcaacactaccactgtaatgtcaatgcaactacagacaatatgcaaacaaatgagtgtgagtatatcacagtgaaactttatttacaaaaacaagaccacctagtctgcagacccctgcccccagatttcagcttcctgttatgaaaatggccattataaaacctatatggcacagttgttgtgattaaacatttttacatacccaaaaaacttagtaaagaatcaggcatattaatgagagttcagtaaatgctaacctgtatcatgattataagttttagggctgcaaggaatcttgggtgtgacagacaattttctcctttcaaaagatacctagatggaggattcaagaagtatagggacttaaccagggttacaggatctattttcccgcaatcctatttgtataccacttccagaaaccccaagaaatatgatggcatgaagccaagctatatattgcgggatatttgagcatccattcagcatgtatgcattgaatgtcagccatgtataagacattgtgcagtatattgcaagtgacacaaagatcaataaagttcctgcgttggaaaatctaacagtttaagtcaccctagtaactataatgaggtggaaagcgacaagtatcaaaggaatgagtgacccctacgtgccaagcactatgttgaagtgcttacatgtgttgtctcatatgatcccccagcaggtggatttttagcatttcatcctcaatgacattcaaatgttaagtaatctgctctaggtcaaaagttactaagtgatagaacaaagatttaaactcgtttctctaattgcacagtgtgctttctaccagacgctggggaaatcctcatacatgaagtatggtttagttagctattgctacaaaacaaacaacactaaaaagttgtgtttaaaatgggcatgttatttgcttgtgattctgtgggtcagcagtttagacttgactcagctgggtagcttggatgatctcacatgaggtccctcatatagctccagttatctggcagatagacgggggatgatgatggtctaatatggtctcacacacatatctgccagttggttctggttattaggctgaggagcctcacgtgatatctctgtgctttgtgacctctcatttggctaatgttgactgcttcacttggtggtctcagggctgcctcccagagaggtatataacaggagcagcaactcttgagagcttggaaatcatacaagaacactttcgctgtattctgttggtcaaagcaagtctcagaatcaggctagattcaatgggcagggaaataggtgacgtgtcttagtgggaggaacagcaacatcatactacaaaagggtgagcgtgcaaggatgggagggtttcttgctgtgtttgccaacaatttaccataaagtgataactgagttggaccttcacagaaaataaagatttgggaaataaagactttgccagagcagggattataaagaagagcattacttcagattagctgagaatgaggccacacgcctatattgcattattgaggaaatttcctcttgcctttgctccacaagcacattgcttctactagttgcagggacataattaccaatttcatatatataatacttctaacttttcagaggatttttatttctcctatataacgtttaatatgctatatagttttgttgcattgttttactctgctcattcctttcctctctgtaagttggtgtcgtcattgcaacaaagcccaggttcccagctcacttcccaaaagacaatcatgtggactatctgctgtgattgactgtggctgagtgtttgccctggcagcttttttgttgctgaagatgaaagtttgatggactttaagatggaaaggaaggaagaggagaaatttgatttcatcggcagctgtcttactcatcttcattaagatgggttgtggacacttcaaggccattctgaaccagtggtcataaaactaataggtgccactcaacctgcgctgctcgtattattgcctgagacctgtcatctcggtagttattgcaaaaggagaaggaatctactgtagggaacacaatggtccttgtgtgacagaagtgaaactgaaagaaatagatttttctattagctgcaaatcaaacccttgcacatcatcccttggaggtgacagtgcctgattctctaaggcagggttcaaacaaatcatttgggcttgcagaaaataatatgagattaatatccaagtgtgtgtgtgtatgtatttgtggggtgtgtgtgtgtgtgtgcgcgcgcgtgcatatatgacaactacgtggctcctcacttgaagttttggaattagctactaatatatgtgtatgtttaagggatgcatttgtggacttgaagttgaaatagggaaactgagatgtattctgaagagggaaggagaagagggaatccagtcctgattaggggaatattgaaataagtaggtgaataatattcagtctcccaggtttgtggctatgagctcttttcttccagaagtatttgctgaagggagggaagaaaacactccttttcttctgacaatcaaacttttcaaatgtcagcatgcatgggtgtttctctctattcttgaggctcctttttgtttcagtctaacacctcacatcctgtgggttgtaataataatggtagcagttaccatttattaagcccttgtcatatgccaggtgctttacatatattacagtgtttgtaatccatacaagaattattacaagatagatatcactatgcccaggtgtgttagtccatttgtgttgctataaaggaataccggaggctgggtaatttattagaaaaagaggtttattgggctcatggttttgcagactgtacaagcatggcatcagcatctgcttggcttctggtgaggccccaggaagcttttactcatggtggaaggtaaagaaagggcaggtacgtcacatggcaagagaggaagcaagagagataggggaggagttgtcaggctctttttaacaatcagatctcatggtaactacagagtgagagctcaatatttcaaggagggcatgatatggttcgactctgtgtccccacccaaatctcatcttgaattgcaatccccatgtgcagagggagggacctagtgggaggtgattggatcatgagggcagtttcccccatcctgttctcatgatggtgagttctcaggaggtttgattgtttaaaagtgtgacccttcccctctgtctcactctcctgctgccatgtaagatatgccttggttttccctcaccttctgccatgattgtaagtttcctgaggcttcccaagacatatggaactgtgagtcaattatacctcatttctttataaattacccagtctcaggtagttctttatagcagtgtggaaacagaccacacagaccaccaagccattcatgagggatctgccctcaggatccaaacacttccctccaagccccacctccaatgttggggatcacatttcaccatgaaatttggaggggacaaacatccaaaccgtatcaacagggaactatagctcagggaggttaagtaacttacccaacaacacacagcttatatgttgcaatgtaggaatccaaacccccaaagcttgtgccctcctactgcgctaccctgcctcttccaggcttggggctttagggaatgccctttacaagcagtataaagacgcatttaggaatttttcaatcagctcttgtctagatcttctttggaaagtcttcttagttactggcaggtcaaaataccagctacttgatctaatagtgttatcagcaagaaactaaaaatcatgaagcaatgcagactttttgaatcagataggacttactaggccatcttgtgattctaatctaacatcttatctggccactttttctgccttgtgcaggaagtgaggtctggataggtcaaagggcatgactagagcattggagttaatgggaatggggaatgccttctttgcttcttgacatttctcctccacaacactgcacatcccttgtgaaataatttactattttttagacatcatgtcaaagactgaagtgaaagccaccctcttgtgatcaactgaggtcagaagttggcaaatttttttgttgggggtggggggctaaagggccagataataaatatttttggcttttcacaccagaaagatctccattgccactagtcaattctgcatttataactgagaagcaaccacagacaataagtaaagaagtgggcagcactgtatccagtataatattatttacaaaaggcaaagagggctggatttggcttcccaatctctgccttaggcctttaaagatatagcttccctggggaaatctctacactttgagatttatactccagtactaataacatagtaagagaatagtaatggtggtggtaataatagcagtagtggcatcagcagcaacaacaatggcaccttttaacatttgcttaatacgttaaggtttacaaagtctttttacaattatcatctcacataaaccttttaaattcctactcaagaactacacaagcaagggaaacgtgctagctgagcagtgtggtacaatgaaaagagaatgggatatactgcatttagtcatagagattggtggtgtgggatgaaaatgcctagagagtaggtgtgtgtctcctggccccattaggggacagttcattcagcagcagggtgagtgtcggagttcccaaatacatggctgctaatcagttccctcactctgtaggcattttgcatttaaagctgtccagaaaagagaggcttggtctaagaggttgtggtgtaagaaaatctctacatttccacccattgccttttgggatccctgtatgttagtgagcaacagtaaaaagtgacctgtgttaaaaaggtaatggaagcatggtacaattttagagttcatttgagcaaacagagattcatgaattgggcagctccaaaccagaagtggtatggggattccaatgaagaagtatgagaactaagctattataaagagaatgcagacctaatacaaataaaatatttgattgattacagttataaagctgtctttgctgggaaattcctagttatgtaattataagtgtgattggttgagcttaagttctgtttgtcattattataggcatttacaagaaatagctcaagttaagttctgctgatgtttgcaattcaagcaagtctaaggccacttatgaggcctaactggctctgtctgctcaggaattcttgcaccattgaagcattcttcaaggtctccattttaatttagtttaacacctcttaacaccacgccttcaataacatttatttaacacaggtctttgcttcgtgctaaaggcaaacatgtatatgagactctgtccctaaagcatctgtaactctccaaagacatacccctaggaacatcctgaagattctgaatcttgcagcctgccagaagcacagcagtgctgttggcatctctagaccactgtctgtgattgacttctggctctgctacttgtcagctatgtaaccttgggcaagtttctttttctagtctctttgtcatgttcttcatctgtaaaatgggtattttttaaactacccatttatgtagtctgtgatgatttaagagctaatatggtatgtgtagtggttatttatgagctaatatgtgtatattagcttaatgcctagcattcgtaaatactcagataaatgccagtcattattattatcataattgctggtgaaattaacatacaaagtcctgtgcaaaccttaattttctcactatggacttcatacattttcagaatcctagctacttggttctcagaacattcttctaacacctagagattccacagccaatgtatctttgggaacttattgactaacacagagctaaatgaagtaagcagcatttgtaccctgacattttacagatggaaggaatcatagaggtcatctcagccagaaacacattttcaagatagggaactgaggttcatagaaagtaaatgactttgccaaagtaatacactcaggacagaatgagggctagaaccccggggattagtttttttcctctggcctcaaaactcttccttctgccatttttaacttaccaatttcacctaataccttccacatatttttgtgactgtttcaaagattccactagctaccatagaagaagtaatgaactaaccttataattccatcccagtggcttcacctcacctgccctcagtttcctcacctgtccagtgaggcaaacttacattggaagatccctaaggtggttcccagttcagataagatacaatcctaacaaataaagtggggtcggagtggaatgttcttgaaatcctggtatcaatgggactgggatattactctaaatctatggaaacttcaagaacaatatatttgttttaacctgaaaagacagttgcgttccagtgtgaaatagccaccaggctggatgaaaatgtgtgatgtgattccatcattgaaatgagcatgtgttgaccgtaagttcttctctttctctctggggacatttgcagtgctgcagagcttctctgtgagctgggatgctctgtcagcttaaatcctttccagagtgataaatatacattgattttatttgatttggcccataggtgggggataaaaaacaagacatcacagccacactatactgtatattcattccccctgaagacaacgcacacatccttgttgaagtctcctcatttagacaactcttcctttttatgcttcattataatgccactttcatgtcccttcccctcaacatcgtgcaccttgttccacatccagcactctgtgtttttaaattaagggaaatgccatttaaatatggtttttctctttgtaatatactcacctataaaaagtctttaaaggtaatgctaactgctttggcagaaattcaggcatatatatagttattttaatacaaggctatttgtttgcttgactgtttttaatgactactcattaacaccatgatcttatcctcatttcctctgcacagagcttgagaggtgctgttcacagcccctgctgcctgctttctgaggtctccaagatgctagctttctacttttccactcagccctgacacctagttcatcatttgagataagccccagttgtcggcaaattgcaatctcatcaggtctgcaagatagcatcttgtttgactcttttcaacaccttccattaacactttgggactaggtctttgggaagagccaggcctcaccacatgggcgattgtggttgatgaacagattctagttttccccattattgacttcattaaacttgacagcctttttagtctccagatagggtgaaccttttttcactgacccttattaagagctgtctccttaagaagggtcattcgagaagggatagtgggggccactccttctacttccaggaaatagctgattttggtaaacaactttgatttagtttttagagttctttcacctccctaattaggacagccacaatttatcaaatgttagcaatgcaccaaagcctaagaatgatcttatttcttcctccttattcatgggttttattactactatcctaatttcctcatatggaaatgagcctcaaaaacattaaataagttactctaggtcccatatcaataaattgacagagctggaattggaatcaacttaagtctgacttcagagcttaaggttttaaccatcatattctaccaccttcataatacctttagttactttattatattttaggtttaccccttgttattggtcttcaaaatccatgagttcattctgattttatgaggtgtattggtaatctattgtttcatgaaaacttaccccaaaacttagcagattaaagcaataaacacctattatctcattcaggctttgtgggtcaaaaattcaggagcagcctagctgggctcagggtctcttatgaaattgtagtcaagatattggcccaggctgcagtcagtcacctgaagccttgactgggctggaagatgtacttccaagtttcactcacatgcctggcaagttactactcattattggtagaaggctttcgttctccagcaatgtctgatcctaattttattttaccatagattagtgcagtcttcacatgaggtttcatttcacctctctttctctctctctctctttctctctttctttattttttttctctctctctctcttttcccctggcagtcttcttttggtcaagccatttgtattagtttgctaggtttgccatatgaaagtaccagtggcttaaacaacagaaatttattacagttgtggaaactaaaagtccgagatcaaggtgtcatggagcattgttttctctgaggcctctgtctttggtttataaatggtgatcttgtctctctgtcttcacatggactttcttctgtctctgtgtcctaatcacctcttcatataaggatactagtcatgattgaggctcatgcatctgagctcattttcacttactcacctctttaaaggccctgtcttctaatacagtcacattctgaggggtgttaggacttagggggttaggacttcaacatatgaatgttgaaatgaagtaatttggctcataataccatctttgtcctttgtatgtcttgagaatttccttttacactgtcttacctattacttatgtcatttctccattcttaacctctctttgcctcaagttcccaaagctattgtgcagccaactttaagagttaactgcctgcctttctgattgctcgttacacttgaaggacttaggatgctatacctgaaggtcttagagagttagactggtcctccaagcttatgaattttctagaaactttttaacttgcatatggtattctcctgaagaagctgtggctaaagtcagatatatttttataaactattctttgatcatgtatgagtgccaaaaaaaggagtctttaattactttgagggaggggtctgtgcatctttcttaacccttttcctggctgccctgtagatattccagaaagatttgatgtcttgtggaatggtctgagaaccagatggaagctagatgaagaacaaaatcaaaagtgtctctcttgtcttgcatgatagaaactaatatcactaagaacgcaattgagagcaaattattaagaatatgcactgaatgtgtacaacagccagtgtttgttcctcatcagcacagggaagcattcttttttttttttttttttgtgagtaattttattttattttattttatttttttttattttatttatttatttatttatttattttttaattttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtggctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccattgatgatgagcatttcttcatgtgttttttggctgcataaatgtcttcttttgagaagtgtctgttcatgtccttcacccactttttgatggggttgtttgattttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctaaggtttttatggttttaggtctaacgtttaaatctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcattatttctgagggctctgttctgttccattgatctatatctctgttttggtatcagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagctgaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgacagagggcatccctgtcttgtaccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgatattggtctcttcagaaattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatctctgttcttttacatttgctgaggagagctttacttccaactatgtggtcaattttggaataggtgtggtgtggtgctgaaaaaaatgtatattctgttgatttggggtggtgagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgttggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttttcctggataatatcctgcagagtgttttccaacttggttccattctccacatcactttcaggtacaccaatcagatgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctggagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgcgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgaggacgggcagactgcctcctcaagtgggtccctgacccctgacccccaagcagcctaactgggaggcaccccccagcaggggtacactgacacctcacacggcagggtattccaacagacctgcagctgagggtcctgtctgttagaaggaaaactaacaaccagaaaggacatctacactgaaaacccatctgtacatcaccatcatcaaagaccaaaagtagcacagggaagcattctaagcttttgccaggacgcctgcttattatatgctatggtctgtccaaatcttctgtggctgccactacagcctgatttcccttggaaacttggcagcccgtgagttacgatggaattcccaggtgataatgtatctaatttccctcattgtacttcttttatcctgtaatgtgctgttgattcccacggctgagctgtgatggagaatagccattattattgtaatggcattattcagtccattaagacttaaaacatacctggtaaaaatagtgaaagcttacaagtcttcatagcaatctcaaagactaataacttagttgttagtcttttcctcaagtaaactttgacaggtgtttgggaataattctttcctgggctgatagtatttgatttgtactatatattgttctaagtaaatgcaggaccaatgctccatcctattcgaaaaaagaaaaggggtctctgtagagaaactattaaaaaagtttaaacagcctttacagaaacgtggtttggtggcaaagaaagggaaaccaccaccccttccaaagctcaccaggagaaaagtgagaaataaaatatcaaaatgaaattgactccacacaaagatatctgatcaccagacaaaacaagtaccaaagtgcagaaaaatattacaataaataacatcagattctttattcaagccaggcaaaacttatgtagtttttcctaaccaggttaattattttcctcatcttcttttcctttaatataaaaaagggatataagaaagcaagcctgagtatattcttggttgctctgtttcttgtgttagcctagccagaacgagctacaatagaaagaagttatactttagaaaacaatctatttaatataattcaatgctacacaaagctttatttcttaatatggacaattatttgctactggaaagaaagcagagcgagatatggccctttggggagatggttaaataagaaatacatttccagatgatgtcacatgtaaatagcactccgaaatcactaggcatcaaaattaatcaggctgaatccattgctttgtaaggtgtaaatcgctagccttacttaaccttacttcagtgctgggactcccgaatcgcgaggaaggtatgattcttatttcttcacacacacacagactgagtgttctcaagacaggaacatgattgagaatgctggaaaaaacattacattaatctacattgtaagagtaccatgcaaacatttgcttgtttccaacaccttgtaaatgtatctcgttgttgactcaaaatgaacatttggtgcagatactgagaaaaaagaatgtacttagaacagggatttcattacttctcttataggtctcagctgtggagattgtttagccaacaagaaacccaatctctgttaggtatcttgtctgagatgatattaaaaatattcaacaaccagtaggaaatggaaccaatgaaaatgactcaggtcccctgctgagactggcattgacctgttagttgttgaattgtggaaagaggggaaagggaccggatgatcggtggtaagggtatgtttgaagcagtgacattcatcatctatttatgcaagtattttaacattttaataattgatacagttatctgggtgcatgccagttgacaacttgccctgcatattgataattttaccatgcagactccactcctcaggtaactcttgttctattacactggactttatcatcatgtaatctgtcctgtccctctctctctctctctctctctctctctctctctattgaattctgggggtgtagtagtccattgtttagagggaatttagaagttttcctatattaggaagtgtattcatttcctaggaatgccataacaaagaattacaaactgagaggcttacaacaatacaaagttatcatatcatggctctggaggtgaaaagtctgaaataaaagtgttggtggggctggacacggtggctcacacctgtaatcccagcactttgggaggctgaggcaggcagatcacttgaggtcaggagttcgagaccagcctggctgacgtggtgaaaccctgtctttactaaaagtacaaaaaattagctgggcgtggtggtgggtgcctgtaatcccagctactgaggaggctgaggcaggataattgcttgaacccgggaggtggaggttgcagtgagctgagatcgtgccactgcactccagcctgggtgacaagagcgaggctacttctcaaaaaagaaaaaaaaagtgttggcggggccaagatctctctggaggctctcagggaggatccttccttgcctctttctaacctcttttgatttgctgacaatctttggcattctttggtttgcagctgcagcactttgatcacggccttgttgtcacatggcattctcacctttagtgcctgtgtgtcttcccctcttcacataaggatgcaagtcatattggatgacttatcctactatcctactatgtctatcctactccaatatgaccttatcttagctgattacatctgtagtgaccctatttccaaataaggtcacactccgaggtactggggggttaggatttcatcatatcttttgggagagacacaattcaactcaggacaggaaggaaaagccccggcaaccgaattgtattgttctgctagatgatgacaagtcataatgtagagaagttgctccaaagtgggatacatacattggagggcagcatagaatgaaagttttagaacatctatttatatttattttaatcgtattcctttatatttttgttatagtctgtttcatagcacatttagtgtataaatataataatacatgtctacgtgttaaaaatgaatgaaaatacctacattgggagtgggctgaatccacagaaagttttactgatggtggttcagggaatgtaagcaaaaggatttcaaaccaatgtaagagcatgaaatattaatgacatgtttcagataaaaatctctgtgtaggtttttcatagccccaattcaagttagactgggcaagaaatgagattatttaggcaaaaaaagggaggagcactaaattcatccacaattttaaaagtatcttctttcaggaggcttttggacagtaacatttccaaaaaaatatagtgttttatgccacagagaatcaagttgcattgtgtatactaaatggtcaagcattttcaagaacatgacaaaataaaaacatacaaatttatatctcaaaaggaaagtatcttctttcatgtcagatcatcagcacagaagccctcgatgcatgcaaaggcaagcacaggctctgcagatgagatgtgaagaagcaattagggaaggaaggaagggacagtttggatgctgggtcctgacccagaaacaacacggagtagatctcggatttgctttttcttaggtccaatgctaggacgattactttatctgtggtgaggaatgttataaaaaaccattgttggaatgccaccaaaatacttctttcccttttagcatcatcaccaagattctagaacgaagtaataacagttgccaaccttgagccattctccagctgttgtcatgtttcagtcagacaggaagtgttggcgagtaatatgggatttattgggagtgttcctttacgtgagtccaggaaataagaactagagatgagcttgggtgcctctgcttcttttatttctatggaacattctttggggtcagttttgaataatcactgggcattatcggatttctatcactattttttgcatgttcttgtgattattcaccagggaacattttataatactcatattaaatttttatttcttaatttcttgcctcattactcccatttgcattggctgcagactctctaagtattactttcccttccttgtggttcataccctaatcattgaatattgatgttctatttatttctatgcactcactttgtttttgaccaagttatatagttatttggttttcaggtaatgctttcttacagttactcaagaatgtatgctagaaaatgttgcccataactgcttaaacataaaagaggatatgttttcttgttttccatctatgttacagtctgtttctgaaatatcctttattatgagtagaataaaatctactggacttggaatccacattcccttttaaattaaaagtattcccagactttcaaattttacattccttagcatgatctcttctctataaagacagaagaggggacagaaaattctgactgatcatttcttgagctagaagcagctataatattcctgttctccatcctttataattactttctcataaatactaaactacacccccctgagcatctagaagatttaaacactgatcaaaggcaggtttagctgtatcctcaggacaagctgattcaatgaagaaaagctcaggctcttggagagcttttagaaagagaaataaattaacaattagcatttaacagcagtaaaaactgcttagcggaagcagacttgatgttttaggggatttgagatattcggagtgatgagatgaataggaaaaactgtgttccaattaggaagacagagtgaaaaggtgtgagatgtggtcttctagttcattccactggtgatatagagcctttcctggacagatttttatcttttttgagtaattattatccacgttataatttcatgcctgttgcttttaggtaagctcagaattatagtcatggcttgagtaaagatctcattgcagttgagtactagcagtaccactactcttgcatgagttgcattctctcttgaccagctctgttaatgggtgtccttatgtatgaaactgattttcttactaatggcaggattctgtctggttaggatattccctgaaatgcccaagggtgtattttgcttaaaagcaaggctggccagagaggtttggtttatgtatttatttttaaatttcttttgtacctaggataataaatatattcctctagtcttggataataatataaaattacagccatactgacaaaattaaagaagacattaacaaaaaattcagattaaaatataaagttcatgtctttggcaagtacacacaggattgtggttttgcccaaggtgtctaattaattactataatttttcaattccctgtgttcaataaaaacacgtctatgaaatgctattcataaaagcagaactcactggtcattaaacatgcaaatatccacgaataaatacacaattctctcttgcaggaaatgctatcagtagactaaataagtggtggacatttttctacagtaagtatttacttttcctacagtttgatcttaaaataccacagttggccagggcctcatgtgttgctggtgcaatctccgcattgttaatgggtatatgaagctcatgatgatgtccacaagatgataccgctattggaaaacttcctcattcttcctgtctaaccagtagcataatggatatgtgaatagtgcctgttttgtacattttccctcaggtaaactgtgataggcctttgggaataattcttttcaaggcctgaagcatttaaagtgcactgtatattgttctaaatgcaagaccaatgccccattctatcagagaaaagaaaaagggtatctgtgggaaactatttaaaagattaaaggagctttgactgaaatgtggtttggtggcaaagaaagggaaaccaccatcccttggtacagtattaaggctatatctgggaaaaccaacaaaacgtgtcatatgtggatagatcatgacactgacaccattagcaaggactttttttttttttttaacagcatttcttgtgctagtttcccagtgccaagaatggcttctttatttattcttgaactccaatacctatcacagtacttggtccttacttggtactcaataaatgtttgttgaatgaatctattttttatacttttgtatcaaactatcacatctgagcgattttgtaattttattcagctgatgatattctttataccagtgcaattttccatatgctcatgtgtgttttatttctcatgatatcagtttttctttctttgaactttgtagttccctgaattgcttagtattgtttatatatgactaaaggcccaggtggataagatggtatctttctttgtttattgtttatatatgactaaaggtccagtgaaaggtaaaaaatgagtttgttagatttcaaaatcagtcaaaaggtaaaatcagtgtgaagataagataccatcttatctaactggacctttagtccagtgaaaggtgaaaaatgagtttgttagatttcaaaatcagtcctaactaaaaaccatttcccctactggatgttgtaactcacatcattacaatttatggcttaatgaaacatttatttttctgaacaacttggatttcagtgagcagatttcttaaaataaggacattctatttttcattatagtactaagaatgctggaacaaatattttttctacttacatacttgagttcagttgaattattttatcaggtatttgcaagatgacctggaatatcttggaagttattatatgtaaattatacatacacatatatgtgtatagttcctggcattgggcaactagtataaggaatgctgcaaaaaaaatccttgctaatggtttcagcatcatgatatatatatacatatatatgcatatgtgtaattacacatatctatatgtataaataactatattaatatacttatataagctactacatattaataaatgatcaacatacctatattatttatatataaactatatataaatataactatatatatacacacacacacatatatatatgtagttgtagaaagggtcttttttagtgaattaagacttcatgaaaggccagttatagtggctcatcatgcctgtaatcccagcattctgggaggctagaggatcacttgagcctagtagttcaagatcagcctgggcaacacagcaagatcccatcttaaaataaaaaagatctcatggtaactaatatttgatatgtatgatatatgactttaagcaatattacgtgacatcacctttctcacattctaggttgctgtttacattttttgttcagtaatgaaacaaactcacgaggaagtaaaccaatcaacattttatgcatggagttttctaaatccttcatgtggctttggtagcattttgattagaagcccttgaattctgtcctgagtgcttacccattatctagtgatttacagagtttacaggaggacaccgaaatcacaggcttgaccgcatttacggatggcacagataccagatccaaaaagtttttaatgatctggaaccatgaagtgaaataaacaaggagcccagatttcttgaagacctcctctatgccaggcattttatgtctctcaattctttgagagaacctatggcatgaagttattaatttttttctagatggcaaaactgaaaataaagtatattcaattaatttctcaaggtcatgggattgaaaatactgtgactgaaaaaaatattttaagtcttcctgatcctagagtctatcttcttacattaaaataaacatattaaataaataagcacaatcagtttaggaaagatttgttttgatagaaatccatgcaaagcaggtcagggaatttcagttgaccacagattcaatggggaacatcagctaatgagagaaatgtacagtgcaaattatttcattgtacttagtgctagtcaggcttaataaagggtatgatactttggcacctcattgctttcacaaacaagaaggcattctgagtaagaaaacatgaagacaaagatcctaaacctttatcttgtggatgacagctaagaatgctcaggtaagaaatgactgtagtgacggcaggggatggatgagggctataacatctgttgcaatacatacactgaatggtgactttttcttttttaaattgacacggggtctagctctgttgccctgccagagggcagtggcgcaatcatagctcactgcagccttgaactcctgggctcaggtgaccctcctgcctcagcctcccaagtagcttggactgcaggtgcatgcaaccatgccccactaatttttttatatatttatttttagtagcaacaagctctcactatgttgcccaggatggtcttgaacttctgggctcaagtaatcctcttgtcttagtcttccaaagtgctggcattacaggcatgagccaccatgcctgccctaatggtgtttttaaaggaggaattagctgtggtcagtacagatttatttggaagaaatggaatctgtgcttagaagccaaaaggcccattattattcaataaaaggaagctctttagaacactttgaacctgaaagagttaatgaagcatgagacattagggttcccatatttagtttagatctatgtggcactatttttagaaggttacattgtttttaatattttatatagtaggccgggcgtggtggctcacgcctgtaatcccagcactttgggaggccgaggcaggcagatcacaaggccaagagatcgagaccatcctggccaatgtggtgaaaccccatctctactaaaaaatacaaaacgtagccgggcgtggcggtgtgcgcctgtaatcccagctacttgggaggctgaggcaggagaatcacttgaaccaggaggcagaggttgcagtgagcctagattgcgccactgcactacagcctgggcaacagagtgagacttcatctcaaaaaaaaaaaattatatagtataattctaataatgggatgctccacttcacttgcaagtacttgcatatggaggtgtttttttccccagtatgaggagagatcaacagtaaatacctatattatttctattgctggtcaatgcagaaaatatttgttaagcacgaagagtgtggatgtgtttgatgactacagaactaaggatttctcaaagaaacaaagagagaagtctaagttcaggtgtggaagcccttgcctaatttgcttcttcacttttgcccagaaataatttggccagggattgtgttactattgttgaattaaaccagacagaatcaggcctataagaagagccgtttagtaaaggaaatgattctgtgaaaattttagatttgataactgacatgggaggtgtttaccttcttttgaaaagcagatttaaaaaattgaattaaatatacacacagacttttacactcattttcagggaagcaagaactctatcataataatcaccaaatatcaattaatcagaaggaaaaataggcttgcaggaagagaaaatcagttcctttagacaaatggtattgacatagagattccaggtatgtttagttatataccatgcattctggatcaaatagagaggcttgtgacttgtatcagtattacctggcttcacagcagcaggagcagagaaaatatgcactatgtttagagatgaattaggagagtatgtctgaaagaaccagggatgcgtgggcaggtagatttggtcaggcatatttataataatgagccattggatttgggattgggtggagggaataaagtcagaaaaccattgggtcatcttccctaataaaagagaacgtctgtggagttataaatagaattgcctaatatttcatctaatagctttattcaatcattagaacctaagctttcttgtatcaatgtaaagtatgtgtgtgtatatatgtatatatattcatatgtgtgtgtattatatgcatatgtgcatatacatgtgtgtaatgaaaaaagaaaacagccctgaagaatcctcaagaaactgtcagacgtccttgtcctttaaaagctccagttgcccttcttgtctaaacacatcagtgcagtgtgaatcctgcattattcatgaacacataaggtctgtatttgtatacatttatctcttggctatttatttctataatctctgccccaaaccctcgccatgctttgtctttctcttttcctacttttcttttttttctggtagtttgaaaaataaacattagaaatagctattttattgcttacttctttcctttaacatatggcatttgcttaacctcttggagagttgtggttttctgaccctggagttctgatgggaaagataatgagaagtgtttacttagcatctaggccagcaagctaagaaaaacattgtgccatgctagtattgacaaggtgacagagagcccacacttgcctcacatgttggccactcccgatgctacatcccactttactcttgctggaggactgacattaatgcttactgttttgaggtctggacataatcctggtagattctaaaactcctagcaaacagtggtagacaagtcaagggtctataattgcgtataaacagaaaagtaaagacttacatatttaagcaacctgctaatccccatggtcatttagttccctagtggctatttttaatttgtcttgtttttagaggcactctgaaagcatgaggcaggtgaaagcgtgtctgtgtgttgcttgcatgcacatgctttttcaagaaggtcttcttcttttcttgtcaagactgcagctgtcaactgttccccaaaggtgttgcctagaatcagcatgcagcgctgtaggcaacctgtcacttagatgagacaccttgtatatatgctgtagttcactctctgacttgcctgtgtgcacaatgccatcttgtctgttagaagacagggccatcgtgagatgcagtttctctttgagatatatagtagctcttctttcttcaaaaggaaaaaataaaaaataaaaaaaagctactcttgctggaaaggtagagagaagggtctgcgggtgccctctaccattgtggtttcaatgtctaaatcttctggagaggattgctgcagtgatgagataaaagcagctgcctttccaagtactgtctatttgcattgatatttacattctttgccaaagtgacatcattaacatttgcttagtatttgtgccacagggatatgttttacataatttaagacttggaagtgatgataatgtatttcagatgggcagtagaggccacagagtgctgaatttcatcccctttcttcttaaggaccttagtgcataaataagtccctagtccgtatccctaaatcatattaacaatactgcttactgggtgccaacaatatgtctggtactggactagatatatgtgtatatattgtttagcccccatgacaacagtatgagggtaggtaccattatctccattatatagtaaagaagcaaggctagaaaaattggtgacttgcacaggtctgaattcagagacatctcaccgcaaggacttttctccttatgctgtgtcattctatctcccatcttgtagcctacttgtttcttcagatttaagaaacagaaaccctatattttctcaggacatgacacttgaaataacaagaaagaatattgtgggactctgaccttggtccgtttctgtctctttcattctcatctttactctaggtgcccagaaactcttctttgaaataaatataaaagatctgtgtttgctttgagagaaagccacataacattgtcacaagccagattattgaactctgccagatggcccttatttaccaaatatatgttttagttttatatacgaacagaggttttaaaaagataaagacgaacaaaattgtgtttaatgtcctgtatgataccttttgccttatttacaaactggtcctctctctgactgtacctgctcctgatgccccatcctcaatgtcctccatcagcataaaaaatgtgaaacctctttttcaaaaacaaatttaaaaaaaagtgctcagtctctcatcttgagatggagaattagaagcaaatttgcccttgcttttcttcttaatcttccttcttcccaccttctttccctcgctcccttctttcttctttctttcacaccatgtgccccagaatgacagctcagggaaagtaggcattataagctgagtagccttttccttgatgtcccttgaagggctccttatgttcagagaatatatcactgcatttgcagctcccccagaaatgccgtagcttggaggagcctattactcacttgaatctctttggtgtagacctataaatagattctcgtcttttccttgtaaccccctatagattcttgattcaagggtcaaaaatggagagatgagagttcaatcttcttggaacttactgacaccctagctcccttttaagaacttgtcctccttactaacaccatctacatggccatctgggtcttctcagctcagaaacaccctgcaacaatggctggcggaaataaggggagggcccatttgaattagcacattcccccacaagcacacacatccatactgccaggcctctgtttgtccagtttcctcctcttgtgctgttcttcccacccttctcctcagtgcagttcagatatcatctgtgtcccatgaagtctactctctcccaggggaaaccctttgaatttccattgcatattattctgtgcttctttttatgattaatcccatttaccttgtattatataaatatattttggtccttattagattatatatacttggaggaggacagtatctttctttggtccattggtgtggctaccacaggctcacagcatggcatttggttgcctaaaatgatatgtcttatccgttctttgatgtacagataagaaaagcctttatttagtttggctttcattttgttcaagaacagtggcacagtttggtttttcttgatatctttcccttattcatggttgcttttctcaaacagcacatgtggggcttaatacctagatgatgggttgataggtgcagcaaaccaggtggtacagggtcctgtgtgactctaccatggtgcacatttacctgtgtaacaaacctgcacatcctgcacatgtatcctgaaacttaaaatttaacagaaaaggaaaaagaaaaagaaattattataaatgtaaagtaattaaaagtatattatttaggagggacagtagatatcacaaaggtaagcatgtttcattctcaaatgaaatacacaaatttataaaagtgaattcagcaccagtggtgaatataaaaggctgttaaggaggaggagctaaagttttgattggaacttgaagaaaaggtatgttgttataggcagaaaacttgccatgcaggtgatcatgttagaatcagtgtcagacattaacaaaacattttcagtcaagggcagagagtaaatattttaggctttttggaggctgattacataatttgcacaatgaaatagtgggtccctttttcaaaaagcaataacgaagtgccatgagaagtacttaaaacataaagctctttttcctttttccatggtttctctctctaaacttgtcatgttgttttatatttgctcttcagtgtcattctaaggaaagaaaatgttaaattattagcatgaattttgccattcatctttatattatgccatgccagtcttaaataagttctgaataagaacttctaattcatttgcagaattactgacataggaaacatttcttatttcatagctcatgcagtgcatatatgttttgttcttaccagaaaactggacacactgcacagattaactcacctgtttttatttatttcacttcttgatatacacatattcaacaaacactctcttcctttggcttcctaatgagtaagaaaagactgaaaagaaaagaaactgagttgctttttcttttcttttccttctttgacataattttcagctgaggtggttggtcaattcatggaagtaacatgagtaagaaaggctataattaggttccttagtcatttatgtttcttagaatgccatcgttttctttctgtgttcaaagcaagttttggttccaatggaaaacatgttctttaaggactgtcagcatcccagcttactcagagtagatgtgagagactttgcaatcgctttgagtctcattgagtgtgcatcctaagtctaccagaatcttctactcccggggtattgtgagagctatagggggtgaagtggcaagaaacaatgggcatgtgtatagtatatccatatgtttatgcatctctcttttgctactgcacatgcctaattgtttcattagacttcattcaaaaacacaaattcaaagataaaattattaagtgtttcaagacggagagacaggagaatattaaaccaagagcaggtggtacagggtcctgtgtgactctactggctgcatacccatgaagcttcacctgggttttgcaagccatatggtctctgtctcaagtatttagctgttgtaccatgaagtgcggctataaatgatatgtaaacaaatggacgtgactgtgttccagtaaaactttatttacaaaaaacaggtagcagccagaatctggtctgtgggccattgtttgttgatccctagttaggcaaaaacatggagatgagaatatgtgagccttgtttgagaattgcttagctagtgtgaggtaagtcagggaatttcagaagaaagccaattatgaaagcatggattggactgtttgaatattttcctctagttgataaagtgactgatggctttagctactgaattaacgtgatcaaaagagtttttttttttttttggagatggagtcttgctctgtcaccaagctggagtgcagtggcatgatcttggctcactgcaacctctgcatcctgggttcaagcaattctcctgcctcagctttccgagtagtgggaacacaccactacttccagctaatttttgtatttttagtagagatggggtttcatcatgttggccaggatgatcttgatctcttgacctcatgatctgcccgcctcggcctcccaaagtgctgggattacaggtgtgagccaccgtgcctcgcccatcaaaagagatttttagtgaattaatatggaagtgtcctatcacagagataggaaggggtggatctgttaatagacagatgaacaagggagctattgtgagagtccaggtatgagatgataacaacttggagtattaagaagggatttgcaatgatggaaatatttgattccagaggaattttaagtgaagtgtcaccaggatgtggagagtgatttgatgttggggctgagagaagaaaagatgggaaatttcaaggtcttgtgcccggaaggctgcaaaatggatagccattcattccctgaacctgtattgtgtgtatcttctgtttgctaaaataaccatgaacagaaatggctggtgggctgctgattttaggtggctgcagaattttggtctatttgagttgatgttgggttgcctaatacacatgatgcttacaaggcattcaagatgtgtcactggcatagaggagtggagtgagggatagaagtaaaggtaggtagcccatcttcacagaaaggtgaattagaccagcgacagcagataccatctcccaatggagaaagcatagagaagagaaagaaaaagaaagaggctctaataccctaatcacttacataccctagtgtagtcctctatgcttttcaaattaagtagatatttcactttcctgtttaaccttgcctggaaagattgagaggtccatgtctagtcacaatgttagaatgaaataaatgtgtgaaataaatcatgtttatagtgtagatccccttcatcttcatctttgagtcaaatgccaaagccatttgttggctcagtaacgtttcacttagaaaatgaaacttttattttggctaaacgagtatggtgtcctggtcctttcccaaaaacataccttcaattttaccctagctggctgattgactgtttcctttacagatgcagtctagggatgctaagggcaacatcctttgtgataatgaaagccttataatgtattttttccagtaacttaggatgctgtatattaagctgtatattggtaaatattttgtctatgtggagaaatgtaaatgagatttttttttcttttcatcattcttctctacaaatgtgcattgaaaagacactgaactttggtcccatgcttatgcacaaggtataaaagttgcttatattcctaacctctccacagagttgtctagattcacaggactatttggtcaaatgttctgcaattcagttccactgcttgactgtaattcacctataaacccagaaaaatactgctggagttcagaggccctgactgttattagacagagaaaacctatagcacactggaacaatcacatttaaaagatttgcctcaagctttctatggtcactattactctttaatttatgcttttaggtttcaactttgaaatgatattgaaattttcattatgggcaaccctgaatctggaaaaatccaaggcagcttttaggacagtcacctttaattacccaccaccgttaagattaggaagtaaatgctgaaattcccatgtaagtgtattttgcaagaaattttcacactatgaaataattggtctttatctctcatcctgtctgattctctatcaagacatatcaaacatgcacccctctgctcaaagtgtaaaaaaaaagtttgctttttaaagttttaattaaggcttttgctgtgtgtgtgtgtgtgtgtgtgtgtgtgtgtgaaagtactacacactttagttgtttaggtgtcattgttgagacatttagactgtatttcattcaggcagatacttttactttattacattcccaaatgaggaaatgtgctgattagatggaaaagcatgtgtgtatcttatagtgttagcaatttggcacggtttttgttttgttagctctcagcatggttgccttcaactatatttacaccacatgggtgggcatgtgttaaagatacaaaaatcctcagacctctgaattgcattcctgaaggagaccttaattctattaggttggtgcaaattaaaatgccgttacttgtaatggcaaaaaccgcaatgattttcgcaccaaccttatactgcttattgcttttgcctcttctgtaatgaaaggcttctaactggtttgcctgcctttgattttagctttttgtgtagccttggtcatatcaagtttctgctgaaaaatttggcatggcctttgatttcccagtctcatctcctacaactcaccagtatgcaccggtagttccagtccgcaatacgtcctgcgctgtcgagcttacgcacctttctgtgtgctgtttcctctgctaagaatgtctagtgaacttctactcaccgtttaagaccagatttaaatggcatcttccttacaaataagttgattgatctatcattttattgattctgtcattcagaaacattccttcaatgcatgctatgttctgggaaactttctctaaacggactcaaacatttcttcttctgggttttcccagcgctggatactctgagtcattactaatccacactgggttcttgttttctaggctgcatccctcaatagactgtgaggtctttgtgagaatacaattgcttttgtgtttagttccatattcacagcgttcattctagtgtctggaacatagggttccactacatgcactacacatttgttgactagaaaaatgattcgttttatcaagggactgtcttaggaaatactaagtggggtgcctttctgatacattgtaatgaccacccttttctctgttctctaacgttgtatcccaaagtagataaactagagttttatccttaccaaccatctttctctcatctccatcctactttcccagcactcccctgcacccccctgctgtgtgcaaagctccaatcccgggaaaataccatgcagcgctttcattctaaaggggagcaattgaaagcatttctttggtaatttaagcacacagcagctacctttgcaaaagcctggttgctaaattatcccctcaactactcattttgcaaaagggaaaagaaaaaaaaaacacactggggggatagagactctaataagaaaagagtctgtgttttctttaggttcagcctgattcctctccacctcctctcccttcagtgactgcaaggctcctggtgtggctcgttctgctacttttccttttaatgttttaaatgccacaaatgcttgtcataaaccaccttcttaattatgcagaagtggagctgaatggttagttagcagttctattgcaattactgcactttttcaggtctgctgctgttttatgtggcactgttttctaagttgctgattaagatgatgtagtgggtggagttcttcttcccaccattggagaagggccgctgaagcctgggataatgagtccttaggcaatagtttatggcctaataagagttaaggatgggagcaaggaggagatggagagttatgctcattcatttccttcttaaaaagaaaaagccctctggttttgttcaacttttgcttctcctttgtccagtgtagatgctgaaattgctagagaaatatccatgatggctcttagcagtcctaatcttatttggacctgatattctgaggcttttaggcatcttcagatatccttgtgcagtgaaagagccttgcattggagttgaaatgatgacgagaaaatttaagaactgttgagaatttgaatcaatctcttcatgttgccatctctctctctctctttttaaagccaaatatgaatactgctgtgtgccgatcttgagccctgagaagctgcacttccagtgtagttctaggtccccactgaaaataaaataatgtgaaattgaaagcagcatgctattgtaaagtagtgcaatcattcgttcattcacaggtacttactgaatgcctactatgtcctaggcactgtgtgaggcccaggggatggggctaaaaacaatataaacttcttgcctttatggaatggcattctagtcaggtatactgatattaaaccaatctggaaataaatatatactcttcaatggtgctatgaaaaaaataaagtagaatgaggtgctataaaaaaataaagtagaatgagggaatggagagtgtgctagggcatgctattttgggtggagaaggtttctttgtggcagtgacattgaaataagtgcctgaatgaggcaaagcaacaagatgtaaggatatccaagaagagcattccatgctgaggaaatagcaggtataatcaccctgaaacaggaatgcacttggcttattggagaaacagtgggaggctgatggctagaagacagtgagcccgcagggcaggacagggggtaaagtgaggtcaaagagataaccaggagcatattgtgtatggccttgtaggtgaacaaatgggctttgaatttaatataatttaatttatattttaaaatcatcttggcggctgggtgccaattataccataaagaggcaaagtagaagactggagccaccgaggaggctgctgcaggaatctaggcaaaagatatattagtgtggtagtggcaagcgtgctacattattatgatgtcctcggccttcttaagtgtttgcttcataaatcagtagagttgtgagctgtgacttggacctgataatgaatcattacttattttaaaattgatacatacaataacattcttaattttttataagctcatataaaatattgaaggaggattggtcttattttgcatctgtttattaaacattagactggagataaggttgtgaggccctagagccaaataaatattcccagccttgcctggcagacaattattgggtgtggaggttacccagcctccatgttgcctcagtgactccctttcctgtccttcactaggtaggaggcaaaaagctcagcagtgacacacaggctctgctctcctaattgctgtaaagaactgtgctgtttcttcttcaaaatgttgattgcaggcagctacagggatgtgctcttatgttacagtataaagattttttattgtaaagaaaggagatttgttggcatggtgggatgtgtgtatttgtgtgtgtgtgtgcaagtagctgtgcttgcactgggagactattttactttgcttttttcctctcccattataggaagtaatttttggaggaaaatagtatgacagtcctgatactattttatttattttcttcttcagagtaggtacaacagaaaatcctgaatttatgcttgttgtattttttctccctattatatttctgcgtgttcacacccctctattaacagagaaagtttatgctatattctgtactccttttactctttttattaagagaaagtgagaaagctgtcctagaattatacaaaatatacatatatttttccacatctgaagggtaaaggaattgtaattcatgggaatagagtgttaagggcttatacaatgatatatactatatatatatcattgtttgtatgtatgtacatatattgcacatatatacatatcactttttggctctacttttattattttcaagtttcttttatataaccccagctgctcttctgcatttagttaagtgcagtcctaccatgtctagaacccccttctattctgcctacattcacgactttcatccctcaactctggtcccatttatctgtcacttagcattaactacgttataatgccatttatcccttttgtgcatgcattatttctactcaagtgggccatttgcttttttagggcaaatatcataatatgcacctacttatatgctccacatctgcatcaattcagacagtttggttgcaagcaacagatactataggcttagactacctcaagttggtcaggaatgtattaaaagtctttggggtagcttacagaatcaaagcaaagactaaaggaagaggtttccaaaaacaatcagagaatcttgggaggtctaagtaacagggactaattaatagctattttaggctgcagctgctagaatgcataaactccaattatttccccccattcttacaacagcctgctgaagcctccaaggtattgggtcatgtgcttacccctaagagaagcagaaaaaaaaatcaccttttgacaatcctacacctctgtgaacaatgggaaggagatgtaatttcccaaaagaaaaccgggcactgagtggcccaaaacaattgtcctctataatatcaagcatactttggtgtccacagttggagctctttacagatctggtgtcagtgatggtgacgacaaggagaaggaagagttgtaaatgactttgctcttttgagtaagtgatcatcaaatgtccttgcagtcagaatggcaaacaaatggcatggcctgtcagtatctgaagttaatttgggctggctgtcctttctttttggatatttaggtttcagtaatgatttcccgaaggccacaataataaacatgtgttatgttataaaaagcgggtgctgcatacattggaagcaaggccccctaattgaatcacctgtgctatgactctttcaactcctaaggcataattgaagcactatctcagttggcatctttgtggtttccatccacacattcttactttctggtagctggattatgaacaaccccaaggtcaggcttgtgtagaacccaacatcttacatattttactattgataaaatacaccctgagtataaatgttcacataacactttctctcatctctatagttatgtttctttcttatgaccttggccacatactttaaactccttgggaaaatatgctgccgttaaaaacgcttcacctatttcttgaaaaatgaccgacaagatgtttttcgtccaattctgtcgtatatttctattccctagatttaaatttcctggacttaactgttccctatagttagcagaaacattattttaagaacaatttaagttgaacttcatgtgaaactggctactgaatctgagtcgggaccttcttctggagggaggtaattaaatattccttattgatgctattttaaatgtgttgaatgaaaggagttaattatacagcagggaacatggcagagttctgactaataatgagctcaatgtttaatgtcttcatctttgttagaatcattaaagttgtttgaaccaatcagatgtttcaagtgaatgtagactcacagctaaccagctccaaatggcaatccctcacagatgcaggagctggtatatctaatgatgacttcaggaaaaggatggcgatatattgctttcttccatgcagtataatctgtttcagttggtcttccatcgtgatggtaaagagaaaagaataagtcttatttccaaaatttcatgtgttataatggaatgatgtttgtgcctggacatataaaagaggaaatgattttgttttttccttaaagttttacgtagccaatctctttggaatctggtgcaatattgacatttctggctgccaattcctcacatgataaatgcattaacactaaatcttaggatgcccaggaatcactagaggaccaagcactgtcctaaagaatggatctcctgtaatactgttgtagagaaatgtaggctcttgaggtcaggtttttcataccgtattactggtttgttatgtgtctttaaataaattttgcaaactccccgacactcaaactacttcctcttaaatttctcctcccttctgattgcttcaccaaacagcctgtggctttgtttttatttacaggactcctaagactctgtcctgtcctgtctatgctggggaatgtaaagtacagaagattacttccttggttctccatggaagtccttttacccagctgtgaggattgtaacaatgattggcggtgacatcactctattactgaacttcacatatgggagttgggagactttgaggaatcagtagggtgaatttaccaagttctcccatgagcccaggcagccggggtgtgtgtgtgtgtgtatgtgagtgtgtgtgtgtgtgtgtgtgtgtgtgtgtgtgaaggaagagtaagtgttaggacagaacagcagccatcatgggaaagggaaatcctagttccacctaggatggttacttcgtggagagggttactttgggtagttacggcagccttcagggttttcaagaataatataacatatatgatttatatttttgaacttcgattttaccactgcgttccctccagtgtacttagtagagataggatcatgtgtatcgagagctcaggctttagaatcccacaggtctggaatgaaatctcagctctgacttttactacccatgtgactttggacaatttatgtatccactgtcagcccattagataacctttaaaatgggaataaagtagtgcttgctttgcagaattgctgtatggattaaatgagataattcaggtaaagcacatagttgagtgcaaaattaatttatcacatattattagaaatgtggttgaagattgttttgttatttagatgaatcatatttaaatctttcattttcaagtatctaagacttccaaggactaaaacttccctctgaattttaccactcatcccagctggagatctaagataactatttttgtgtttgtttgttaattatttgacatgtttcttctcaaattaagggaaaattcttatttcggagtcactgttcagaatgaaaatgtgagactaagtatttgttttgcaaagcgcaacagaatagagaagaaaagttgggcattctgtagggcgacccatttggaaaaataaatcctaccccttttgaaggggagaaattaatgagatgagtgtcagtccctccctccccacccactgacctctctctgggatcacacaccaacagcctatgatgaagtgttgctgcagtgcaatggagcaaggttaccttcacagtaacagcttttctctggccagattactttatagccaaagatgtggttattttcacctaaacgtttcatttaaatacattgtaaagtgtgacctaggaaaacgagacaaaatcattctaagctgtatagagttggattgtttgtagaaatgctggacattaaccaatgactctcaacttgaatgtacatcagaatccccaggagggcttgttaagaaacagattcctaaaaccttactccaaagtaggtgtcaggtggagcctgagaattttcatttctaacaaccttccaggtgttgctgatgctgctagccaaggaaccacacttagagaaacaccttcaaagtgcatattttcgtgtcttactattcaaagtatgctccctggaccacctgcattagcatcacctgagaccttgttggaaatgcaaattatcaggtcccacttcagatgtaatgaattagaattgtattttcatcaactccctgaagtgacttgtttgcatattaaagtttgaggaacactgatctagtgattatagccaaggtctttggagagttgagaatctgagacagtcagccctggattcaagtctcacctactgccattttctagccctgtgattttgggggtgttgtcatttttcttctttttaattcccaatttcatctgagaaattgggatgatcatacttgaaaagttgtgaagattaaatgtgataatgtaggtaaaatgcatacaattagtagtgttgttaaattatgtcttcatttctttttatgtgaaacctgtcctgtgaaaccattagaaacagctgtttgaagaaggtatttgaaattctctctgaagtgttttcctatgtcctgttttgagagaagctattttcacagtatggcattagattgtcctcactatattattttgtgtatgagtgacagctgtagagatatataatggtttgagtttgccaagtcacagccccctcgtttgacctctgaatttaagggtgtgtgtgtgtgtgtgtgtgtgtgtgtgtatgtgtgtgagagagagagagaaagagatacagatagacatttcgttggaggaggagtgtgagggaaaacctagggttttctttcttctctaataataaaatatgacataggctttcaaagataaaattcgatttgtaatatttgacaacactggttagtcagccctaacctcactgatatattatgaagatgaaggttatgccagttaataaagtgttttgagaacattgaaaggtgctaataaaattggatatttgactttttatttacgtatgtatgtatgtatgttttgagacagagttttcctcttattgcccaggctggagtgcaatggtgcgatatcagctcaccacaacctccaccttccaggttcaagggattctcctgcctcagcctcctgagtagctgggattacaggcatgcaccaccacgcccggctaattttgtatttttagcagagacaggtttctccatgtttgtcaggctggtctcgaattctcgacctcaggtgatccgcccacctcggcctcccaaagtgctgggattacaggcgtaagccaccgcgcctggcctgacattgtttaattttttaaagtacagcccttagtgataatttttccttttctgtagccagagaggattctagtattttggcagttggacgatatcttatctctctcaatgccctcatcagttgagaaataagcctctttcttttagtattttatattctcaaagctcagaacatttcagagtcatgttatgtaaaaatgaggtataatggctgcagagaaaataaattaaaatgagaattgcgctaatgcaaattaaaagggttaatgggagcattttcttctgggtctcaatgtaggtctctgtacagatgattgaggggtttttggatcctgagtgttattcagcttggaggggctcttttctgaaattgctggctcccatacaaataggcctcttaggaccagtcattatgatgcacaccttgcactataactacatttttaacatttacaggtagggcggtggagctcttcactgcttagttactacccagggtaatctccttcaactgtaacagcaagtcaccaagttcttaatgagtatctcctgttggtccatggtaatgagggtaggtgtgtgggagaggcaaactgtaagacctttcgctgcaaatcctataagcacttgccactcaaagtgcgatccacaaaaccagcagcagtagcagcacctaccagcttgttagaaatgcagagtctcaggccccacttcagacccactgaaagagaatcagcagtttaacaagatctccggaggctgtgggggagactcacaggcagcttaaagtttcaggagctctgctttaagaaacattcctttcagagagggaacttaaactgagccaagatctaaaaccatgtgaactccaaattcagagaatcaggtcagtggtcaccagaacagagggtataataattggttataaaccattctaatagttgtaggtttaaaggaacatgtaagtgtgaggtcagttattcactgtattatgaaagatatgctttatagtttgcctcaaaaaaaaggaagtctgattaaatgtcctcaatctatgtggcagatccaagtaagaccccaaaggttaaaaacaaaacaaagcaaaaagggcaatgccgtgatcaattgcaagtcagagttaagatcaaaattaaaatatgaggtttgtaaatacaatggtaatagaaatttgacgttagcatacgaggctccccattgtttggaaccctggtttaaaagctagaatcaaaagaattttgtctagacctaatgcatactctcacttaagctaagtggaaatctttgcctctgttccagtaaccaaatctgtggcagagctgggagtggaggtattggtgagggttgtgggtggggagcagtgtcatcccccaacacactttgtgacagtttttaaggaattagttgatgagactcttgtttattctatggtgcagagagattagaggaagcagtttgagagcaaaggtcagactgttgatgctgggttgaaatagtctctaagatgcagacaggtatagatgtcctgccaacaaccagcaacacagggttgtccccagacttgctctcctgatattagagtctggctattcttctgaaccaaatacattattttactttatgacaagtgctattacatttaaggactttagagacactgtgattctctctgacatcatagcaaaatttttatgtgtgtgcccaagtactactactttttttttttttcctttggcttcccaagaagaggacctacttattgtttgtatcagatttttcaaggcaccttgggatataaaattttaagtctgctgaattggagaatttctatttattttcccaggggaaccctttggagttctgtcctactcagctgcgttatcccctagatttctgtaactgtattagttaggatgctttggagtgctagaaacagcaaatctggctcaaattgctccaaccaataaaaccaagtcactgacatgtaactgtaaccgcccaatgggttcaccttgtctgctgcctagatagaaccgatttatcaagacaggggaattgcaatggggaaagggaaattcatgcagagccggctatgcaggagaccggagttttactattactcaaatcagtttccctgagcatttggggatcagagtttttcaagataatttggcgggtaggggcttgggaagtggggattggtcaggttggcaatggaatcatagggggtcgaggtgaggttttcttaatgtctgctgttcctgggtgtggtggcagaactggttggaccagattaccagtttgggtggtgtcagccgatccatcctgtgcaaggtctgcaaaatatctcaagtactgatcttaggagcagtttagggagcatcacagtcttgtagcctccagctgcatgactcctaaaccataattgctcatcttgtggctaatgtttgtcctacagaggcgatctagtctccaggcaagaaggaggtctgctttgggaaagggcttttatcgtctttgttttaaactgtaagctataaagtataaactaagtttctcccaaagttagttcagtctacccccaggaatgaacaaggacagcttggaggttagaagcaagatggagtcagttaagttaatctctttcactgtctcagtcataattttggaaaggcggttttataactgaaaagaacagcctggctcgctcttcatgagacttgatacagggtacaaaggtgtcacctagagcatttttttctttctctttatttcctgtgcctttcctgcatctgccagaagatgacctaccaaggctagatccttgtgtacctctcaaatgttggccaacaactctggggccaactgctttccctttcaatttgagttggagagaaataatttttgtcccatcaatctcaggaaaatactttcaatctcaggaaaatatttcaaatatttccttcaaattcactgaagttgggttgatatagtttacctgcacagtctggaggaaagaatcctttttcccttttttgaggagatgttgtcttgctctcttacccaggctgatctcgaactcctaggctcaagcaatcctcctgcctcggcctcccaaagtgctgggattacaggtgtgagccaccatgccctgcctgaaaaaatcacttttgccagagggatagctgatttagttagtgcatgtgctctatccctggagccagggcagtttctaaatggaagtcagtggaataaaattctgggaagagaggtaaaaaaatgtttaccagttttctcagaatgccagctctgtttgacacttctctctcaggactttgaagactccaagaggaatgtattattatctatattctactgaggcaagccctgaagtcaaaagttttaagtgaaataggtggggttgtgctactggtctgccaactccagatccttccagggctcatctgaccatgtaggagtctagtttatggtatccacccagctggtgctaggaggtgagtgagaggaagaagaggcagactctttctctctccaattagcctctgcctctctgtttggttaataagatccatatatttaatatgctcaatgtgctttaatgtgttaccaaaccatttgagtctgttgtcacataggaaatgtagaacttttcaaacactattaaattcccttaatcgattaaagatactgccaaaatggtttacatgaaagaactaacataatagattaaaatatctttttcttttacatttattcattacattaaattttatgccatggttatagatctgaaactaattaaaacaattatacattgacttttttattcctaaatgtatcatgtttttagatgtgtaaaaataagaaacagattcagatttaaaaaataagctatgactcaaaaaaaattaatgtgaaatgcatctggaaaatttctcttttgaaactgaaatattcctcttactaaaaagttgacaatataactctttgtaacacaaagtatatcaggagaatctttggcaaaatggtgaaagaaactcttacagaatatgtaagtcacctaagttccagaattcaatctgtgctaagatttttatggctcagagggaaatatcatggactctttatgttataaaaggagtgaactatgtgattatatcttattctgaatatcaactgtaagaagcagattctcacgggcttcatccaatatgctcttgtaattctttctaacatatgtcctctattcacgaagaacaagaaaacatctccagtttaactgcattttttgtttgttttattaaattctttttttgggtatttgcacgttccaactacccagaaaattactcaaaatatttgccttgtggtctctgtggcactgagcatttaaagcaaactagtgtagttttggcttggtagagattgaacaccctttcgtgtttcaaatatttttagagaagaaattcagatacaaaagccatataagatttatcatcactttgacattaagggagcagccatgggttaaattacttgctttaggtgggtaagggaaattgatattacaccgattctgtcctcagcaccagactgtgtaatgtggggtcaccagaaacctctgacacagctcctgtcctcggggtgtttatgatgaggttttgagaaaagccagactaataagaattagattcacaatgccatgtcttagcaggatgatatagtttgggtacttgtcctctccaaatctcatgttgaaatagaatccccagtgttggcgatgcagcctggcaggaggtgattgggtcatgggagcaagtctctcatgaatggtttagcaccctccctttggtaataagtgaattctccctctgagtccacatgagacttggttgtttaaaagtgtgtggcacctccctcctttgctttctttgttcctgctgtcaccttatgatacccccctttaccttctgccatgattgaaagttttctaaggcctcaccagaagctgagcaaatgttggcacatgcttcctgtacgtcctgcagatccatgaatcagttaaacctattttctttataaattatccaacctcaagtatttctttatggcaccacaaaaatggccgaacacacaagatatgtctgcttggcctccaaaataaatctcaggtctctgattctgcctctatcaacctacattaggccaccatcgtttctcacctaaaccacaactatattcccctaaatgatcttcttgcttcagtttttttccttgtactggtttatcctacctatggcaaccagagttattatttagaatgtaaaacacagcggctgggcacagtggctcacgcctataatcccagcactttgagaggcagaggagggtggattacctgaggtcaggagtcccaggtcagcctgaccaacatagtgaaaccccatctctgctaaaaatacaaaaaaattagctggatgtggtggtggcacctgtaatcccagctactcaggaggctgaggcaggagaatcacctgaacgcgggaggtggaggttgcagtgagcagagatcatgctgttgcactccagcctgggtaacaagagtgaaactctgtctcaaaaaataagataaggcaaggtaagataagataaggtgagataagacaagatatgagcacatcataaaatgatcttgccaaaaaaaagaccattcattgatgtcccagtgcacttaaaaatcctaactctttcttactgcctggaaatctttacatgatcactgctaaaatctcagatcttgtgtgctacccctctgcccctaaggtcactaccctctgatcacattaactttcctgttctttgaagatgtcttggaacttgccattgtttctgtgtgaaatgtgtttttcctgtatgcttaggtgtatcactcctcgttatccagggttcacttacatctcgcctcagtgaagagatttagcttgattgccccatccaaaaagatcttatttgttaacttatttacatggatactatgtcttccccaacttcaagttcatgaggtctgtgtttctgtcttgtttatcaccccaggctcaatgtcttaaaatagcacctcgtaggctctcaataacagaagatggcaccaaattaatacactgaaaatgccacaagattttagataaatgtaaaaacattcaggctttgattatttggtgaacattttgaggcattacgtgagttggagcaaaactcttgaggttaaataatatttgaatgggctctgagaggcaaggggagcgtggccatgcttgtccccccacccttatctgtattctgataagaaaatacagaataaatttctttgaaattaaaaaataactcaaactctctgtaattatttttctttaattttctgagagaaggtttttttttaatttggagaaatttttaaaaattaaataaaaactagaaataatacttaatgtcttgacaaagtattaacttgatctagtttcagaaagatctcattaaactgcctgataaagtgattattcagtgccactttcatagagttttcagtaattatctgaaatgatttttagaatgaggcaacgttttcctttttttttttttgaaacagagtctcgctctgtcacccaggctggagtgcagtggcgtgatctcggctcactactacctccgcctcctgggttcaagcgattctcctgcttcagcctcctgagtagctgggactataggcacgtgccaccacccctggctaattttttgtatttttagtagagatggggtttcatcatgttatccaggatggtctggatctcctgaccttgtgatccacatgccttggcctcccaaagtgctgggattacaggcgtgagccaccgcacctggccaacatttcccttttcagtagcaggtgaaaccgtcttggtattgacacagaaatgctgataggaaaaggtgatgaactcatacacactaaaaatatgacatctacctctaaaagttttagaaatatgtggaaagcattcttggcccttttctcctaagttaagactgttcgcaaatcacttttgagagcgaagtgacgatgacatttttctcactcaagtcctaactcatttctaggcatataatttgaattaaacccttatatataattttctaattagatttttcttctttcatggctttttaagctttacataacctttgtgcttcctttttccattaatccttcaaatgccagcatcctgccaagagggtatttaccgcagtatttccatcattgttaacagagccacaagtttttttccagtatattgaaattacccatccatgagaaaatgcagtcttggatttttaattatttagttgacgcttattcaactatatgatgtaagtaggccttttctccctaatgttttattaccagttaaagcacagacaggtattttactttaatttagatatagagtaggtaacagagagctgaaattttaaaaattagataaattttttggtagttagttttatagttaatcttctctctttttttttttttttgagacagagtctcgctctgtcgcccaggctggagtgcagtggcgcgatctctgcccactgcaagctccgcctcccgggttcacgccattttcctgcctcagcctcctgagtagctgggactacaggcgcccgccaccactcctggctaatttttttgtattttttagtagagacagggtttcactgtgttagccaggatggtctggatctcctgacctcgtgatccgcccacctcggcctcccaaagtgctgggattacaggcgtaagccaccgcgcccggcctaatcttcttaatttgtcacttagagtagggcagtcgccacaatatggaaatgagctgggattagtgttatcactgggaagtgattgtaacttttgggtttgtaccaagaagtatatagaattgcttaaacttctgcatgatcaattactgcagatttttgcacctagctccactacgtagtccatcacatttcatagggcgatttctccactcctttatcatagaaccttaggagagaatgttcttttataactcccttgatggagttgcttaatgctgcctttaatttaattgaaaatggttgatcaataaagtcactttttatggatttatttctactgtttgatgtggcaaatcattaattatcattacctaaattagcatggattgccatgaaagtgaaaggagtaaattgctttatggatttcctagtgcatagtacacatagaacttttctaaatatacatcctcttcagcagttagtttgtgccagatttcaattcctacgctacaagttctccagcaaactagaggtgtccatgtccaagtggacatgctaaaaaattcaaattttacagaaattttacagagaccttacttttgtaaggtctccggaatctttaaaaaaaatctatttaattattgatagaattttagtgaccaccatagaggggagtacctgtgtaagcagaaagcaggaggaaatgaacccatttccagaaaacgaactagacattaaggagaaaaaaagaagagaaagaaaagtaaaaagaaaggagagcaaatacctctaggttttttattctgaaagcccatgttatgggttgaattgtgtatctcacctccgtcctccccgggaaaaaaaaatacacacacacacacacacacacacacacacacacacacacacagacaatattatacataatatgttgatgtcctaacctctagtacctaaaaaccttaaaacctctagtacctcaaaaattgtatatagtatgttgaagtcctaacctctgttacctgtttggaaacagtcttaacagaggtaatcaagttaacatcaagtcatcagtgtgggccctaatctgataggactagtgtccttataagaggaaattttgatacagacatacatagaaagaagattatgcaaagagacacagggagaagatgccataggcaaaccaaggagagaggcctagagcagctcttagaaggaaccaattttgccaacaccttgattttggacttctggcctctagaactgggtggcaataagtttctgttgtttaaaccatagcatttgtggtagtttgttacagcatcactagcaaactaatacagcccataatttatgactagcatttcatattaaaattaaacatattatatgaaagcttccccaaacactggaatactataatctataagagttgcattaactattttcatggaacgtcagaatgtggaatccaaagaaattcagagcctaagctgggtactatcaaagcattttataatcaaacattcaagtatgctctgattgagagaattgatttccatatgtatctttaataaaggaacccaactttcatactttcattgtattaacaagaacaaggcacagactttgttaagcctgattctgaatgttaagtaagccaagggtgaggaactaaaatttgtagagaattgagtcatgtagtgtctactctactgtgggactctggtgttggaattatcaaatgacaatgtgaatgcatcatagagatttatcctggactagcttacacttggaccaaaggtgatttatcaggcttatcattttatattgaagtccataaactctctcttctgcatccctctgttcgggagtgtgtgtggcatagaacaaatcagcctttggcacacattggaggaaagggtgtgtgttttgttttcataggttttttttagtgatgacaatcaaaagcccattttcttgattcctatggatatgaagccgattaagtattgataaggagtaaggtattagagtttaaaatcggggccatctctgagctacatggttaggtcagtggcacctttctctgaatccataatcctccaagccatttcaggccttttatgcagtcctactgcaacccagaactccttctaggccttcctctccaggagcagttatgagattgagtgttaactgcttataagacaccatatgctacacaaaactttttataaatgttgtgcttatatcaactttgacattaatgctattataatcctcaatttacagaagaagaaactgaggcttgaagcggttaaatgacttccccagagacacatagcagtatatgctagaggcaggactccaacccagaactggcagaaaagctgatactttcaaactttcaactaatggtctctgcagcctccaaagtatcagatttctccgtcaaatccttcttgcctggtctgtctgaccaactaatctctgataatgtaacgaaggttataataaatcccttccagagaggatatttgcatttaactggatgtttatgaaataatgtgctggcagaaagaaatgatactcatggtgggaatttctcattctttttctggtggaatgtataatcttggacaaatcatgaccgcaggagtcttcattttatcatctataaatgccaggattgggttaactactgtctaaagatctcttccagattcaaaattctatgattctttcacattaaatgcaactccttttcaacatatgtgtatacttggccctttattgaacctttttataagctgccaattggaaatacacagtcacggtagatatgacaatgagcaagtcacttaataactatcagcctcagtttcctaatctacaaaaggaggctattaagagcacctacctcacagtgttaatattatatacacaagtagcaaaatgtctggaacagagcaagggctcactagctatagctttaataacgtgataactgatggtgtgatcagttctattatcatctccctgcagaaatcacagtttatctaaggttatagtaaaagcacccatcatgacttcttttaatcataaagcatttcatgcagagtgcatattttaactttgtattctaaaggcattggtgtctcactaaaagctgggcagtatttatatcaaacagtatatcatctatgtgttcatttatgcatgcagactttcacccccctccaagctatgagaacaataggcgctttaaaagtctgaagcaagaaggatattagctccatgaatctttattttaaattacatttctgagttagaagtgtcaaaatggtagaacaagttaagcaagattgcattccccagtagggctattgatgttggttgcaaataaattgctggagcaggtgatgatagcaaagtccatgccatcttttatttagcaaagtatttctcttgttaacagctccttctgcatgctttcctttcttctgtttcacatcaatcatatttgacacattgcccaatgtcagggtaaaaaaaaaatgcagcgtctggctaatcatccagatgtttggcctcacactgactgaaacatctggttgtgtagctaaatgttatgttctttcatccagttattttgtgttctgttagacagaactgaagaataaaccctaggatcttcttctattaggataaagcttatagaatctcgaacttgagattccagaaccaaggccttactggttctcatagttgcacagctgtcagcagaatccggatcaattgagataatgtgtgtggaagcattatatagtatgtggaggcattatatggatttgagaagctcatgttaaaagaattctactccctttacttggttatacaatggccaaagaatgtttgtcttctggaaagaagttttaaaacagaataaaaattaattggtgttagaagccaagatttcagagctagaccaataataataacagctaagatatgtctgatgctaactctgatccatgaactcttctaagtgctctgcatagatgtaaaaacaatcctttgaagtggaccctactctttttttccattttacaaatgaagtaactaaggatgagagtgcagttaacaatttaccccagttcagaagctcaaaatttggattcagacaatttgatttcagagtctacgtatttaacttgtaaacttcctctgaaatcaaaatgtttattcagcttccaacaccatcacttattaaacttggttttgtcaccttaaagtggggatagcatgacataccttaaaaggattgttgtaaaggttaattgaaaggatgcatgtaaaacatttaacaatgttgttttttggtaagtagtaagtaaaagtagctattttttctctatgttatgcaatatttggaatcaaatatttcaatactaatttaaataatatattctaataatctcactttctgaaaattcattcaatataatttttttttcttggaagaacattcctagcaggttaagcacttttgatcaactcttgatataggctgttcttaaaataattggaagtccacaaattatatgtttctggaaactattctgaatatggaaaattatattcctttttctttttaatgaacatataatgagtatgtattaaggggaagatatatgctgagcttcctcttgccttccttttctcccccttcatttctgtcaccctgcctttcctatcttcacaatggtcctgtacagtaaactttgtttgcttttgcatttgaactttaggaatcaaggtttttaaagaagctgcatcatgtatcataaataaaaacgaaaaaaatgaagtgtaatattttaaactgttttagaacatgaggctcagtgttctatccaacaggctatgaaatattgctgttactaataagtatgatgatgaaagccactgattcttggacaactactatatgcctgacatattgctgggtgctttgcatacattttctcatttaacgcttagaagttcttgtgattgacacttgggtatcatgagcaactttgctcaccattttttcctatggtccggcgtctttagtcacttgtattactgttgttcagagtgacctttatttgattcatttacctttcagaatcttctattactcatgtatgaggaccacacatttataattagggagtaaatttggtcatcaactcggataaggcaatgggcaaatctgacatgttttcaaagacttttcagtatgctaactttcagtagggctggtttctataacagctacgacatcttttgtcaacactcaggctgattaaattgcaagattataatgttttccgaccctaagtgaaagtgacacattcttgttcttttagtggcttcataaaagtcaaatgtttaatctcaggaggaaatttaaaagatggaagtaaaaccttaatgagatgcaacataaataatagaagtccctttgcgtgaaatgacttgtgatgaggtttcttcaaaggaacaaactataaaatggagtgtttcagaaacctaaaatacactagtaaacactgcgttttaaaaatatggtatcaatgatactcagcattcagtaaataaaaagagttagacaactggtgtctgtaaaaatgttaattttccaaaacactataaatgtatcaccaaaaaataaacattttttaaaaaaattaggtgactattttcatgaatttttagtccatgaaacctgaggagttacttgaccacagcaaagattctttctaatcctttatccagccttttgtgcaatagtacctcctgttccactcacatttcacatgcctgtatgcatgtacattcagatgtgcctgtctttgtctcccagtgcttgttacacagaaggtattcaagaaatggtagccattctcacaatatcattcctattaccatttaaaaatgtatgtggaaaagggtaaagtgcaaacctgggttgttaaaataccggaaggatatctataatttaacaccagttcatttttgttttcaaatcactccaaaatgccctcacttattggtttagaaataatgtaacaaaacaaattgtgttgtgtctccaaagaacattttgctaagtgccagagctgtatataacactaaagtagatgctgacatatgaggattgtgagagatgaatggtgatatttggcttttgcttcccaagtataggtcgtgtccgaggtatagataattgttgttggtttatgataattcgacttgcggagttaggtcagtcagcatagatgcatattttttggatggttttttaacaatgttgcttaaaattttaaatcagattatttgccaaaggggggtgacaagatttggttattagcaaaaaggaaaatattaatctagatttgtttggtcttagtactgattatgaataagtcatcaatagttaatgataaggaatcagtctgctgtgccatattggtagatgaaatgctgctactcctcctattcctgggcttttctgtcccccacccccttccttccctccttcctctgtccctccaactcttcttcacatctcccaactcccccaattcacttcttttccactgcatgccatgttaccctatgcctagttatgatcctaattgtaaccctagttagagtagacacaaagtaaactcaggagcagggattataaagctcaaaattgttcctcggctccgcattttgtgtttattaacctattttacccttgcagcaactccaagcaagtctgtaaattttagcattgagagttctccattttgtgagacccctctgtctggtcaaagtgggatgacagttggtcactatagcattcaataattatccactatggttatttttattcttacagcttttattgaaagtttctttttaaccatagtgccaaagacaaaataaacaataaatattaatgattttcttggcttctatttatgatattgttattttacttttaaattctttggtatcttctgccctttcatcttttctgttctgttcagtcaagacttagctgatcctatctcaacctcaaacatatcttttctatttcatctcttgactagttagaaactttcacggcagctaaaatctcccacacaaatctgagtaaagaaaccctagaggtcaaagattgtagtgtaaataaaagtattttcctttatatatgatataatttatatgtgttatataatatgaagtctcaattagaatagggaaaatgaaattcaataattattagagtattatttgcgaagtgttctgctaatatttttcctcctattaatcaaaattagttttgtattttttttccatagcaaagtagtctaacaatagagaagaatgtcttttaaaagactaaattaggtgaaatctattctttttgttaaattatcctaatgtaaaaccaggtggcctgattaaaactagccttctttgctgcctcctactgtttcaagaaaaaggtcgccttaacacttagtttctcttgctgtcttttgtttggagtatgtgtgggggtgtgttatttatgcaggcatagctcctcattatgggaactccaagagcctgattgtgactgttttttaatgccgcctgctgtgttgtccttaaactcttgcttttcctggaatgcacaactttctcccagctcctggtttagccattggtgtcatgtcttcatgctgcatccttgtgcctctgaaatcgtgttcaaaagagtgtttatgtttcaaattcatccacagtctcaccacatttaaagataattgcagaaggtaaaacactattaataggaacaaatttactagcatctcttttactatgtgtcttatgcataaagcagtttctggttgttgggttatacagtgcctattgtgatagtctattctaccttcacctcccgccccactgcctccccatttaactaaagctcctgctgatatgttcaatttacttttttttcttttttttgaaatggagtctggctctgttgcccaggctgaagtgcagtgatgcgatcttggatcactgcaacctaagcctcctggggttcaagtgattctgctgcctcagcttctggagtagctgagactacaggtgggtgccaccaggcctagctaatttttgtatttttagtagaggcagagtttcactttgtggcgaggctggtctcgaactcctcacctcaagtgatctgcccacctcgtcctcccaaagtgctgggattagagacgtgagccactgagcccagcctgatatgttcaatttgataaatgaatgtgttgaaagatataaaatgtgttaatccctaattgcatgtggctgtgatatttaatatggctgattctaatggagtttgtaacttatggggaacactatgaatgggatattataaatatttgtatgaagtaatacaagagacatttcaacagaaaaccatgtgatctatgccctccatcattattttctttctgtgtaacaaatgaccaagtaaaagtagtgaattaaaatatgagtaagtctattttcacagtattcataatttattataaacttcttttttaaaaaaataaaaaaaattaacttctattcctttaacaaagcaaagcaaaccaacattattatcagctaatgccatttgatttcggtttggtttggtcagtctcagggtggccaatcatttaagttttctgggactgttccaatttaagcactgaaagtttcacttcctgggaaaacacacactcctttgagtatttaccgttgacttccaggtgacccacttaagggcttcttccagaagggcaggcaataagactatcaagactcttcaaagcactcttccccaaagccattagatgaggtccaattttctcagcttgatatttctgagaactgctcttcctttatttccaggatttaagaaaaataaaataaactgatatatatatacatacctttagaaggattcagaaaagaagaaatggccgtttcaccccaatatgtcactatagatatgaatgccactcatagaattgacacgtcatgtttttaacttctgtgctttaggattttcctgtttgaattgtttatgtgcatgtgattttggtggaatttcttcccctttcctctgttccttgctccttcttttgctcagtcagcataggaacatagctcccacactaggaagggctggaggttagtaacatcaagcagtgggctttcaagttagtttgcaccttggtttggaagtgtttgctcaggtctcagatacacaggagactgtgtaatcactcttgtggcatctactacacacagcacgtgagttattcctaaactgagcacaggctcctgggtggtgaatcctagtctttttatctcctgcaggctaagccttggtatttccttcagattacaccaaaaccaaaataatgggcaatgttgtccctgaatgttcaaattaggttgagtacacagagccaaagactatcaaaagaaagtgtcctggccgggcatggtggctcacgcctgtaatcccagcacttcgggactttgggaggcagaggcgagccgatcacgcggtcaggagatcaagactatcctggctaacatggtgaaaccccgtctctactaaaaatacagaaacaaaatcagccaggcatggtggcgggcgcctgtagtcccagctgctccggaggctgaggcgggagaatggtgtgaacctgggaggcggagcttacagtgagcagagatcgcactactgcactccagcctgactctgtctcaaaaaaaaaaaaaaagaaagaaagagagaaagaaagaaagaaagaaagagaaagaaagaaagaaagaaagaaagaaagaaagaaagaaagaaagaaagaaagaaagaaagtgtcctaaaagaagtggtggtacctgtggggcgtgtttggtgtcagagtgtttctgctaaggttattttaattagcctcctcccaaagccctccccctattctccttgaggaactgtttgaccgtcacatccttagaaaggccaaaccactactaactctcctgaccctctgccttatcctcatacccttaaagatgtgacttaaaagagaaaaaattatgttgttaatttcatcaactagggcaaaggggaaaaatgttcatttcgatgcaggaagttaatgggagatgggaggaagctacggttacaattcccataatacattaatgtatatttaatataccaccttgatttgtggcctcaagttaaataactacatatgtttgcagcataattcttttcataattgtgtagcctcaatgggataacatttgtattagtttccataatcgaaaatgtcaaatgcctgtttccaccttccaagtattttggttttaggtagcaaagacaattctttcaatgcgtatctgttctcattaagttctgattgctttataaagaaataaagtcttttcccattgttctgctctgtggaagtcaccttcagagtaagggtgggggtgactgtccttgccaatttttaagtaactgccttgcaagggtgattccctacagagttattttctgcatagtttccctctgggtacagaatgtgggaaagtagatgcaacgcattttagagtagtcatttgctctaataattagcattatagtacagtgtatgggctggcttcctgttgaggtctagatttctacatataatgtaggtttttctattctgtcctatattaatttcattggagttactctttatcagagcaaacatccgtaacatttagtctttttttttttttttttggagacagagtcttgctctgtcgcccaggctggagtacagtggcgtgatcttggctcactgcaacctcttcctccaaggttcaagtgattctcctgcctcagcctcccaagtagctgggattaccggtgtgtgccaccacacctggctaatttttgtatttttagtagacatggggtttcaccatgttgagcagagcaataactctgtagggaatcacccttgcaagccagttacttaaaaattggcaaggacagtcacccccactattactctgaaggtgacttccacagagcagaacaatgggaaaagactttatttctttataaagcaatcagaacttaatgagaacagatacgcattgaaagaattgtctttgctacctaaaacgaaaatacttggaaggtggaaacaggcatttgacattttcgattatggaaactaatacaaatgttatcccattgaggctacacaattatgaaaagaattatgctgcaaacatatgtagttatttaacttgaggccacaaatcaaggtggtatattaaatatacattaatgtattacgggaattgtaaccgtagcttcctcccaactcccattaacttcctgcatcaaaatgaacatttttcccctttgccctagttgatgaaattaacaacataattttttctcttttaagtcacatctttaaggatatgaggataaggcagagggtcaggagagttagtagtggtcttgaactcctgacctcaggtggtccgcctaccttggcctcccaaagtgctaggattacaggcgtgagccactgtgcccagccatttgtaatatttacagagcattgctctttttcttatcatggaaagttattccaatatctattcattctatacacatttattaagcatctactatgtgccaatgttaaagaggtgaaagtgtaaccttggccctcagactgactttttgcaggttatgctgaaagatgaatgctcagtaatagctcgtgccttaagacgtggccgagcaagctttggaggtaaaatagctcatggagtttttatttatttatttattctttaaaaatggtcacaaagatttcagataaacaatctgagtatggctaaattatttttcttaggtaaacataggaggcaagaaattaaaagggtgggagaaacattaattaggctatgctcttatcaagtagtgtgaccttagcgaatttacctaatctttttgaacctcagtgtcctcatttataaaatggaggcataactttttatgaagattaagataatgtgtgaacaatctgtgcagtagtagttgctcaataaatggtagtgattttcacatgtatttggactattgtagaatatagaaaagaatatcatgcaaactctagtcctttaaatatgagtgaggaagaggaatcacctgtgtgtatgtgattaaagctgttagctatgatgaaggcagggtgatttttctctgaagggtaattcgagtacagagatattactttgaagaagtaatatgttaaatgaaatcattggggctgaaagtggtaacaacattctgggaaaggagccgtttactctcttcacctctaagataaaccataatgcatgcatgtatttaataaactgtgatagctagagctgtttcactggggcatcagtaagctatcctcaacccccttttcttttcttccagcttttcacttccaaccccctaagttttatcagaattagttaatactgagtccagctgaatacattgcttgttataaatagaatgctttctcccttcctctgcccctgaccaaacaattgattacaaagtttatctgctgagtgcggtggctcatgcctgtaattccagcactttgggaggccgaggtgggtggatcacttgaggtcaggagtttgagactagcctggccaacatggtgacaccccgtctctataaaaaatataaaaattagcccagtgtgttggtgcatgcctgtaatcacagctacttgagaggttgaggcaggagaatcacttgaacccaggaggcagaggttgcagtgagctgaaatcacgccacggcactccagtctgggtgacgggctaaatagaatgaaaaaggaatgacccatacctgaaatgtttaacataataaaatgactgatatcgattgatgacgttgagagcaatgaccagatataagggaacaatgtgtttttacttggattgtagatatcaagaatacaggagaatggaatgggagggctaacaactctagacaacatggctgcaatctatgactttgcattcttgctataatttactttcagtgcttttacaaatgtaagactctcgaggccagcagtgtatcttttacgctattcattctacttttataattattattattattattattattattattattattatttgcaacctctgcctccaggtttccaacaattcttctgcctcagcctcccgagtagctgggattacaggcgcgggccaccatgcccagctaattttttattttattttattttatttatttattttttattatactttaagttctagggtacatgtgcacaacgtgcaggattgttacatatgtatacctgtgccatgttggtgtgctgcacccattaactcgtcatttacattaggtatatctcctaatgctatccctcccctctccccccaccccaccacaggccccagtgtaagaaatacaataaacaaagtatcttttattttggctacgtagttatgttgagggtcattcatcgtcctccagtttagcctatttggaacggtactggttaatctcaataaacaaataacattgtcagtttaattgttcaattattggagggaaataaatatatattaacctaaatgttaaattctgcaggaaaaaaactgattagacatagacaatatcaacatgggtttgttaaataacttgccttccaacaggacccaaccagaaattggaacctatgtttcatagaaacatgattcttagaaatgatctttacacaattgtaaaacaaagggaagattatgtgacgcagatgccaagaaatcagacctaggcaccatgtacaagtatacaagcaatgccgagttcatcagtcccatggctgctgctaaattgggctttatccccagcaaattaacacagttccagcaggcacgataagtttactctgaccagattactgggttgaatggcatatgccgttattttagaaagatgcagaataacatttccatttagagtcctggcagaacaaagcttggatttgggcaatagataaaaacacatagagagtatttgcagatgcatgtgatagatagaaatggtgagtgaccatttagaaatttagaattggaatttttttttttttttttgagtctcgttctgtcacccaggctggagtagtgcaatggtgtgatcttggctcactgcaacctccacctcctgggttcaagcaattctcctcccccagcctcctgagtagctggaattataggcgcccacaaccgcacctggctaattttgtatttttagtagagacagggtttcgccatgttggccaggctggtctcaaactcctgacctcaggtgatccacctgcctcggcctcccaaagtgctgggattataggcgtgagccactgcacccgacaaaaattgtctcttttttgatatttcctagagcagtgtggctcatttagattgaaatatctgtcagaagctatataccagttccattgatttcaacattaaaatgtctccacatattcttccgcatccttcttccagctcatagctgtaattagtgttatgctccatggagtggcagaagaccagctgaacaaacagccatgtacgtaggaacagttccaggcagctaaaagagcttcttcctcacttgccactatcttaaatggtatctggtgtctacagttgctccttctactttcttaagaaaaaaaaaaaaaaaatccaaatggaaaagaggactctgaagacaaattagtcctttacaattataattttatttgatttcaaagcagtacttggtatagcaccagtccaaacagattggaagaatgatattttcattccagctcctgcatagaatatctttgtgcttttcaattgctttagggagcttgcaacaatagaatcctgttaaatctaacaccattttgaactcttccttgccgatattgtgataagaaatttatacctggcccaggtttatctctgttgataatgggcttcatggctatagggacatgttgatatggtgagctagcacctatcattttgacacctactctttagtagacatagagaataatgggtgcttggggtaaagtgctggagaagagtgtcagcagtcagtgtgtatgaacctagtgatggatgtctctgtgtttgtgctgtggccatatctgtatggctatcattctttcttcctcttctcatttcttttaattttccttcaacagtctttcatttgttgcttcaattcactccatttctccccagttcttcttttttctgtcttctataattctagataaaattatgacatgacttaaaatatcctccttttttgtccgtgattgctttcaatggttctaatgaccccattggaagtctggtgattaggccctgaggggccacagtaatggaaaccttgtgttcagccttcataagggtgatccaaaaatgttattacattacttacacctctttctgtaagtattttttcttcattcacttcgaagtatgggatgcttcccatgtgcaggagaattagctcattcataactcaaaggcaagtaatttcatgttttgctatttataagagaggagtctatcatgcaaggatgcaaaggagtatgaaatcagtcacaaatgtaggaaataaaaggcaataagcttccattaaaccaaacaaaagaaaaattaataattaggcagtctctttgcaagtacataataataatactctatttttcaatgaatcaattaggtaaaaatgaaacaaaataaatgcaaagagagccctcaaaaatatatcacttttacatatgtaatataagttgaacatctcattagaataatgtgacttttttaaaatttatttttgcttcctagagttcataaatcttcaggtggtaagtaggggttctttagctattcataatgcaacttgcttaggttaattagtagagaccctttcccttcacagctgaatatgagtgcccctacttactattcaaaaatccccaaaaccagcactcttctatatattggtgcttggaagagattgtatttttcattgacctgcaatattaggtattttattataaataaagtctcaaacaggctttattttatttgtcagattctcttttggtttcgtctcataaaatattagctgaatagttattatataaaaaggaaatgatcagaatatcacatttcgggtggtggtgtttagtttgtgggttccttcatgtgacaggttgaactgggtggtagagaattctgagttctgtacaacagagtgattgatttctcggtttgcatttcttggcatctggcagtgacaccactgcagaccgagagcagaaaatggacagtagggaaaaatgcaacatttctacttggtccagctgcctttgaaggatgctgatgtttcattttttatttcttaccccaaacatatttatttgctgagtcattaaatagggcaagtgttatttctttctttgtatttgccatctcaccacagaagagttttattggccgggcgcggtggctcacgcctgtaatcccagcactttgggaggccgaggcgggtggatcatgaggtcaggagatcgagaccatcctggctaacaaggtgaaaccccgtctctactaaaaatataaaaaattagccgggcgcggtggcgggcgcctgtagtcccagctactcgggaggctgaggcaggagaatggcatgaacccgggaagcggagcttgcagtgagccgagattgcgccactgcagtccgcagtccggcctgggcgacagagcgagactctgtctcaaaaaaaaaaaaaaaaaaagaaaaaaaagaagagttttattaaaccatctcgaatcgatattgttttggcacaaattgcactaataacttgaatatatagttttgtttttttaaaggtgccttcaaaatctgatacgtataatgtatgttaaaattgatatttctgtgaaagaggttaagatcagaccgctttctgattgcagagataaaattgatagttaacaagtatttattaaacatctattatgtgactagtactatgctagggcatgatgaaaatgattcaagatgaaccatgcaagcacccctctcttcagcacctctgtgtgtaaaacataaacagaatgctatgattaacactgaaagggttcagtccgggatacttgggataaaaatcggagcactgataagttacttgtcatgtacttacttttttaaaaatttaaaattttttaattatgggtacataataagtatatatgtatggtatacatgtgatattgtgatacaggcatataatgtgaaatatcacatcaagataattggagtattcattacctcaagcatttactgtttctttgtgttaggaacattccaattccacttttttaatttttaaaaatatgcaatacataattgttgactatagtcaccctgttgtgctatcaaatgctagattttattcattctatcaatgtttttgcacccgctaactgtctctacctttcccttctctccccaatacccttcccagcttctggtaactgtcattctactctctatcttcatgagttcaattgttttaattcttagctcccatataaaagtgagaacattccatgcacttctaatttagactcttctcctctttctctgtcttctttttttccatagctcactaattttgggcatctcttctcatttacagtagcttgctgctcttcattcattaattattacaatatataattctaccaagaagcccaaagaactatagtgtttttatgtcattattctcagttcagaaagaaagcatgtgtgtggcacagggaaggcatttgaatgaatgtatgcattttctggatagcattctcgaacagagatttgatgagagtcacatggataattttaacttttctagtagcaatattaaaaacacagaaatagcttctcaataactgaatcagtaatccatttttaaaatctttttcaattcattaaaattaaatagaattaaaaactcagtcccttagtcttttttttttttttttttttggagatggagtcttgctctgtcacccaggctggagtgcagtggcgcattcttggctcactgcaagctctgcctcctgggttcatgcctttctcctgcctcagcctcccaagtagctgggactacaggcgtccaccaccacgcctagcttattttttgtatttttagtagagacagggttttactgtgttagccaggatggtctcgatctcctgacctcgtgatccaccagcctcagcctccaaaagtgctgggattacaggcgtgagccaccacgccctgcccccttagtctgactgaccaaatttcatgtgtttacggattgacaaccatgtgggtagtgcaggttttggatgcatggcaggctgaagcttatgtagcacatatttgaccttcacattttattaagtctaattttttaaagttttgtctgttcatttacatgtggaaggatgatagaaatataggaagagacatgacagaaagcttgcctaggactcagatcaaggattcagatttcccaattccggcttcagggccctgttctgtaacatcacatcagggaaaggaaaatgagagaaaagaagaaagaataagaactaatgttaattcatgtcagacacagtgccaaagatctttatttgcattattgttattattttttaaaaaataaatagactagcacgtagcctagcttacacacttctcattgtatagatgaggaaactgggaatcagttaaactttataaccacaccaagatcattgagctagtaagtggcaggcttgggatttaagaaagcttgtaatgatgttacatttgatggtttaaactgtgctgtgggaagggaatccaagaagataatcccatgtttctgcttcttgtgatgtttgcaaatctgtgttctggagtaagtctttgagttgactcttggagcttctgaaacgtctattggatatactataaccaaagataaataaataaataaaaagatcagggttcctgaacgttttcatctttacattgattgcaatgattacaagtgatcatttcatcacttggagcattattacctctatggggctttacatgatactgactttgtcaataaaaggacatattaggagcaggatttctgtttgggccagaacaaggggacataccctatttttaaaattccccagtttaggaattgaagtgactgcatactaaagttggccaaatttcatgtggctatggaatgagaatatatgaaaagttggttgtaaaaacaattaagaggattggggcagactattttatggatcccttcctccttagcttctgaaatgaactaacattgattctacaaccacttattaaatacctactttttgccatggctgatgctaagtgttgaggctagaaatgcatatgaattatattttaataagcacagaataaagaaaacttgtcttcctaatttttactttaaaagacttttatctcattgtttaagtgccataattgtacaaagcatgctgttctgagttcagtgtttcttggctcattctcagtcaatactctgcatagcatctttgaattccttactcatcaaagggtaatgagttaatttgtgtactctacctctgccaccttttgagctgtgttgttgaccattccctatacatttgcatctctgtctgccagaagatgtaccaggaaaataaaagcagcagaaaatcttataacttcccacctagacatcagtcaccatcagagtttggtctggaaacagaaaagtttatttaaaacaaaattggtactctgtgaatatttcaaccatttgttccatttaatccccattagtgaatttgcttagattaatttttttgtggattccatttccaagaatgaaagcaaaataattacatcaaaaggccactgaaatcagccaaattctctggcaggaaacttattctattcagtcacattcaaactatcaggtatgaaaaatacctttcaccactggataatacaacaatggagttggaaaatcaatcgtgtggtaaataagcaaaaactacgtgcaaacagaggaaagaagagttgttctgaaaatggtatttcaataaaagttatagtgatgacgagcagtgtgatgatgtaggaagttccaaaactaggtagagggtataatcaaaggtgggtacaatggaacaagcctggaggcaaggacgggccagtcaggaacaggtgggcttatagtgaaagaaagtggaggctttagaagtagagtatttgatgaattcttccgtccattctattttggcttctatgtcaaggaggatgacagatattcattgtgtagttttataggaaaggcgattggtagtgacttcaatgttataaagaacttggccaagtccataaaatgtccatggtgtataacaaatcttttatggtgagtgatccatggaattaggtacttagaaaagtcgattgaaacatattcacagaaaggcaaaggtttgatgacctggtgcatggaatgagacagagacactgagaaattttgattgtacaagtttttcctaatatcccacttacatcctgtagcggtgtgggcccatttattcttttttatgtttggtttccctgtctcatggtaaaatcatggacagatgttacccctcaattttctctttttcaattatttctgatccttctcactttaatcagtttacttgatagtctctgcgctagtgtaatttctccagccttttgaaaaatgtagacgcttgagccagacaaaagcacttcagcaggaacatgactaatcttgaagacatagagcagggctgataatgtacgccaggaactgtcagttaagaaatagtgatactgcattgctgactcacagtcagctcatgggtcactatgctgcccccattctgttgagatttcagtacactttccgtatatggagtttctgtgttggtacacatccagaaggtttcttgggcgcattgaccttcacatattgtttggttaatttacctaacttggtattaatcagacagaaaagacaaacatgaagtaaggaaagtcggcctttgctgttctcccttgaacttggcttcacttctatccccaccatttagtaaggaagaacagccccaatttattgagttgctatgagccagacactgtgtaagcactttctacacattattgcatttaattctccaaagaatgagataactattataatctctgttttatagaacaaccagctaaagtttatcgggttttttttgtttctgtttttttgggtttttttttgttttttttttttgagatggagttttgctcttattgcccaggctggagtgaaatggcgccatcttggctcactgcaacctctgcctccggggttcaaacgattctcctgcctcagcctcccgagtagctgggattacaggcatgcgctaccatgcctggctaattttgtttttttagtagagacagggtttctccatgtcggtcaggctggtctcgaactcctgacctcaggtgatctgcctgcctcagcctcccaaagtgctgggattacaggcatgagccaccgtgcctggccaagtttatgttaaataactcgtccagaaggtgtagtgggatgtttgactccaaaatacatgcttttaccgcctcaactgactgagcttgggactacctctaactttcattagaaacacaaatctttttctaataaactttcttcttcttttcaataaaaacatttcccacaaggtgacttaaattcattcacaattaggtataaatactgataagagcagttaacttgttttaagagtctaatatgtgctaagccttatgccagatgctttacaagcattatcttaaaccttgtaacaattttgcaaaaatgttactctattttatagaaccaaaacccaagactatgaaaacctaaatatcatcctcagagtcatacagcgaagcagaaattgtatcagctaatgagacttagtgccatttctctcatattgtgtgagaaaaatggcaatgctcaataaatgttgttctaactgttccaggtatcaagcagtagaaaaagaatatggcagatcaggtggattttgctgtcagccctggaaacactcagctggtggctacataatccatcatctcctgaagctttcattgtccacattttttttctaccctttagtcatgtgtttgtaaggaataaattactaaaatacaccataccttttaaaatatagaataaaagctcacagagagttagggtgacagaacatatgattcaaccttctgccttctggcagacagtaggctatttcttttaggtgggtatctaggaatagatacttgcatataatattttttttttgaatcccagactggtcctactaacattcttgattaccacttatttaagtgaccatcaaaccagttttatatctgatatgtttaatccaaataaatgtctttttttaaaaaactgtttaaaaaatggtatttaaatccttcccagattttagctgtgtatagtctggaaggaaacccattcacatggttttatcaggtttgatatttaatagatcaaattagtaaaacagggccctcacttcacaggcacggtgaattctttgttgataagatctatcaatgatcagtatggatcattggatggcagtgaacgtatacgtttgtggggaaaattcttatgcaccttcatagtaatggtactgcccattttatttgaggataattaaaacacaaaatacccaacgatgctgtttttattgtaggtatatgttaattcctctagagatagacaagactctaaattcatggaactttaagtgggatgttccacaaaggaaactctttaaaataatatagaaaaataaataagtaaatgtcaaccaaaatggcagaacatttaaaatcagtctgccaaatatcttttctcactttacttcatttgttgaacaatttatatgctgatatagatggccattttaacagtgtatacaaagcatttatatccacacatgtacatttaatcaaacctacatgtctacatacacatacttaagacacacatagagagtgtgtgagagagaatcaactcatcataattgtaaaggtgaagaaaattgattccttaagactaaaacacaccatattaaacttggagtttatattttgaaaataagattcaggaagtcttctaaagcattcgaagattgattagaaagataaatttcggcacacagggtctctgttcttgtaactttccctgtggtagcttatccctctgtataatacattttgtcatcattctttctttcctccctgatacaataaaaataatttccaaggttagattctatcttgcaagagcttttccccaaggaggtgcatgcatcttcttaatttattatattatataataattcctcataggaaaactaaaggcaaattaaaaccacatggagataatgcctgactgtgctttagactgttgtctaccactggctctttagaaaaagatcagagatacccctctcttgattgtccattttcttgatcatgcaatgtggtattttaagttctatgctggctttgatgcttttgttagtcaaggtgcatgtgtgaatgtgtgaattggatatgtgaatgattttaatattagcttaaataaaacattactgggaagacaaattttctgaaattcccattttcctcttccacttcccctacccccaaagaaacttgacatattcgtttcaaagcatacactgcttttttactatttttatttttatcgtgcatatcacaaccccttcattagtagacatcattgagcattaactgtgacttaattctagaaaaaaatatttttgagatacccattaagatatcacccctgacaaatataaaaagagaccttgagtttacttcattttaaataaatagactgtcttcatttcctaactctgtgaatctgacgcttcttatcaacaccccaaattactgtcaacaaattcaaaaccatctactgatgaatgagatgtttaggtccaattctgatatgccatgctcattctcatacagagaaatacctacactcttttaaatatagttgttattgctgtgacttgcacctactaaacaaatgtaaaaattcttacagttcaagaaataccagtgaagtgtatattattgccctcattacacaaaatgctcatggaaaacactctatcaattccaattatgttctggggggaaaaaaaaggaaactgaataaaaagcaatcccagaatatttgactgggctggttggttatagctgctgaacaatatgtaattgtaagaagtgtggcaaaatgataaaaataaactcagtatttgttaaagaaatgaaaacgtggcaataaaagattccggaaagcgatttagttttttgcattacttcttcattacttgattattttactgtttcatttctatttacctaccaagttgattcttttgcatctggattttgcacaattctttcaataatatacggttcagtggctataattacaggattgttaaagttcacattttactattcatcttgttatctctggtaatggaaggttggaataaatgcacataattacatggttggtcttaaattatttttatattgctcttgccaggatatactcgaaaagcagtatttattctctaatatttatttttggtggtagtggttttagcaaaataaaagtaataaatacataaatggactggtcccacgagcttactatctatggtttttttcaaattaattctaacccattcatctctctgagcctgctaggggcaggaggtgcttagagtctatggaagaaaaacgtcatgtttcagagctctggtaacaggaaaatgtccctcatgaggtactcatcatttgatctattattttatctatttgtagcagagtaactcagtaacctacagatctgtggaccaacttactaaataaggtgtcaaataagtttgatttcattctaaagcaatgccatgtcatgaaagtaaagtgaatttttttgtttgtattatactggaaatagtctcattgtactatatggcactcaaaacattttataaaaatcttagcactatcaactaaaaattaactcataagctcccgtaattaactgaacagatgactccctgttggccaaagggaccccagaaaagactgaagaactgagttcgtggccattgatggaagcgaggtcagaaacgcctcattacatgccctttatgttagagtttaggcacaactgaccagcattaacattaaaatagagatcataagattaactaaagggactcattgtgacactaaaataccacattctaaataagacctaaggccatgcaaagcaagggttaaggcatgctctgcaaaccgtaaaatctttttttaaaaaattaatcctgcataatgtggcttactttccaatctgactctggtataccctcacatggcagatagcagaccccttatcttgacttaagcatccctttgtattgacctcaagtctttagacaaagcttaactctttcaatcaattgccaactaaagtatctctaaaactcacccatgacttgtaagcccatgcttcaagatgtcccaccttttcaggccaaaccaatgtatacttttcatgtactgatttataattttacctacaattcctatctccccaaaatgtataaaaccaagctgtaacctgattactttggtaccaattatgcaagacttcttgggtttgcgttttcttgggctgcaccattcatattggctcagaataaacctctttaaaacattttacagaggctgatttttccatgaacagcagcatccaaaaaatccacaggatacatgtatcaagtatttattaagtacctacgatatgccaggcattgggctatatatgaaaaacagtgttatcagacatccacctagtgctcctgattaaaaaatggatgtgagctcattttacctttacggaggtccagagatttaaattacttgactagtccctcagcgagtcaggagaagaggggttaaaacctgattcctccagttatatagtcatttaatgttcttggacttaccagtacttttgagtttttgtgttttttttttttttttccttaaacacaaaactacacccccgcctccagctcccaccccctcccacacatatacccttttttcatagaacaaaatttggaataaatggactttaaatgaatgcattgttttgactctgcagggaaatgacatagagaaaataaggaatggatcgtacatgctcatgcactgtctggggcactcctgctgaagtctcaggagtgtctttggtttgttgtctgagacctgagagttaaaaagcagagtgccttttggaggaacacgtgtctctttccgcagcgggacgtgcacttgatacacatcagtgggcatgccatcagtgcctcgcagctcatctttctctttagggtggctgtgttgttcttccgatgactggcttgccctggagaaaaatactgcttaaatattaagattagattagttttcacacagccccattttaaccactaaatttaaatccctcagcaatctacttcccaaccttccctaggcataatattcagtttaataaatggtttgtatgccattatttctcatcaatatataaaaactaaaaggaattttaaaaatccatacatcttggttgagatgaaatttgacttgatgagaagagattattcttagaaatgtttctaattcccaatcaaggcattctatttcaaaatgtaggagcatggttgaaagaataaatctttagaaaataatgtatgagcatggttgaaagaagaaatctttagaaagtaatgtatataataatatacatatatgtatatatacttatatataagtgtatatgtaagtaatatatatctctcacaaatattgttttagtcatcatcatcatcatatacacgtgaatatatgtacatatatgtattatatatggtatatggtatatatgtgtatatatgcaagatatatatgagtatatatacatgtgggtgtgtgtgtgtgtgtatgtatatatatatatatatatatatatatatatatatatatatatatatatatacacatacatatgactccaaaaacaattcctctacaaattgtgtgtcacttccttgacccattacctccccaatgtatatatcatgtgaatatcaaacaattgaatgttttgttggtacaattggattcattcacacggaaacgtggagtctatttcttccttcaaatcctcatcctccaattaattagctgaaaaactgactgcatctctgattctctaagaagcatggaagagaaagaaatgggaaaccagctagcagctcattacatgaattcaaacagttccctttgaagggaaactttttcctggcatagatgatgtcattgatgagattgcaagggtaggcattgtataaagatgagatcctttttaattctgttttcaaaactataaagctaaaatttttagaattgaaatttcagttaacatgacccatgtattagataaaatgtctctttaaagcctgggagctctccaaggtgtggtgtgtttcctatttgctaggtacatgattacgatgcatatggatagatgtttctgaagtgtttccttctaagtgcactattgccagtcagatttacacccaagtagcaaagatgttaatgccatgcaatcctattaatctaacatgttgcttttgtggattagaactactcagactctaccttttagttgtagttattttaaatctttaatactgagctatcaaattttcttttatgatacaaagctactaagtagaagatacttgaatattccattggctgactgatgtgtttattaggcacttactctgtgcccaacacaatgataaacattctcagcaatatcgtgaaagtttaacacaggattcctggcttccagaaatatgatgtttacttaagaagagataggaacatatgtgaaaaagttaagcttcatgtagtatcttaagatgctaagtttagtattctggtggtggagtttcttatcaacaatgtttcacagaagatattgagctcagcttttcattatcaaagcaattgcatgaagaagaaatttgagaaagtacaacccctggtaatgattggagcctctgaaacttttgtaatgtcaatatccatagcatgactattttttatttccggtactgatgtggcagaagttgtggagtagtgtttttgagttatccgctgtttaggatcctgtattaaaagaagtatgtcggctgtgcatagtggctcatgcctgtaatcctagcactttgggaggccgaggcaggcagatcacctgaggtcaggagttcaagaccagcctggccaacatagcgaaactctgtctctactaaaaatacaaaaaaattagtcaagcatggtgtcgtgcacctgtaatcccagctactcaggaggctgaggcaggagaatcacttgaacccaggaggcagaggttgcagtgagccaagatagtgccaccgcactccagcctgggcaacagagctagactctgtctcaaaaaaagaaatatgtctcagtagtgcagttatccttctgtaggtttgtattggtgttcagcaagtatctggtaaattaatgaattaacaagagaatagtttctatgaagcagaaatgcatagcaaagaagtggggtgttgaaaggaacagctgggatatcagttatacaggttgaaatgtggcattggtacaatgacatattagttatactcttacaagttgtccttgagtgggtgcttgatagaagttggcttgcaaaccaaaaaaggttaaacacttgtcatggcctcaggctaatgaccccttctaatatgcaattctgtttttctcattctgagagcaaaccagatgccccatgatgtgcccactgttcttttgctaatgtgttcatcctcagtgccttcattaccagtttctttcatttgacatgcaaagatcttttttcttggctcatcccagagaagtggccgggcaagtgttctcctgagaaaatgttgatgactctggcacacagaccacatacaatttgctgcttcctcacattcacactgaagttggctaaggtgcccagagagaaaccctgagccctgactgcatccaaaaccagtcattagggatgaccaccgtgggatccctcctactgggtgcctggttaaaactgagtgtcagagaagagactggtggctttgtcattgactttcttgttcagatgtaagagcatcatcactgggagaaggaaatgtgaattgtgaaaataaataatgcagatagaagagtcggaagtacagaggagtgttcctagagtgctttatatggagctctattatggtgcataccatggtgtgttgttaagttagtttacgtgtcagtttcccctttacactgtgaaatttagcaaagcagagactatgtctgattcatctttattccaagtacctcacaaaggtaatgctagcgttgaccttaataagcatttaatcatgtttattcatttattttttgaatgaatggataatgattaaaattgaggtttttatctcttgattatggagcttaactcattgtgagcccattgacatcctgaaatacttgctgaatgagagaataaatgaacagatttaaaaaaaaaaaaaaaccctgaagagctaagcttaagccactatttaggctttgaagttgatccatgtggtcttttgttttggattgattgtagggactaaagaagtacttcatacgttgtgttatctttctgctcaggtcactgtggacgatagatagcctttacttctccgctttctcaattttcagccactggtattcaactgcaggccttctttaaaaatgtacctctttctttcaaaattttctgaaaagctagaatttttttgttttttgttttttccaggaaaaaattttaacttactggagaccaatttcttttcttaaacctgtctctgagctgagtatactgtatagtccctataatgattttggtaaatccttaagcataaggtggtcattgtgtgtgacggtgttttctgtttagtgaagacaaatggtgggatgagtctcctgctaggatgtgcagaaatgtgagcattagtctcaaggtacattccgtaaagtgttggtgccaggtgagtattgaggttgatagcttctgtgaggcctggtttcctggggttgtgcccatgttcatatgacagctgcttccacaataacatagcaggtgcgtagctcaggatttgcccactttctgcaagtggacactctcgcttgtatctaaaaggcctctcccatggtgccagaatgcctctgacagcattttcagagctgtgacggcaggactgtagctttatggtgggagcttctatctttgtaaatgccactgatgtcagctctcaccattaaccattttcttttgtcaaatgggagagattcaggactcatggaagtgagagactggcatgatgaggcaaacagggggcagtttaactggctgtttggccactttcccccactctaattctccttctcctttccataaaacatgctttccaatttctgccaataaaagcctttttaaaaaagtactagtctttcatttttttttttgcataccttgttgttattccttctgaaccagtagtaacacaatatacgaagtacattctcttgggtataaggccagtgtataggtgggaatcccatagacctaaaaagaaaaacaatctaggatttctggatgtgctctgaagtggcaccttctaagctgcagtatttgttcaacagtgtttttccaacaaaaaataggatgagttcacctgtgaagcatcctgaagggaaacaccggtgcactgggcagggaacaggagacctagatatacttcttcttttttttttttttttttggtagatatatttatttatttatttatttttattttattattattatactttaagttttagggtacatgtgcacagtgtgcaggttagttacatatgtatacatgtgccatgctggtgtgctgcacccattaactcgtcatttagcattagttatatctcctaatgctatccctcccccttccccccaccccacaacagttcccagagtgtgatgttccccttcctgtgtccatgtgttctcattgttcagttcccacctatgagtgagaacatgcggtgttcggttttctgtccttgcgatagtttactgaggatgatgatttccaatttcatccatgtccctacaaaggacatgaactcatccttttttatggccgcatagtattccatggtgtatatgtgccacattttcttaatccagtctatcattgttggacatttgggttggttccaagtctttggtattgtgaatagtgccgcaataaacatacgtgtgcatgtgtctttatagcagtatgatttataatcctttgggtatatacccagtaatgggatggctgggtcaaatggtaacaacaggtgctggagaggatgtggagaaataggaacacttttacactgttggtgggactgtaaactagttcaaccattgtggaagtcagtgtggcgattcctcagggatctagaactagacctagatatacttctaacataatctgtgactgtgtgcaggtcatgctaagtatgtcagactgccattttctccttgaggctggaagtgtggggagaaggggataatgtagttgagaatccattactggccccaccttggacagagagacaggcaggtaaagggtacacatgtgcctggatggtgctgctactggactcttgtttacattaatgtgtcaacagtgtgctccaaggttctattaggtgttaacaggtgtctcaagaaaaaaatgtttcttaatgagatcagtttgtaagaattctgggtgaacacgttaattagtttattcttttaatgcgttgaatgttttttttttttttgaaaaataatagaatcccttcagaattcttaatatgatatggtgttctgtatattttcaagaggagaggtatatagtgtttctcaaatttatttgcacatgaaatgcctgtgggacataatatctctgaaggccgatgttccttgaaagactgtgtgaaatattgaactatatgatctctgaaagttcttgaattctccattatcatcagaatacctggcccttccaagcccttgaccttcgtctgtggagtattgactctagctgccttccagacattgtcatctatgcttcttttcctctgaggacgatgaaccccggctgttctctcagtacccctgaaaaatgggaaattgtatttttttcttctttgtacccaggagtctatgtataatgcataattctcagtcaaaaggaacttgcttacttaagtgctcaaaggtttttgtcctgtggtttttgtaaggtaatcccacaacatccagataaacaaataatcacaagacataaccttccagagtgttccataacattgatcacaatcaaataatgaggcacgattccatgaaacattaggaaaattataaaggcatcaggcagaaaaccagcaactagcaaatggtttctccatgatgattttgggttcacatttcacttccatatataatacaacttatgtgcccatatttcatcctctggaagcctgccacattatcctctgaatgaatattaacactccttgtactctgaagtagcctctggtattctggtatttattcaacaggttttgaacaagattagtggattataattttggcttcaccacattttaaactgtgtgccttctctgtgcctcagttttctcctctgcaaaatggaacaatagaatccttttcattgagttattctgaggattaaatgagtgaatataggtaaagcacgtaggacatccctggcatatagcagtcaatcccttgtaaaatgttagctgcagtgggtgcaactgactgcggccagttgtcaccacctgtgacatttaccaagacaattttgggtaaaaaaggcagatttattggagaaagtacaaagataccttgcaagaaagcaatgcgcaggacaatgggctgtctaccaagaggcaggagctagagggaagttttatagggtcatactggaggggctatgtccagataagttgtgcagataaggtcctgctgctagggctatgtccagaaactaggtatttgggaacatgatgttctgtcagtcggttgtctgtgataagccatctcctctctcagaacaattgttctccccaatctggggccccttcttcattcttgcttatcttattaggactccacattaactattgttgttattatcatacacagactatctctgaaaggatatataagatatagataccagccataacctctgcaaaaagatacaaagagactagggagccggaaagcaaagatagaggagtaggcttacttttccctacatatgaatttactctattgaatattttaaaatcacctgtgttttaccatcaaaaaaataaaataaaacaagcatcaatatttacaaatgaagaactgaggttccaactttacgattgactttcctaattcaattggctatttgacttccctaatagttaagttagatttgagccagggatttgaactacaaaaaccgtgttttttctagtctaccaccttatatagagagatatgacagaggggagagatgagaggtgtgtgggtgggtgggtgagggtggaggaggtggtactggatattactgaaaaacttttgatgatattgaattctttccctgagttctgtagattttggcactggtctcttgtttcttctatttctactgtgagtaaacaaccattcccaatcctccagttctaacttgaatttcagtggactaggctgagtggatgtacaagggcaaacctgcatggggtgtagggaaatataaatagattggcactgtggaagtcagcatatgtttgcttggcacccaaccctcctatgcctttcatttgctgaatattaagcatctcatttttatctgtcctctttttgatggaatggacatgcaaatttttcaaacctacacaccctcttctttctcttggacaaagggagtaattttactatgaatccatcatgtgtcccaaggaggcaaactcaaaatttgtctgcaaaaagcctttcattcatttcttttcatgtaagaaacaaaattggcaactattttttcatagcttgtaaattccaagaaacttagtatcttttcttttcacttgctctgcagccaaaagcatattgttcagcattgcgaattcacaatactcactgctcctcagtcctggctacaacataattttgaaaagtttatgcagggaccatccgagtaataaatcacagaggaggactgctttaactgttcaccccttagctactgcctgaatgagctccatgctttatcatctcagaaggaagctgtctcaaatgcatgcttcattttattatccaattgtaacccatctagataaatttaacttcctatagatttgctgcctcttagtattcatatcttctccagacttttcattaatattatgatacttggataggagtattcccctccctttcctttataatgtaacagctttaaattgacatttggtgaatgtatcatcattgctattcaaattaggtcagtgtttttatttcattatgctggaagtcctcttagctgcgaaatcaagtttgaatgtctgttacctgaagcaatgcttctggcaaatgtttcttagaggtttttgcaagccagaaattgtcaggcacctcccccactcccacttcttatttctatgtggtttggttcatataaccatttaacatatttttataaagcggtagttgaatagagtataaaataggaaaaaattaatcatctgccctttaagaggtttctgtccactgtgtgggtgttggagagggaggtgggggaagagaggggaagggaggcagatatgcaaacaaaaatcatactatgccatggttttggtacagtcagttaatgtctaggatataatggaaacgtgggaaaaggagcctcttgacgtttactaagacttgagaatgagtttttttcttaataatctataaattgaaatccactctttctaaatgtgcctttggcactgttcttttgaattaggaaatacagaaaaacagttaaatttggttgaacgatacaggaagtactcagaaaaggcaaccatcttaccccaggagagatcaaaagacattcacagattatgttaacccaaagttttggcctcatttctcaaggaaggggctacatcttttagaccacaggcatttttccccagttttgaaactgtgaaggtgtttaggacctgagagattattaataacaggtttcaatgcctgacactcttggacttaaatgttcacctacactcaatctgatcatggacaaactacttaatctcactgagcccatgtcctcatccataaaatgagggtaataatagttccacgttttagtattgttaggatgattaaataaaataatgcatgtaagtaaaataacccagctattggaacaatcgctgctgtataataaaccatcaataattcttagcttttgctatcattcttgctactgttaattagttagtggttctcacttttttctagaaattgctctacctctgtttctcaactgagatattatagtttaagactttgattatgataactagatgataatttagatggtgtctttttttttattatactttaagttttagggtacatgtgcacattgtgcaggttagttacatatgtatacatgtgccatgctggtgtgctgcacccactaactcgtcatctagcattaggtatatctcccaatgctatccttccccccgcccccaccccaccacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgtagatggtgtcttgatcagcaatctatgctttgagtgttttttgttaagtggctaatgcagtttgcatatttgtcccactaaatctcaagttaaatgtaatcctcagtgttggaggtggggcctggtgggaggtgttagagtcatgggctgagcactcagacttgggcaccatccttgtgacagtgagtgagttctcacaaggtttggctgtttaaaagtgtgtggccatttacctatataacaaacctgcacatagtgtacatgtacccctgaacttaaaataaaagttggatatttttcaagtgggcttcatccctgggatgcaaggctggttaaacatacgcgaatcaataaatgtaacccagcatataaacagaaccaaagacaaaaaccacatgattatctcaatagatgcagaaaaggcgtttgacaaaattcaacagcccttcatgctaaaaactcaataaattaggtattgatgggacgtacctcaaaatcataagagctatctatggcaaacccacagccaatatcatactgaatgggcaaaaactggaagcattccctttgaaaactggcacaagacaaggatgtcctctctcaccactcctattcaacatggtgttggaaattctggccagggcaatcaggcaggagaaggaaataaagggtattcaattaggaaaagaggaagtcaaattgtccctgtttgcagatgacatgactgtatatctagaaagccccatcatctcagcccaaaatctccttacgctgagaggcaacttcagcaaagtctcaggatacaaaatcaatgtgcaaaaatcacaagcattcttatataccaataacagacaaacagagagccaaatcatgactgaaccactcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatctcatccccatcaagctaccaatgactttcttcacagagttggaaaaaactactttaaagttcatatggaaccaaaaaggagcccacattgccaagtccatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcttatctacaaccatctgatctttgacaaacctgagaaaaacaagcaatggggaaaggattccctatttaataaatggtgctgggaaaactggctagccatatgtagaaagctgacactggaccacttccttacaccttatacaaaaattaattcaagatggattaaagacttaaatgttagacctaaaaccataaaaactctagaagaaaacctaggcaataccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctatagaatgggagaaaatttttgcaatctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaagaaacatgaaaaaatgctcatcatcactggccatcagagaaatgcaaatcaaaaccacaatgagataccatctcacaccagttagaatggcgatcattaaaaagttaggaaacaacagatgctagagaggatgtggagaaataggaacacttttacactgttggtgggactgtaaactagttcaaccattgtagaagtcagtgtggcgattcctcagggatctagaactagaaataccatttgacccaaccatcccattactgggtatatacctaaaggattataaatcatgttgctataaagacacatgcacatgtatattttattgcagcactattcacaagagcaaagacttggaaccaagccaaatgtccaacaatgatagactggattaagaaaatgtggcacatatacaccatggaatactatgcagccataaaaaaggatgagttcatgtcctttgtagcgacatggatgaagctggaaaccatcattctcagcaaactctcacaaagacaaaaaccaaacaccgcatgttctcactcataggtgggaattgaacaatgagaacacttggacacaggaaggggaacatcacacactggggcctgttgtggggtggggggaggggggagggatagcattaggagatatagctaatgtaaatgacgagttaatgggtgcagcacaccaacatggcacatgtatacatatgtaacaaacctgcacgttgtgcacatgtaccctaaaacttaaagtataataaaaaaaaaagtaggatattttttaaaaagtgtgtggcgtcttcccccttattctctcttgctcctcctcttgtcatgaaatgcaccagctcccccttcaccttctgccatgagtaaaagatccctgaggcctctccaaaacctgagcagatgccagcatcatgtttattcagcctgcagaaccaactacacatctttaaaaaaaataaattacccagtctcaggtattcctttatagcaatgcaagaatggcctaacacagtggctttttttttcttttaagtatattttatatttagatgctactattagcagatgatttgtgcgtatgtcttgccctgttcagctttgaggagtccaggcccttatgggactccttctgagagtggggttcctattttccttaggaacccaagacagttctttcagaggatttcattgatctgttgccccatggtgctttgtggcacataatgacaaagcatgacaggcaggctcacagccctcgactcatgctagatctcggttcattctgtatccagggactccagttcatcatatcccttacccaggcctctctcctagctatgtctgtgtggctcacagatactctagagggagaggcaattaatttctttttggcggtgagatggtttgcctgggtccccactccaatcttatcttgaattgtagctcccataatgcccgaatgttgtaggagggacccagtgggaggtaattgaatcatggagatgggaattcatgttctgttgtcatgatagtaagtctcacgagatctggcggttttataaatgagagttcccttgcacatgctctcttgcctgcaaccacgtaggttatgcctttcttctccttagccttctgccatgattgtgaggcctctccagctatgtggaactgtgagtcaattaaacctctttttctttataaattacctagtctcaggtatgtctttattagcagcatgagaactgactaatgcagggggttatttcatgtcagacattgtcgtaagttgtgtcttccttggtgtcttagttttttctgtgctgctataacagaatacctgagactgggtaatttgtaaagaacagagatttatttcttatagttctagaggctgagaagtccagatcagttgggtggcatctggcaaaggctttcttgctgttttgttctatgatgaaaggtggaaaacaagagagagaacaaaaggtgtctaaatttggttttatagcagatccattccttgataaccaacaaactcccaggatgataatattaatccattcatgacggcagagcccttgtgacctagtcaccacttaatgctcccacctctcaccactgttgcattggggattaggtttccaatacatacctttatggaacacattcaaaccatagcatttggcaaataacccaaacccttctttcctcatctgataattgggaaaataatagcaactaccttgtggatactttgtgagaatcccatgcttcatgcaataaggacttaataattgtaagttgttaaattgtcatacatgctccttttagttatgaaaacctgtggcttttgtctaagagttgaatatgagaaggttcaaggactagggcttttatccttggatctctgtagcatgctgaattaatgaaaggtctgtctctctctctctgattaatcaaaaactctgactagtactagtgaaagtcaggtttgaacaattctgtgaagaatggatttggaaggaaaatatgaggcaagaattttaaaaagttgtttctgagttgaatttgatttacatttgctaactggaaaaagatcagggtataatcagtccataatattgaaagcagtttggaaataccattgcagatacaggtaatttaaaaaatctacatgaattaggtccaggagcggtggctcacgcctgtaatcccagcgctttgggaggccgaggctggtggatcacgaggtcaggagatccagaccatcctggctaacacagtgaaaccccgtctctactaagaatacaaaaaattaggcgggcgcggtggcgggcacctgtagtcccagctactcgggaggctgaggcaggagaatggcatgaacccaggaggtggaacttgcagtgagtagagatcgcgccactgcactccagcctgggcagcagagcgagactctgtctcaaaaaaaaaaaaaaaaacctacatgaattattcttcctgtgacatatttgtcattcttcatctctcctttaacattcctatcttcatccttcaggccatcctctgcctacctctttctgctgctacagtgtaagttgaatcatactttccaaaatatgtaaatgaaagtcagaagtaaggcaactcatagtgtttcagtgactttgatttcaatctcactcaagactgggagattctcctaaattctagcaaacttgtgcctctttcccagccttataagaaactgtccttctatctaaatactggaatgccactatgtgaagcttcaaatcagggtggttattctgagacaatggcagcttcttgggatgtggtgtaacatgtactaaatcattatgtgcacatacatttatttttaatcaacctgcgtttacctgagtgctgtggtttgaatgtgtcccctaaagttcatatattggagacttaatcctcaaggcaacagtgttggtgtatggggcctgataagaggtgattaggtcatgagggctctgccttcatgattgaattaatgtcattatcacaggagtgggttagttagcacgagagtggcttgttctaaaaggaagttcagccccctcttcctctcttgccctttgcctttggtcatgggatgaggcagcaaggagtcccttgccagttgtaggcccttcgaccttggacttcccaggctccagaatttcgaagaagtaaggctctgttctttgtaaattatccaggctcagatattctgttatagcagcactaatggacttagtcaccaactaaatgtaatggacaagaatggcctacattaaaaaaaaaatgtgattagaggatcttaatatcttattctgtagtgaactttagaatattttagacactggagattttctatcagatgtatcctgtggattcaataggattcattttgagaggcagctttctgaagtggaaataattctgtactccaggcacagtaattgggttcaagccccagctctgccatttactgggatggggagaaactcttggacagcctgttaggcctttttggcttccacttttcttgtctttaaaataaagttaataattttcattctgcttcactcatggcatagatgtgaggctcaaataaaaaaatattttggaaactaccctgaaaactgtagaacattctacaaatattatctaacaaaatatatgaatgcataattagtgtcttcaagggatgtcataaatatcgtaaaactaaagggtgagctgtatcaaaacttggaagggattgggatgaaaatcaaactgtctaaaatagaatggccaaatacattgggacttggctccagaaagaattaatgagaattacacagattcatatcttctccattattccattggtcacgtctaataacttgccatgaaattgcattgatttctacaaagtgattgcatatgctgttgcctcttttcaactgcacatgtcataattcatccatccagatcagtattttacttttaggaaaagagagatgctaactttttctcagaggagagtgtttagaagtctatgttctatagtccctcctagagaggggggatttcttcagtactcagcagctaatcttttttttcttctctctctttttccttttttattatactttaagttctgagatacatgtgcagaatgtgcaggtttgttatgtaggtatacatgtgccatggtggtttgctgcacccatcaacccatcatctacatgaggaatttctcctaatgctctccctcccctaacccccacactccccaacaggtcctggtgtgtgatgttcccctccctgtgtccatgttttctcattgttcaactcccacttatgagtgagaacatgtggtatttggttttctgttcttgtgttagtttgctgagaatgatgatttccagcttcatccatgtccctgcgaagtacacgaactcatccttttttatggctgcaaaatattccatggtgtatataccacattttctttatccagtctgtcatcagtaggcatttgggtttgttccaagtctttgctattgtgaacagtgctgcaataaacatacatgtgcttgtgtctttatagtaggatgatttataatcctttgggtatatacccagtaatgggactgctgggtcaaatgttatttctggttctagatccttgaagaatcgccacactgccaacaaacatatgaaaaaagctcatcatcattggtcgttagagaaatgcaaatcaaaaccacaatgagataccatctcatgccagttaggatggggatcattaaaaagtcaggaaatggccaggtgtggtggctcatgcctgtaatcccagcattttgggaggccgaggcaggcagatcatgaggtcaggagatcgagaccagcctggctaacatgatgaaaccctgtctttactaaaaatacaaaaattagctgggtgtggtggcatgcacctgtagtcccagctacttgggagtctgaggcaggagaattgcttgaacccaagaggcagaggttgcagtgagccaagatcctgccactgcactctaggctgggtgacagagtgaggctccatctcaaaaaaaaaaaaaaaaaaaaaaattcaggaaacaacaggtgctggagaggatgtggagaaataggaacgcttttatactgttggtgggagtgtaaattagtgaaaccattgtggaagtcagcaggtaatctttttacggtctgagtaatgaggaacctggctaatagttgccattctagatagcattaagggtgaagtctttgctcacagaagttggtgtatccagacagacattgtaattacagcagagcaaattaccatactctgaaagagaagaacacagaaagcaacaaacacatttaaagaagactgtcccagaaataaggagaagggcaagaaatctaagcagaatattccacttgccatttacagcatagacaaggacagcaaaatggaaagtcacttatataactgcaggataaagagatgggtgagatgaaatatactttctccgaatgaagttcactgtatgtgtagtggattaaatgagattgactatttttaaaaagcctgttacaaagaagaacaaatttaatagactattaagaggtaaagaggaacttttaaaagcacatattgattaaaacaaaagttatacactttgggaggccgaggcgggcggatcatgaggtcagaagatcgagaccatcctggctaacacggtgaaaccctggctctactaaaaatacaaaaaaattaaccgggcgtggtggcgggcgcctatagtcccagctactcgggaggctgaggcaggagaatggcgtgaacccaggaggcagagcttgcagtgagcccagattgctgccactgcactccagcctgggtgacagggcgagactgtctcaaaaaaacaaaaacaaaaacaaaagttatagttcagaatatttattgcatacaactcagcaaacaaagttgacctagatacaagagtattattggaatttgttagtgaatacattgacaaaattctgttatttttgtttaattatcactaggtccagtagggtggaagtcagaaattttgacttaaaatatcagctaattgaattagttatttcaaatcaatgtctagtttggataagaatattttataaaaaaacaaatcatagtattaggcatagtttatgcttggtggcatgtagagaaatataaaaataaaagatagtgaaatctttttaaaaattgtgttgaaaggtataatcatttgtgttaatgtattattcaaccaggatgtaggaagaacacacatgtcactgagctttgttctggggctggaaggaagtgcaaataacaatgatgataataataacagcagtagctaatatttatcagatatagagcttgttaccaccacagtaagcaatttgcatggagtatctcagttctcgtgattagtcaggtacacttcttacattggtttttcggattgagatattaaagtccttagaattgaaagaacttgctccaaatcatacagctaggaatggtagactagcgtttttactcaggcagtctcaagataacatttgttgagggtctattaacaaccaggcattgagatggtgtttacacatattagttatctcagtggttcttaacctgggatgcatgttaaacttaccaaggaagcattttaaaaccctgatgcttaggacctacaccaggtgaattaaatcagaaccttttgagacaggggcaggacttggcatcagtatttcttaaatataaacattgtatatgtaaatattatatcaataccagtatttttaaaagtatcccaggggagtcagccttttgaattactgtccatttaatattcaaagcaaagtctatacatttgtattattcctattttatttatgaggactctgagattcagtgacgataactgacttgctcgatcaaggtcacttacctggtaaattgctgagctgggatgtaaatgcagttctgtctagctaaagagcccgcattcttcttgatgcctcagtgtctagccattttacccagagcaataaattcacttgttcctgttatttagtgtttatcatagaatttagctttagcctcaatttcattttattgtcttcactattgagtactcacaaagggagccagttaacaacatctttggaacaaccatcctgtgtggagcattgtgctaattgctgtgggaaagaacaggggaagatatgaaatattccctttacaaagatatctactgttctgccagggttcataactttgggcctgtgacttgacatctgggtggcaaaagaagtctcatgaattgtttgggaagtattcatagttttcatcagattgtaacagagccatgagccaaaatatttatgaacttctgccttgcttggtatgtaaggcatttgattccagaagcagtggcatattatcttgaattttcttcataaaggcaaaacagtgccttttcaagagattttgagtttgatatactgtcaaaaactgtttacagctaagcctagtaaaagatgttgcatatgtggagtgtgtgtgtgtataaaaaaaatgcaggctgtgaggccgggcgtggtggctcacgcctgtaatcccagcactttgggaggccgagatgggcagatcatgaggtcaggagatcaaggccatcctggctaacatggtgaaaccccatctctactaaaaatacaaaaaaattagccaggcgtggtggtgggcgcctgtagtcccagctactccggaggctgagtcaggagaatggcgtgaacccgggaggcagagcttgcagtgagtggagatcatgccactgcactccccgctgggtgacagagctagactccatctcaaaaaaaaaaaaaaatgcaggctgtgaatataaaacaatgaaataaatttcattagtggctcagaaactagatctgagaacaaggatttggttgtttctggcaataaaacattattaagaaatgtgatatcatgaggtaaatatcttaaagaattgtattcatttacacacatatatgtacaaataaatttgcacacatatatacatgctatgcacatatatactatatatacacatgtatgtattatatgcatgcaccaatacatgctggcatgttttatgcaaattgatttttattccatagctatttttcctatataatccattatttttaaatgtattaataattttaatatcaccataaactgaaatgagtaaagaggcctgtaatgtgaatattcatatatggaacataatacgggggttgcgtaattataggtccatatatgtattgtatttcctgatatatttatatatgaaattgctagtatgtgtgaaagatatctacatatattttactaataagagatatattcatatatatatatacaaatatatgctttatagagcctaagtttggggtggaacaaatgttctcacccttgtttgattatgagaaccacttgcagagctttttaaaaacctgagtcccttttacccttgattcaaattcagtacatccagagcgggtcctggtgctgtttttaaaacattccttgaatggttgtgttgctttgcttgagaagcagccctgtagtttgtgtacaggtaggaatgaggaaggaagggtaccagacaacagacaggtaagacagtcaaggggaagaggccaggaaaatttctaccaggagggtggcagtttattgatttgcttatgttaaaatagttgagtccgcgctgtatctttttacttgattaatttaatttacacaaaccaaaggtcaatatcaatgattaatgtcagagggaagggtattattattatttttaaccctacttctttttcaactactacatatctgaccttgcagaggaaatcttggagagaaaatagccactttcatacgactatcccttggtcaatgcgctacttattaaactttattttcccactgaagaaagaaaatcctaccttcagggaataaaatagagattcattttctgacctcctagtataatgctaaaggaaaagcatacaatctctttggggagggagctgttaggaaggccagaggcagctgtcttggaaacatacagaaaggtgctattgggacagagcataatttaaagtaggtgagattggaaaatagggatttttccttctcttttacatttttttttcctttcttgaacatatacagttcttcagttaagtgttagcctgagattaaatataacatttatgaagctcctttcaaaactcatccctgcatgtgaatggaccatttcctcctttataccactgcactgacttctaattacatgcatctttcatgaaaatgtttgtcagactgtctgatgttaaattgcaagataattgataacaagacccatgtcttaatcatctttgttggtgctaaatacgtgtttattgaatgaatgaacaaacacttggatgaataaatagactgtaattgttagtaactccatgagacctgcacatttctttgttattggcactttgcctccctgtttctcttgagcttcatggttctatatctacatcacaggtagtctagtgtaaggttgaataacaacactcaaattaaaaagtaaaaatcttaagatgcttttggtacctaagcataatcataaaacaatggtcttgtttaatttgaggaggagataagtgatcaaacccaagaatccataaatttggcctaagtattggtatttatttccagagatgggcaaggaaagagtgttggaagaaaatacaaggtaagttttacaacctgtgagtactcagaacctggactttcatgtcttttagaaagacacattgacaataggcagaaaatccttagctacaactcactggctgaaagcttggtcagttaaattgtgaatttacatggaatccaaatgaagtgttcagacatttcaaacatctcttgcttaatgaggttctgtgcctggctagcaggtcagcagtctgatttcagtttacagatgcagtcttaaaaaaggaccctgagatcatctataacacttccctgtcttcctttgctccagctgcattcatcagcttccatcagggttcacagcaatgaaattaattgacaagaagctcaatcttaagagcactctgaactgtatactcttgccatccacccgctaactccaatcctacatgaatgaatgcaagtgtagttttttgagaaggggccatggctcaagcagtgccatatatgtgccttctatacaactggcttggtatctggtaaaatttccattgcccagttacaaactagccagtcccttgcagacctaggatcctcttagaatgccctatcaggaagttctttgcaagatgttttaactgagcaatgaatttatagaggaggacttgaataaattgtttcaaaaatgaaaccatttgaacacaaatcatgtctttcactaagacccagacaaactaactcatatgtactccacacatctcagtgtagtaagcagatggaaaatattcattgttttttttttttaccaatgagacactagtaacaaagagaaagtgtagaaattcttcaagatccctagaggctgggcaatcatatttctagcaaaactcttgactttcttcctgttctcaacctctgccattaaaataaggaaatagtgctatcaaagtaaaagagaagcatctgttggaggggttcaagggggttgagtctttaggcatcaaagctaggagttggctgggcgtggttgttcatgcctgtaatcccagcactttggaaggccaagtcaggcagatcacctgaggtcaggagttcaagaccagcctggccaaaatggtgaaaccctgtctctactaaaaatacaaaaattagtcaggcatggtggtacatgcctgtagtcccagctactcggtacactgaggcaggagaatcacttgaacctgggaagtggagttgcagtgagccaagattgtgccactgcactccagcctgggctactgagtgagactccatctcaaaaaaaaaaaaaaaaaaagaagaagaaaaaaaaaaagctgggagtttcattattcctcaaagaaggcacctcagaccaggttccatagggcacgcccctaaagagcccaaccttctcagggttctaaaatgtatcttaagcccaagcaaaatccttgactttccatttagatgccaatatgccatcctcataatattcattctcatggaattttgagttcccacactcttacatagctcccaaagccaacttattttactgctgaaaaatacttcagtacacttttattgctgacactggtttctctatacttcccccagagatattcatgttataagtaaatctttttccaaggtgtgcttcatctcctggctggaagcaagaaaaaaaatgttcaaagtattgtagcactttttacagagtgtgtatcatgaaatcaataatcatttattgagtactgactattcactgtggggccagatattgagaatattggagagcaattagatgtggtctctgactccaggggtctacaaacggcatggtggggaacaagctcattagatgaggagaaaaaataataatataagtgagtataaactcaagaactataattatgcattgattaatgaaacaaatactgaagatttactttttaaaaagcgttgtgctcaaggctatggcagatgtaagtttataatatgaccacttacattaatttgctaggtttgccctgacaaattgtgaaaaactgtggctgaaaacattggaaaatcagtttctcccagttcgggagaatagaaggccaaaatcaaggtgctgacagtgctatgctacctctgaaggctctaggggagaattcttccttgccttttcctagcttctggtggcggccatcaattctgggctttccttggcttttagcagcgtcactccagtccctgtttctgtggttgcaaggccttcttccctgtgcatatgtgtgtgtgagtgcatgtgtgcatgtgcacctgtgtgtgctcctgtctttacgtgacctgatacgaacactagtcttttatttggaacccaccctaatccaatatgacctcatttaaactaattgtatctacaacgattctatttgcaagtaatatcacattctgaggttccagggggacattgttcaacccagcacaacccttaaatatcctattgtcttgttggaggttattttatgggattcatttttggtgttccatggcttttcagaggaggctcagtgtccactgatagtctctgggaagactacgtaggcataggtccgaccattgctatattttcttatatctatgaaatcctaagttaacattttaaactacagtctactgtgtgtcaagtgttgtcctaggctcttatttacttaattcaatcttatcctcacaacagcctttgcagtatgattttttccattgtatagatgggaaactagttcagaaagtttacttacttacatgagacttataagctaggcgctgggatgctaaacaaattagttccaaagtctactattcaggctgaacttatgcatttctggtggtgaaagcacagcctacataaccattagtttgtgatttagaccttagcccaaacattcgtcattatcatatttgaagccaggatggacccattgttccagatctatatactgtatatcagttagccatatcaattaataatcttttgatacttgtcaaagagcagagaaccgcagaaattaagagtttattctcttcattaaaccattaaagattggaggtggctattgtgaattgggcatgaattatagcataagcctatatatgttgcatatagccccccgtaacaagcctccttgttgtcttttgtgttcctaacttatgagcagggcagagattatcactgaacacattgcagggtaaatgtaggactctgagtcacccattggatttttacaggctgaaacatttacagtgtcctgcttacaattctcaagcatcagttaggtgcaggaacacacaggcagagtcagtagctgcccagggaactagtgtccagtctaatctcttcacaaactttgtgcgtgattcaggaaggattattacaggccaaattttacccatggacctgttttgtttagtaaaatattttcaaaaataaattttggatttgaatgactttagggaaggcaggaatgatctaggctctcacaagccttagtcattacccctggcctgaattacatatttatgtgagccctctagtccctggaagcagttctgtttgtcaccctgtacttagaaaagtggaaattaatgtatggttcctggacaggcagcaccagcatcaccagggaactttttagaagtgcaaatcctctagtcccacaccagacttactgactcagaaactctgacgtggggcctgtaatctgtgttttaacaagccttctggttgattctgatgtgcattgtcctaggagaaccactgacttagagataagttaagaaactcttcctttcttgaagaatagcgtcttctgctttctaataatgaacttttctgtaatgcctcaagatctacaaagatgtcttattttgcttccagagtcacgtgagaaaacagtaacaatttgagggaggtgttgctctttcagctttatccagagatgtgcggtggcttgttccaggtgttatatgacaggacaatggacctcaaactcaagattctttttcctctacacttcactactttaactctcctgattattttgtggactgatgaataagtacgtgtaaactgattttagttttcctggtaatgaaaaaaaaaaaaaacaatgagtattgttactcttgtaataatcacatcattttttgtctttctttctttttctcattttatttttagacagggtcttgctctgtcacccaggctggagtgcagtggcatgatcacagctcactgaagcttcgaattcccgggtttaagcagtcctcccacctcagcttaccaaggagctaggactacaggcatgtgctgcaacacctggctattttaattttttattttatttttttttatttttgtagagacagggtctccctgtgttgctcaggctggcctagaactccctgggctcaagtgatcctcccaccttggcctcccaaagtgctgggattacaggcgtgagccacttcacccagcctttttttctgtgtctaaaattcagttactctctcattcacttaacagtttagaaaatactaactatacaacatgtactacgctagatgattttttaacttaaaaatgtgcaatgcacatgcatattcataataaaaatccatctttctaactcctgagaggtaagcaaaaacttattttactgctgtaaaaatcacataattggggacaaaaacttgcatgtaatatattttctatgagactgtattgactttgagagtggttagagttaatggtttgaattagcataagtaaaattaatgatattgtaggtcttaaatgtaaatgcaattttacaccaggcccagaagaaattcccctcacctaccttaattggtcagatgaaaatatttggaagaaatacctcattcaattttttaaaagcatattggctacttgccaccattgaagaattagatctcaaactaaagggattgtcgggatgggcttaaacagccttttgatttgttcattaattcatcaattcaacctctcacaaaacaattgtatgttgaatgactgctaggtgctgtgtgctatgctaggtgctgctgatacagttatgagcaagacagactcagaatcttataaatctttttgtacaaaagacaaacaattatttcagtgagttgattaaatttaatattaatatttaataaagcagaagtaattatacctgcaaaggaaaaataaagtgtgtttttagcacctataatttgaggactgtgggatggtagggttatctgaaaagagataaataatttgttgtatatttgtttcttttggggggtgaatgccatgtgccatgatgtgggaattaattggaaaaccataggctatgggagtcagaagagacattagaggctctaatatctgtcccacttttctctaatttagaaatctggaggctgggacccagaaaaggtaaaatgaattaccccaaagccacacttagtgaatgaaagatgtgtgaacggacatatgcatgggcctccttaatcctatgctagggatgaggacatgcctttcccaaaaataggtgaaattaccatatgataaagaacatttttagatattgggagtagggtagggtacaaggctttggaacagcaaagttaatcagctcagtagggggaaggaaaaaggaagagagaaagagcaggacctccagtggaacaagagtctgtggactctgtcaccctgttactccctcttaatcactcagatgatttgctttttctgcttctatttcaaaataagctgctaaaactgagatgcagtgcagtgaaagcacatcatgatctatgttctcatttttgcatggagggagtgagtaaagacctcctacttaggtagtcatcttgctgtccctgcatgtagactaaggctgtgagagagaacttggtgctttataaggcattccctgtgctggtataaatttgacccttgcatgtgagtgatggtgagggacatctctgagaattgttcctggtacaacatgtgtggatttcaacatgggtactgcatgctggagagatcttgatatgacccaaaagcaagaccagaggcaagcttgacacgatggagcaaagggtggaaaggtagaaaatagaatgaaaaatttttctttgctgtcacctcctcgattttattcaaatcttaacccaaacaactagattgcattactgggctcttaaaagttttgttggaaaagtgctgctaaagaataggaagacaatctaggcaatgccattcaggccataggcacggacaaagagttcatgaggcagacaccaaaagcgattacaacagcagcaaacactgacaaatgagatctaattaaactaaagagcttttgcacagcaaaagaaactatcaacagagtaaagagacaacctacacaacgggagagaatgtttgcacactgagcatccaacaaacgtctaacacccagcctctataaggaacttcaacaaatttacaagagtaggatctcataggtttatttacaataataattcaaatgtttcagatttgtaattgtcctttgaaaccattgctttcctttaattccagctataccaaagactctttggaatgggtaaattatttctacttgatagactaggaaagtgagtcacaaaaaggctcgcccagagctactggttattagttgtgtgtttttctctcctattccacactcgagaaaaccccgaagaatagggggtggttaatggtaaaaagaaatctagaagaagagttctggaaatgaaagacagctaggttttgagtttctctaagaaaaggtagggggcaatggatttaaactaggggcatacactgcgattaaatatcgaaagaaacacactgagatttaaaaatgtataaagggcttatgggaacgaagaactaaaaagaaaatatgaggcaagaacatagggtggcgacagaacaaggctgtgagacgtgtgcttggtttgtttaggctttaaaacttgtcaaagtttaccgttttctctttcaagagggatgaaagaaaggatggtgcttcccttagtttgtttgctttcttctttcatgtatctgccctggcagatatgcatacatgtgcaggcccgtgtgttcgtgcacacatatgcacacagataaagtgggaacagagagaagccagtgggtggtggtgagagatgggggcagaattgatgcatcagggggcctaaatccatgcaatgatcaagttcatagcaatttccccaggagactgtatcatattccagtgaaggggagtacggcaggaggttgccatggcaacaaaaggcctgaaatattaactctgactagcaacaggccagtgaaacagcctagctaggatttatggcacattatagtgtgaaaagcaggagaaaattactgtaaaggcaggaattatagcacaacagaacatataaactcccaaatccgtcttcctaattaaaacagcatgctcggaggtagagcacatagtaaggccattagcttaaatggggatgtgctatcatcgctttgttatcaagtttaatgtccttaagactaactgtgtgcactgggagagtgagagcaagggtaagatagtctggagacagatggaagcaagactcttgggcacttgaattcttctcaaactcattcttggtgacataaggtttcttcagatactagtctctgatcccacaggagattctagaagatgccttgatccttctatttgtaaataaatcatcacttctcaggcatgaaggctgagagactgataccacagtcaatccctctggaacccaccaggaagagaggagcaactaatcaatgaggtttattgttgaggaaaaaggatcttggatctcccgactccctagaggggaaaataactcccttgttgtcacagacccaaactttcttttatgtcttagtcaacagcctgcccctaagtgtttgaatttgcaatgcctggaggaagtcttccatgtaattcatactttatgagggaacctttgtcttcttgtgattcttattagaaactcccaatttctcgaactctaatccaggaccttagtactcagtctggagatgggtcagggaaaatgagaaaaccattattttacaagggttcattgttcatcctttattctgccagccattcaacaagtatttaatgaataccttctacattctagtaaatgctgggaacatgtccatgaacattaaacaaacgcacaaataattacttaataaacagttaaatatacaaaagaaagtacagaatgttttgaaaattatgaaaattcttcccatagcactatctttatttccctatcaccatagttgccaaagtgcccccacctgacattcttttaggtttgccagatgaccaagccctacattcccacagctatgtcagcaacatactcaagatcatcctttagacattgcattcccctcccctcccctcccatcctctcccctcctctcccctcttctcccctcctctcctctcctctcctcctctctttcttgagacagggtcttgctctgtcacccaggctgcagtacagtgattcaatcctggctcactccaacttctgcctcctgggctcagatccttccacctcagcctcctgagtagctgggatcacagttgcatgccacagtgcctggctaatttttttttctcttttgtagagatggggtttcaccatgttgcccagctggtctagatctcctaggctcaagcaattcaccctcctcggcctcttaaagtgctgggattacaggcatcagccactacttctggcctgtgtttttcttttttaaagataagacctaaagaggattttgactattttgaaaatatattcatatctgtgtatttttggttattcacttccaggtcctaaagttgcaattaaggagaaaaaaatcattgattattcttagtagttttgatgaggtaatgcaaggtttttctgtagcaaagtcagcatgcgtcgtgaatatggttaagctatgtatgattaaaggattatttatgttttatttataagtatttgctatcaataacagctcccaaaagtaagattcaccagtattactacagcatatgggacttttgctgtagattaataatgccatgatattttctttaatgaaggtggaaatgattgctttattttaacaaagggacctctatggtccccctgagtttgagccttgaatgtagacgatcagggatgctatatcacagctgtctccctgctgataatgactctccttggggtttcataatttctgcctgaaatcctttggtttcctctcaggaggcatggagtgaatttatagggagattcttcaatccagacacaaaaaaaggttttaaaattttttgtgtgtctccatatttgactttctgtctcccattctcatttcctttactttcatgtgtgtgttttcttcttactgtgccaaacacataataaatgctcagtatttgagattaatagatataatcattattattttgtgttattctttctactcctcccttataaaaaaagggattcctcccttcatcatgcttcccatgccttcatatacttcttattggtttgcagaacaggcatagttatgatggagaaagtaaagaataatgattaaaaagaataataacaaaccacataactaactgtttgggtttaaatgacagaactctcaaatccatcttcctaattaaaacagcatgctcagggatagagcacatagtaaggcttttagcttaaatggggatgtgctatcagtgctttgatatcaagtttaatgtccttaagattagctgtatgtgccttgggagagtgagatcaagggtaagatagtctggagacagatggaagcaagattcttgggcagttgaatccttctcaaactcattcttggtgagtactgtcactttctaggtgtgccttaggcaagttatttaactgcttcgtgccccagagagtggtgggggaatcaagggtaggacacatgtgagtcactcagaacagtgcctagtctttagtgaatggaacttcgggtgttcattattgttgatattgcaggtgtaaagaatttgattcacacactcctatcatggattggagggaagttgaatattggttcatatcttgttttaggttctggtttacttgctgcctgaactaggaatataattcgggatttgcagctagtaagttgaaattaagaagaactcaggcctttagattaatcaagtacatatacagtattgaaattatgtctttttatcagtatctttccagaggcccagttaggggagctcctggcatgtgcccggcatgtaaggagtgtccacaagtgtttgcagacctgcactgaacactatttctcttttgatatgatgcagtttaacatactcaaaagagttgagccttatcccctttgctcctcaaaaccaaacacagccagttttggattaacttttattcagtcatgttttatgctgtagggtccaacctaaattttctaggacgcagcccaactaactgaattctttatgtcacttgaaggataacgtcactacagttaattttgataataacatggtttgaaggattcctaactgcttgcaatttatgtaatattctcagtgctctgtgaatttgtagtctgatgaaaacactgaaaagggaggtaatgtttactatttctgattattattctgtatccctcatgcagacctaacctcaagcatttgcagccacccaatgactttttttgaaggaatttttactagtgggttcatctggggcagatgaaaatgtttgcattttagacactccaaatacagatataaaaactttatgtctcctcctccagctctaccttcaactttcttttcactttctttcctactaagagcacatatttccaggctcattcttcatccctaaactctgtccctctccttactcctttgttccgtcttttgtcctctccctggaatttctggtcatttgcattaactacacttataagtcaaactttctttgttcctttgtgggtgtactcagaacatcattacattcaagtaaattcatgtgttttttttctttttttgcccttttatttaaaagcactcctactggccattagaatagttaccagaaatctcctttggtctatggataagaaattctgcagaacttttcaaccaagtaattagatcatattatgtctaaactggtgcctttttctcaactgaatccaagtaggagtatagactgttaacaccttcaactgagtaaactgcaatctttgcaaagtgaattaatatatgaatgcttgctaaggcaagataacacatttttcaattaacaaagtaacaggagctcagggtagcatgtgatatatatatatattctgctacatacatatgcaggtatatttttcaatcaacaaaacaggagctcagggtagcagactacagatatacatgtgtgtatatgtgtatatatatatgtagcatactacatatgtatacatgtgcacatgtacatatttatctgtgtatatgtatacattatgtatatacatatataggtatatgtatacatatatgcatatgtaggtatatgtatacatatacatatataggaatcctatatatgtagtctgctacacatatatattcacatatatatacatgtatatatgtagtctgttgtcctgagctcctgttgtttgtcaattgaaaaatgtgttaccctgtcttagcaagtgtgtgtgtgtgtgtgtgtctatatatatatatatatatatatatatcctcaaaattttacctagagtaaaaaaatgaaatgcctacattacataaagacccatatgacaatattaattctgtgagctgagacatattcatgccaattctccataccttctcccccattgcccattctccagccctttgttgttcactggtcctaactctgctttcttactacaatggcccacttactgcatccttagtttttgacattttgaaatcacaaggttctcatattaagcatggacattttctttacttttttattaattacaaccacagaacttctctcgtcccactccttcttgttttgtctttgggtaaaaggaataaattatatatttatcataaattttaactctacaaaatggccatatttatactttcttcagatttctctcagttctagttaaggtttttttttggcttccatttgccccttatttgattattatactccaagtggctgaagaaaaaatacattcaatataatctgtctgtaattttcatgtcttcctcattaccgtaaaatataatgcttatttgagacacacacacacgcacacacacacgtgcatactcttggcctagatcaaccacacagattcatttattttaccttctcattaattagaccctcaagcctcttaatgttgttttaacactaatttgttgagttctttctggcaccaaactaccccaaactccatgaagaactgaatcatcaatgtattatttataggggcttctttcgtgtgttcgtttaaaatgtagttatctaattaatttattaatttatattgtcaataactattcccagaaggttttttttttttcagatctactagagaacttaaagctttttcttttccaggaatggccaaaatatccagaaggacaatatcaagtaataattaaagttataagctcttggtttgaattcttgctccactagttatgtgaccttgagcaaattacttaacttctctgtgccttacttttgccatttgtgaagtggaaactaaatagcctttatgtcccagtaacaatgcaaagtttattcattgccgattagaaggggcacactgttcaagatgctcattaattcattcactcattttatgtaatgactcatttatcaatcctttgttgagtctcaaccactgtcctaggtaatgctgatacaatcttatgttttgaagctcgccacaaaatttgatcaccactagagccaagatttaacacattatttcatttaatagctattttgagtcttcagggtacaatttacagttttgggggggaagatgtagggaaatatgactcgtcagactcaattaagtgcatttactcagggctacccatctattaagtggcatggttctctaaccccatagttcattctctttttctgtgcaccactagtaggttttgcataaggtaattttgtccaagtggttactgtgtgggtcctgttcacaatcttgatcatgattgtattccaacttctatgtcagagtttgcaagcatgtggcttataaactcaagatggctggtacaatgttgttcaatatttaatggaggggtattaccaagatctagttttctaggttttcttgagaaattagaaaatctggcaacactaagtttgtaataataccagggacaactagccaaactgccctattttgttgaatcatgtgctgtctaagtcctcacagtccttgccacccccaaccctgcaatcatcctacatgtagtgtttctatttatcattgtatttttgcttttatatctcttacatcttgtcacattgtatagcctgtctagcatttgaatttttgactcctgttttaagctagagatatgcttgtcactgaacacgacttgaataaggaaatgagtaataattatgactctacatgccctttatagtacacaaagaactttttaaacaaccatgttatactgctactttgattttacagtagtttgctccaaatgagtcaaatggtatgtagtagagtcataattagaatccagaacaattggtgtaagtctagtgcttttctcatttatctgtcattcattcatttattgacatatttattcaacaagtaaacaattataagtaaatgtcaaatatattctagaccgtatagtggatgctagagatatagatgtgactaagatacagtcccaggctttaagaagctcatagtctatttaggaatgacagataaacggatttttctgagtgcattgtgatgtgaactgagaaatacacagggtatgtacaaggtgccatgttaacatcaaatggcatgtgattgattttatctgtgactcagacatacctctgccactgtagggagtagtataattgacatgggatcctggccagtctccttatggtgatggtggttaatctacatgtccctgagtatcatggtctttacagaagcaggagagtgaaatgtaaaaagtgctggaatggaaatcagggcaccaagtatatatggtcctggctctgacatttgcttgctccttgacgttagaaaaatcgttgaatttatgtgtgcctaaatatcttcaccaaaaaataaggaggcataagaggggagataccagatcttacaaaataagtaggttttatttacaaatacttatggattagtgggggccctttcactaggctacaaagaatttgaggctctatctatgcttagttttaaagaatgctatggtcaaagaagctatgtttgtcataggcactagaggaagggatagaaagattctgagatctaggggcaaaagggattttgagagtgcaagtgaattaaaaagctaggatcagctggctcagtggctcacgcctgtaatcccagcactttgggaggctgaggtgggtggatcatttgagttcaggagtttgagaccagcctggccaacatgatgaaaccccatctactaaaaaaaaaatacaaaaaagtagccaggggtggtgacctgtaatcccaatcccagctactagggaggctaaggcaatagaatcgcttgaacccaggtggcggaggttgtaatgagccgagatcacaccactgcactccagcctgggtgacagagcaagactctgtctcaaaaaaaaaaaaaaaaaaaaaaaaaggctgagatcaagtttctgctgcaaggacattttcattagttaaaataagaaggggctaataccaataaaatgcatagcaagttgactattcaaaccaaaaggcctccagttgaagttgtgttttaatttaagcactagtagggcccagcaaatcaaatattgaaagatgctaaaattagtctgattactttgtgagtcatcaaattgatttgactgtccttgcccttcatataatgtcccaatagacacttaacctgactctacttccttgaatttggcaaagtaagcacgatcattggagttactgcttttgggattatttatttatcacatcacctctgccatcattacttcccactcgtctttgtttggcttactttctactgtgcttctctctatcaaatctttgcacctccttaggaagatctggaagtcacctctctgtaaatctgagaagttattttcattgttgttggatgataatgcttaagccagtgttggaggctgcacaagtaaattacatggttttagaagcacctcctccttccatctgtgctgtttggttgtattctttattggatctgggatgatatgacttctttgcctggggctgttgctgccattacgcagttttggattcactgttgcttcataccaatgttggtgctgtaaatgtacatgataagagttccacagtgagatggactacaagacttctggacccagagccccctaaaactagatccaagaccagattatgcactgctactgaggttggcctgctatggtacagactgctcctccttccccaaggatacaggcacttttacatagagggtacaacagatcttgacctgcaggtgttcaaaaatcgactcataacttccctcctcttatatctatcttatcagtaaacaaatattaataagtcataggaatgaaacatgcgactctttttggttttgttggagtgatcatgccagaactgggactttctaatcttgaattcaaatcatgagagttaagcctgtcatgaactgtgagtgcaagctgacccaggaaccatgtggttctcaaaaaaaaaaaaaaaaaaaaaagcttatggctctttttgtgccacaatggcagaattgagtcattgctacaggcagtgcatggcctgcaaaacctgtgatattattctctgctctgatattaacatagctggaatgtgccccaaatgtatttcaatcaagagctttcatgtattttttgaaataacctggataagaaaatccagattttagactcaccattctgcgggggagtgggggcggcagggggtcattgatcctgtttgttttctctcttgcatgctgtccttggagatcagaggattgatgtttgagtaagaaatgcagaataggaccatatgttaggcagggttatagacagtaaagcaggtcagcatcctataacttgatgactcaatcatcctaacattatgccatctgggcgctgatactgttcagctctcccttttcttatgaaaagtttgactcaggtcaaatagggtgtctttttttgtttccttagaattttgttttctcttccttttagggattagttcttttagtcccacctttgagataaattttataatttcaaattttgaattctgatctaaaccctcaactgttctttctcccacagtaaagaagttaaagcaatcgtagcaaaaaatgtagagagtatttctttccccatccccaactttactgagatataattgacgaataatatcatatgtattcagggagtacaacataatgtttgatgtatatatacattgtaaaatgattaccacaatcaagctaattaacatatccatcacctcacatagctaccgtgtgtgtgtgtttgtgtgtgttaagaatatttcaggttcactcttagcacattttaagtatacaatacattatcattaactgtagtctccatactctatattaggtctccagaatgtattcatcttataacctaagtttgtactatttgacccacacctccccatttcccctatttcctgacccctggtaaccacacttctactctctgtttctatacattcaacttttttagattcaatatataagtgagatcatgcagtatttgtatttctgtttctagattattttactctgcataatgtcctctaggtttatccatgtttttgcaaatatcagaatacccttctttgtcacaggatgaataatatttctatatatatgtgtgtttatacatgcatacatatctctctcacacattttctttgtccattcatctgcacggacactcaggttgatataatgtcttggcttttgtgaataatgctgcaatgaatgtaagagtgcagatatctattcaaggtactgatttcacattttttggatacataattggtcctccatatccatggattttacatttatgaattcaaccaactgtggatcaaaaatatttgaaaaaaatgtgtctgtactaaacatgtacagtttttttcttgtcattattccctaaacgatacagtgtaacaactatttacttagcatttacattgtattaggaacttaagtatcttaaagatgatttaaagtatatggaaagatatgcttaggttttatgcaaatctgatgtcatttcatgggagggtcttgaacatctgaagatttttgtgtctgtgggaggtcctgaaaccaacccctgtggatactgaaggataactgttactcaaaagagggattgctggatcatataaagttattttcttaatgcattcatgtatgcactagtgtgtgtatgcctctatacacccatgcctgtcactctatgacctgttgtcatatctgtacattcatgtaacaatcgccatgtttaagaaatgtagcattgagcctatgtcttaactgatgtatcctgtttcaatctatcttgaagtggccaatcaccctatccccaaagatactgctactcaaagcatggtccctgaaccatctaggaacttattacaaatgcagaaccagagaactcatgcctgatatactgaattggaatctgcatttaacagatttcttggtgactcatatacatgttaaaggttgtgaacactgttctaagaaatgtcttcacttcttattcctttggcttgcagtgattaattgggtagaggaggcagcatatcagaatcattatgaagcttaaaataaagtgtgcctgggttttagacccaagattaaatctgaagcgaaaccaaatgtctgtattttttaatgattccaaaggcaatcctgatgtacccaacacagggcaagggtatatattgcaaggagtcacagaatctttttattcttttcttttaaacctcctggcaaccttctcttttgctgcctggtcaacaaagattatctaatgtggttgatcagcttttcactgtcccgttcattcttatgacaatttgccctaactatgcacaaactgagaactctttttaagggtaaataaatgttctcattcatcctcacaattgatttaaaatattgtaacattttctaaatatgtacaaacagaaagctatctcatagttcttgtatgaccagaaagttattgaaattttacaaatcaaatgcaaacaataccatgtaaatgaagaacattaacgtggcagatgacattttcctgagaataaagctctacttgcaacataaatacaacacaattgctatattttaggttctttagaatttggcacattttactgctgtatgccttgtgatttctcagttctgttattatttgtctctgtttgaacccatgcaaaaccttcatccacacagcttagactgtcattcagccctctctttctgcaaataaatctaatatatgtctatagtcagcccacttttcttctatgcagatttcattaatgaaagtagtaattcttgtcagtgtgattgcaagcacaaactcaaagataacattacatggcagtccttggttggcaattgaatggtcagtattcagttgaaaggtcatcaaccagaaatatggttagccattttttagaagaaaacaaattagaaaaaagtatggataacaactttggacaccaaagaatatttctataatatttcctgctcagtctgtagtggaaggcagtagagaatagaacttacaaacatagccttggagtgagaaagatctggaaactatttatgatagttctacttactagatgcatctcttggaacaagattcttcgcttctctgtaacttggtttcctcgtgtgtatgatggagatgattattatctatttcataggccaggaataggtatgatatgcaagaagcacctgtggccctatcttagcacatcataaggactaagttatcaggagctattttaactattataatgatgttatcattgttgcatctttattataaatgtgaacattaagtttttattaattaaacctgccacatatttcttccatttgcttcattgtactcttaagatgtttattcatttttctcacttcttgctttaagaacctggttattacagaggtgaaaaatcccatcaaaatgctagagaatttggcacaattattgcttatatttctcctattgctgcttttactgctgtagctgcctcctgaactgctgctgctgctaccatggcttctagatgcttctttgacaatttatttattttccagtggaacccatctgtgaagaagcccttcatagcagtaatatcctggggctgggcactactacaataatgatgctttcgttaatcaccccatgtaattttagtttttgctgataaatactacaataaatcgattgaaactgatgaaaatagctcaaaatttagagacatacagtatttcattttaccatcagcgtatttctatgtttatgcaatagggattgaaaaagttcaatccccatgctcaaaaacacatacttccagctctctgagatgatatgccagacagggcttttgattagaagccttatttttttgcctagttctagcttctgtatgagtggagactttattaacaaaggtaggtttggagcactcaacagaagcgtagagaatatatggaaaaaaaaaaagaagaagaaaaaagataaaagggaaccaaacaaaacaggtttacaactgttttactaataagagggaaaagtctgctcatgagttaaaccaagactaaagataaagaaagaaagaacatccaaaaccttcatgtgctttgtatttgtacatttctgacatatgcatgaagcatgagggaaatacagtaatacactgaggtatgctgccaacatcctgactattcctagtcattagatagcctagtgatgtttttcagttagaggggtgctgaccttactgttttcagtaattataagtctataattaccttttatattctttaagtgtatttttgtaatttcaggttaggtatacaagagtggaaaccgtgtttgatctgacgttttggctcttgtatgaggcagctttaaatagctgtcagatttggtttcattttagtgaagggttaagtaattttaaggcgttaaaaccatgggcaataaataaccatccacagtcatcgaaggaagttgcttcttagacaagagaatgaagctagagctgctagggacattagtctgataaaaagtcacatcagagaaggtttacctccaaatgattttggtggcaaagaagcctgtgcatcaacacctgcccttgagcacagcagtcaataaaaataaggtaacacaaagcagctctcttgaaaacaaaatcagagcctatactcttaagaagttcatagccgtcacaaaaggaccctcgtggcagtagaagctaaatggccaagaatgctggaaatggggctgcaagtcataaatggagaaagtctaaactaagagggtaaacagcaggtgacagtaaattggagcacttggccaggcaagccctgcatctgccacagtgagatcagttactggagagtcatcccaggcctatttcacactgccgtctgggaatgtgggactctaggttcttaagtgttaactatgggcaaaaaagaaacaagaagtataaagtcattgagaagattgtctgcagtagggcaggcatggatgaaaatcgaactctactttgtctgtgggtgaattatttaccttctatctgtcctgggtctgtaaaacagttataagaatagacagggttaatttgtgaaacttagatgaatatgaagtatgagtaaagtaccagacatttagaaatgctcatcaacatcttgaaagaagttctttcattgagataaaaagggtctttgtatctctttctgtaattcttctgaaaacagatggtcagggtagagagctggtgcaatagctcaaatggtaaatgacagacataagattcaaaagaagctcaataggaagaatgatcctaagacaaaatggatgaattgcaatagggttacataaaccatttccttaggtttagaaaagtcgttattccatttctaggtaggagagattccactgaaataatgtttctgtgctaaaaatgcaaaagccaatttataacttttaaaattataaattgaataagtgcaaagagtgtgatatggctgctagatattggtagaaaaccatccttctcatttgtgcccttattagatgtcatcaagagtcttgtgtgcctcctgctgccacatttaaagaggggagagagagagagaaagggaggggagagaaggatgaaagagagagagaaagacagaaagtgaggcatgtccagtatggtgaaatcagctgtaatcaattccagctcaaccactatgagtccttggacaagttacctcattgacaaaatgaggatggaagctccctccctggcttgacctaaggattggattacataatgcaagtaaacaactctgcacagtacctggctcataactgggagctctgattattcacaggaaagagtggtgagagacagctatgagataaggagctgcagaagctctcggtgatctgccaatataagagaagcttaaggcaggacatgacaactgtcatcaattatttagatacctgttatgtagagaagcaattctcattaatcagcctaactctaaaggaaagaaccaggaccagtagatagaagttatgggaagagatattttggctccataacagaagtaatgaaagcagtagtggtgtagtagtaggaactgagaatgcaaatagctcttggagtgttccagttcctgttctaaggactctgcattcttatttgatcctcagaacatctatgtgaggtaggtataattattattattttcattttacagatgaagaaactgaggtacacagtgaagtaaatttccaagaacatgtaaaatagaaatgaatgacagagctggaatttgagcccaggcattctgtctcttaacccatttatgctggaggttgtgattttttaaactgatgtatgacagaaaaatcagaccttggcaaatatcttgagcagtaggctataaataactcccacatgcttagtgttccaataatggaacactaggcataagtggctacacacattatctcaactgccccaaaaagtagctcaaatacacagggaaaggctgagtgactgtacaccatggttgctagtaaggggattcctgcactgagttaggaattggcctggataatctctacggtccctcccatgacatgtctgtcattttataaaaccaaaaagcaagcaaaaaacacatggtggcaaaagctaatacaaaacctagagtcaaacattcatgaggttttctcaatgcaaaagaagcctaaaatattcacctgtaatctatttatatcaaccttatactcagttataaaaggatggccatcttattgtcttgttcaaggcagagcagaagaaatacatttgaatctgggagtggtagtagaactaatagcagcaaggagagactcatgaatctttaggagaaaaaggaggtgttaacgcactgaacaaatattaactgagtgcctcttctgggctgagataagaaaatcattgtgaaaccaaataagaacaagcattgcaggccccagatatttagagactccagtgacgtttgggcttttcctgaactttagtgtgcaatgtcattttaaaaagtattttaggggaaatgataaattatagccagtttcataaaagaggtatacattatatttttaaaagactttatatgaactgaatcatttgactttaagtttgggtgtaaaaagggtatacttcaatttctctcaggccagcttgctccccagtaaatgacaaatatgggtctcgccgcactaagatattttaatatacttcagtgggaaaggctctgatccagaaatttgcagttgtgctattgataaaatttatgagaaactttcttctgtgggcctcagttttcacatctattaaatgtgctgatttaactaaactatctttatttcctttaggctcagacatttcctatttcttttatttctataactgtacttattttcattatgtagataccagatggcaaaatgtcctggtagtgtgtgcaggactcaaactgattctgggaaaatggggcacaagtgaattctaaggtataaggagctgaagtgagcagaagcctctagaatctatttctatttctgtcagctacagaatgtaggcccagtttaatattaggagacgttgtctagcttttaatattaggtttcagagttgcctaacaaaacccatagaggttgtttcttgcttagagtaatttaatgttataaggatcaggcaggtgcaacatggcataaaagtattacttgccccaatgccacctttaatttctctcaatctttcaaagcatcaaaagaaaaaaaagttctctctttgtctattgtttataaatataatttattctctgtgcttaggtgattttcatagataagaggacattcattgtattcagtaaaacttctagagcagtccttacactagtaacaagtttcctgggcaatactgctttgttatcagacttcaccatgtagatctcacatccttctcttttctgatcttgctcttatcatttcaaagttacatgtagagtgaggatgcaggtttcatagggtttttgtttttatctgagacagagtcttgctttgtcacccaggctggaatgcagtagtgtgagcatggctcactgtagcctcgacattctgggctcaagtgatctcctgcctcagcctcccaagtagctgggaccacagatacatgccaccacccccagcaattttttttttgtcttttttgtagagatggaggtctcaccatgttgcctaggctgggcttgaactcctgggctcaagcattcctccctcctcagcctcccaaagtgtaggattacaggcatgagccaccaggcccagcccatggtgttttctgacaaagctactccattcatttgctgtttgaagttgattagtgaaccacattttgatgttcactaccttcatttgcttttatattcaactgcattctttaagaatcttccctcagcagttagaaggccaaagataatttaaatgggattgagggatatttccctctcacattagtgctgtagagccacataagaaggtattctatggtagaaatagatttagaaaggtcaaatttgaaaaataaagtaagtccagacccgagtgataagatggatggctgtctagattgagcatgcaattctaatacttcagttccacattcttttttttttttttttttttgagacggaatcttgctctgtcacccaggctggaatgcagtggcacaatctcggctcactgcaacctccgcctcccaggttcaagcaattctcctgcctcagcctcccgagtagctgggactacaggcgccctccaccatgcccggctaatttttgtatttttagtagagacggggtttcaccatattggccaggctggtctcgaactcctgatcttgtgatccacccgccttggcctctcaaagtgctgggattacaggcatgggtcaccgcgcccggcctagtcacacattcttaaagatgtttcagcttttgatttttaaacagaatggtatggagaagggcttttgctggaggtgcttcagtcagttagcttcaactctgaatgaacaccgaagatgtcttggctttcctaaagactcaggctacagattcttgctcatggccaggggtaaaatgcccttcatccaatttaatgctctcccatgtgtagcaaacatatcaactactctgggttggcatatgggggttttagtaaaactgtgtaaagaatttgccatagaaataggaatagtctttcactttccattttgtactctgggtcttctctgattatatatctcttttggttttcctttccaagctccatctttatcccaacctattgggtatacatctgatcactgctttgctaacacgataatacttgagactaattaacaataccttagtgatactgcattctcaaataggaaaatttcaaatgactagaagaagactagttgatgcctaggaccagtactagaatggttaagttactggttggaaacttcagtgtgcttgtttctgcaggaggagaactgctttaatgtgaattgcattagaaagctcccctccacttttccttccccagtgtttgtctactgaatagcagggtgaaagcgtcggttgctctcatcgcctcacaatcaggccaattgggcataactgctttctggtagaattcatctcataataaattgcattcatggaagatgcctagtatgtggtaaacatggcatggacaggccaatactagagaaagatagaacactggctcagaggagacacaaacaaattgcctttctgctggctctgaaatattctttttcagtgtagttaaatataaagttgaaatgatgctaactacaccttgatccaaacaacctcttcattgcttggcttctgatgggaatgctgtaggtagccatttgttttaatgattgatttcactaatactgagtcacaattgcactcctcttgaagttgacataagatctccatgcacagaaaatgaattcattagaatcaaagtgattgtataagaaactcaaattatccaggtgttgaaatgcatgtctactttcttttcagacaatggaatcatttataaaacatatagttatttaaaacacagacacacatacagagactatcatatgggattgtgagagattgctaattaacacatacaaattaagacaaatattcattaaaacaaatattaattcctcaaagtttaattcttaacaaatattaattctacaaagagctaaaaggctctatgtaggtagataacggcattcagatttacctcctaatctttacagtaattggttttaagggttggagaaagaagtaaaggaggtaaaagaatgtacatagacaataataattatgaataacatttactaagcatctactatgtgttaggtactttgctaaccaagcttagcatttcacatatattatttaaaattcacattaactacctgaattacattcaattattttactcttcagggagatttgtataagttgtgtaaggtctaaaactgttaacaggaaagctgggagttgaactcaagtttctctagttcctgagccaagatcttagttgctaagttattaccacattctcagagcctctgaagcaataccactgaattcagggcttatgtttattctagcagcatctttctttacaaaggggtatgtaaaaatagtagtccttctaatttctcctccctccccccaatatttctgggattatgcaggcgatactttgcttttggaaagaatgaaatataggcaattgacagaggcagggtcctgactttcttttttaattttttttccttgatgatgagcataatcatgtgaataattaagcttcaagagctaaatgactgattggcagcaagctgactaactgttctttatttataaggatatagctttcatgggaaaatgtagggtggttggtaaaacatcagaagtctcccttgagatttcataaatgccatagcttaggggttaaactcacagacatttaagtcacatgttcttgagttcaagtccaagttgctggccctttgggacttttaactcccctatgatcgattgctataaattaaaactcagttaatagaatataatgtaagtagttatatatcggaaccaatgatagtacctacttcttagggttgtcaagagcatccagagagctaagttatacaaaggactagctcgatcactggcatgggataaatatttgataaatgtggtttgtaatattttataaaagtgacaaaaattcttatttatgtaccttttttactatgaggagaatcaggttggattcttagaaaaccttcagtgcctctgtcacagccttgcaaagactacttgggatatgtttatgttgataatttctccccttttatttttctatcagtcagatttataataagaatcagctgttctttctaaaagactattgtgcctttatattattttctttaattttcaataatcctatgaattagcaattattatcctcatttttacaaatgaggaaactagagatccgaaaagtaaacagcctcccagctaataaacagatgagctgcaataccaaccgaggtcttctgtctctcacaatccagttctaatattaaaacaaaaggctttgagaccatatgacccaaggtgcaatctgtttttcagatcagaagattgggactctaagatagaaacacggtctgtccagagtcacatagcaagttggagacagaatggacactagaccctaggcctctatttctggtctagagctctttcatcatttccaggctacttgtttgtttgcagcaatttgtatgttctgtagaggaagattgaaaagagaaatggatagaaagagagagcagagatgaggggatgagagtctggagagaaggggagagagagagagagagagagaaatagattcatatatgaaggttagatcaagggccagcatccaagggtggtctaggtagagtactgggaaccaatctcaacctggcaggagaggcataattaaccagtgtctacatctgtgatattatttgtccttgctccaaaatgacaatagtgattacagtagatgcagctgacagtagcagatgacacaacctcctttcacctcctggccagctgcagcgctaccatcaccagctatagcagctttctccctggagattcagctttttctccactgatggaaggctttccctccatcactccaatgtcagagcttggccgatttggttcctcaggagactgtagagaaattcactcccattgaagcattttcttgacattttgacattcaatcagagaaaggcaaaaggcaggctaagggcccaatcatcaggtccatgaagatcaagctatgttttctgagtacctattgatagaatgtgcaggagattattactgtttgccaaagctctattgatcttggctttgtgaagctcaaagtctgtttacagccacctataaaaaccaacagccacttcttttactgaaggttaacgtgctgtgtttatttaattgaatggaaatggccttgtgttttccaaatgtcattgttaataaattttcaagggaatctgtgactagtgtgtaggtgttgaggatgggagaagggactgtcatggggagggacggctgttggaatttgaagttgctggaagcaagagataaaagacaaacacatagatacgacattggaataatttccctgtatagaagtgctataaaatatccttactctatattagtgttgttttttaaacttgtcagtaagaattctcccctgggtgttttattctttagcctgcgtctgtttttgtttgttcttttgggtttccaaaaaatatatattttaaagtgacattgagcattttagtataattgtgagttttggggttgaatatttttcactattatttgatcagttttttccttctgtaagagatttaacagaaatggctaaaattaggagccatattagatagaggaagatattggcaatcctattgacctgctttttaagaggcgtgtttcaactaacaggaggagagatgcaaagagctttcaccaaagcaatcagaagacctgtaaacagcctcagggaactgtaaaagtctgtgagggtctctagtgtaccagatgaaaagcagaaactttaggtagccgtctgaatgtgtcaaatgggaatatcagaataactcactaaatttcctttttcaactttcctcgcaaggtttgtctttttatgtggtaaatgttggtgagttccatttttaagttttactcttcccattctacttcagtctccttagcaaacacacacacaaacacacacacacacaaacacacacaacacacacaaaattgttcttcttgaaagatacatgtaaatgaatggtgagtaaaaaattaaagtctggacgcagtggctcacgcctgtaatcccagcactttgggaggccaaggtgggtgactcacttcaggtcgggtcactcacttgagaccaggagttcgagaccagcctggccaacatggtgaaaccccatctctactaaaaatacaaaaattggtcgggagtggtggcatgtgcctgtaatcccggctactcaggaggctgaggcaggagaattgcttgaaccctggagttggaggttgaagagagctgagatcgcaccactgcactccagcctggcgacagagcgagactccatctcaaaaaaaaaaaaaaaaattaaaaacttattgtctcaaagcagccattcatttattcaaggaattgctaaacttttctaagggaccaggcactggcctgagtgctacatcgagagagagtaataagatcgaggatcccattcccacgttctgcacgtgtgtgtgtgcgtgtgtgtgtgtgtttcgatctgtgtgtgttggtgggtgaatggctatgcaaatacataacaatttaataagtcttatgatactgggagtacctgactctgattagggggcactgctttaatatctggcaatggaggatatatccatcttcattcgctccttcatgcccccatctaaccttgattaaagtctgatttcaaatagcccatttgttgaacattttatcaaggtttttcaggagcctgacagaaaatgtaaagtcgtcgtatgttttgttttgggaaatactacttctaaaacttatttgagtgtctcagctttttctttcttttattttattttttaattaaaaaaataatattatcttttatttgtctttaagagacagaaccatgtctgcctagtaccttcacttggtcaaatacctcttttggtggaaacaacacaaattatgtaggttgtatatacaggatgaactcggtttaaagataagacatgaaattcagtggaaatattctttaaattctaaacagagaaatcaaaacaaaggtatattcatactgcatgtgggtataagttttttcttacatatattatatatacatatataagtgtaacacttttaagaattttattgaccatctaaatatatagcaaaatcagctgggggtacaagagtgtaactacttccttttttcctaagttgtggaaaatgtgagaaatgagaagtaagcaagacggaggattagaatcacaaggtaggtttccctagtatgaattcagtacctgaaaatcttcttagttctgagtttgaagcagattctataaaatcctgtattaaaataaatacagtaggaattagcaaggatgggggaataggagtgggcagatatgttcttgaagagaataaatgcagaacattattctttgtcaattaatttttactttttatagattgttagactatttaacaaattcttatgagaaaagtgtgtttttaagtgatctctgggaagatgttcctgataataaattaaattaggactgtgcattgcggagcccccaccagttgtactccctctggtgaatttaataccagacgcaacctagttagaggtgacatgaaatcacagaatttgataatcttttttttcaaagttaagcaaatatagatgagctcttcttgtatatgtaagatgccagatggtgtttttgagaaatcgattcgtgtatagtaccagtccagacaaatgggtccaatccttctatagataaggcgacccacttttcctattcaaccatagggctccgttgtctggcacacattatttaacaaagtgacattgtggagtcatcagtaagaatgtggcttctggagtgaatttctttttgagtttgaatcctttgctgggtgatcctggccaaatttcttaacctgtttgaacattagtttcctcgtctctaaaatgtgagtaacaagagtttctcgtaggaactatgtaaaggtaaaaagaaactgtctagcatagtgcctggcacataatataatttcataaagtgtaactcttgttattaaactggatagctcaatagatattgctccagaaacactagtgcatgaggctgccattacgatcgccaaatgatagcagctgtgaactgccactccaagccctttgcagatgcatgtacttcttcgcaagggcttctagtcattgacttacccagatctatcgtcacctcttgaagaaacaaccagaaaacactttccctacttacagtgaaataagtgagtatccttctacagaaggacagttagttcttgaaccaagggacttcaatgccatatgagaaaaattgtcttgtatacaatatctttggagagtgaaagagttttaagcatcttgatattagaaattaaggctacaatgcattcaggttgcctataagttattcatttctgtatcttgttgtcaggaaaaaaaaaaagaatacttcaaaattaagttttttccatctaggatctcagatctcattgtataattttcatcattcaactggatttaataggtctatcagtatgtacagtaaattattttcaaaattcttcacctaatagctaaaaagtaagccctaatctggttttctgtgaaattgtcctcgacagaataaatagttcaggtgtctgaaaagaaaaattccatattcctatatctgggttgacacttaagactgcgtttgtgaagcctccttatatcttgaagacaggatgtatctatcttgctggtgagaattttgctgttctggagtctatatcaggtacctcaaacgtgatgagtgatagaggtcatgttttgttgtatcacagtttgttgaatctccctccttagagattcatttgactgaaaaattaacaggtttatttgtgcaaatggtagttgcacacccaattattgcttctgggtttcccatgtgactagccaagactcaaggtgaaagtttggcctgcagctttggcaaacaaaggagaagctaatgaatcataaaggtcacatcttcttgaattttcttctctttcttcactgttctgattacttttaaaaaatctctattccttatatattctgagtacaaaaactcattagcaagatttggttctgttgtctggagaattttctgctcactgcaataggaaggtgatccaggtaccacataactgtctccatgaagatgtttgcaatatgttatgagttttttaaagttattgtttgagaaaaggccatataaggagataatttttgcttattactaattagcttacccctcttctgctgttcttacatttatgactatttacttgtaaataaaagttattgatctttttagaagtccattggattctgctgcttttatttttgagaatcattttaacttacaaacacatattaccttttccaaaaagtgaccacatagctttgtgactcctccctcatatattttgagcacacagaaattaccatcctctcactgagtactatacatcggggcctctggctcttacctcctttctcagatccaggactgaatgcatagctgaaaagatgactttagtctttattcacaacctgtaaactaaagaaggtcattaaaaaaaattcttcgtatcttgcaaacaaaagaactgagatacctatctaagaatggcaagtctgagaagcaaatacctggctctagccctctgccataagtttgcaagcttgtgtagacctttgtctgagaattggttaggtatagaaatacacttcagcagagacttgacctatatgactttcaaatttgttatgattctacaattagtgtttgctaaaatcaaaactgtagaatatagtatagagagtatattaattgttggctctatgctgacccaaaatgaagtcttttaagagattagagtactacactgtctacatttaaccaggtgtcatataacaattaatgaaaattcaatgttttatacttagaatttttaagtaataacagatgatggatcaagattaaaactgtattgacagcctaagcaaagaaataaaatctaacaaaagaagctttaaaagaaatgaatgtaaaatcctatattttgattaaataaatcaagtttgcaagtaccaggtataggagttttggactgacagaactttacactaaacaagatgtaaaagttttagttgtacataaatttaaaatgaacctgccttactgtttcttttaaaaaaattaagaaaaaaaaactctacgcagtattaagttctattaatagacttctaatttattactaaattatgttgactcttcatctgaaatgtatctatctttttactccattaatttctcttcagtgatctagtcacagaccttattatcctttacatgacagtagcttaataatggtatccttgcttttctccctactacagtctgtcctctgcatgtagccaatgttatacttgatgacttaaatctgatcatatcattcccaagtaaataagccaacaatggtcctcaataattaccgaattaattattccctgagaaatggggcccctcagtgtaatatctcatctcaatcattttttttagttttgcagatagcacctgccatttctaaatatgtgtctttaattcatcttaaccacttcggattatgacatcctaaaattgccatatatttttatatttccatacttttgctcaggatcttctttggttaaaataatctttcctacttcacctttgaccaaccactgccagtgatccatgagattcaaatgtcttctcatttggaaggactgcctgataacctgctacctcagcttcaggagaaaccagttgctggcctctgtgctgttctcctacctctaaacagaatgtaaagtactattattttctcttcaattgacaaggcgcttctatgattgttcccatcttctgttggtattatttttaataaaaagatctcatatattgtgttaaagtactaaccttgagaagacccccagtctgaaagaagaatatttcacttctcccttccccattttcaatcacacatattattgaataattttggttaacatccttaatattctaaagtatcttgaaacagttattttttctattttcagaaataaggttttagtgataatactgaaaattctaaactgtgagcttttgtttcagggatagaaatttaaaaaatcatgaggtcttctgtcatgattttgaatgtttaatctactttgtccagtgggcttctgaatcttttgtgattggcacgtgttactgagatgcagacacatgcaattctggtgaccgagttctcaagctacagtttattatttcacactgcagtaaatgtatggactgagggtgaggggactgtcagaagatgtgtgtcttgggtgcctgaataatgcttcttttgctattcactttcatcttaatttagagtcatatatttcttgttaccttttggttttccccggcacctaacaatgtaatcttcacaaagcagtgctacattctaaatttatagtgcagtaaatgaaagaggttggatccattgtgcttcataattcagagggaagaatgtctgcagaaagaaacgtgggtattctttggaatgccatatgtgcaataattgaaacattttgaggaatttccaatttacctcttaggaggaattcaggtttttgttctttttgaaaagaagatgattgttacagacttgggaaatcctaaaagaaaaaagaaggactgttgggacatcctggttgttcttgacccccgcaagaacagctacagttctttcagatcacagcacttgaagtcagaagcctaagtgggtgtccagagaattcaatgccgaaaggttttgcccctcttaactctcctgaccactagcattctctctaccttagtgtgtgggtaggtctttgttatgtctccagactcacactagttttttaaaaaaaatacttaggtaaatagcagtgggaccccaattctctttttcttgtattccagatgaaaaagaaaaaaactcaccagtttaaagtgctcgtttcatatgttcacgatatctaatagatgttaaattttggtaccaggaagtgagagagtgatatgaaggaactagtgaaataagattttaatacctggcaacatttcatagatgataacactggtccacttgaacacttgccattttttattcattatatctggtctagatgggtctagctaaaactttattccgtgcaacacagctcttgcctatttagaagcctttaactgtgtgtttaattatcacctggagtggttcttttgcagagaaaacatagaacgtaggatccagtctttcacaatgcaaaagttgaacctctgtcacctggcatgcttgaggaaatttcagaagctttgtcctcaccttagacccactgaataaggtcactaaggaatggcacccaggaatctacattttacaacctctccatttaatacatatgcttgctagaggttaagcaacactgtgggctcacctgtagcacgtagcactaatcagacaagactcaatatctggccagacttttagatgataatcacaagaagcaataacatttttctgaaacaaaacaagtggcaaatgatactgtgaaatctctggcactggttacccaatatccacacataccccacttagctctagattagaaaataaagaatgagattcagcccagaggcagccatgcgcacaggtgcacaatttggaaaaaatgagaccaattcttaaaaaaaaaatcaagctgaagtcaaagaagcttaataaaaatgtaaatcctctttcaactggctccatgttttctgtctcttcatgaacacctgccacctggtgaataatgtcaaggcctctcagagtgggtcaggaaagcaaaaaggcccatggccggaaatgctattaggcattcaaaaatgaacaatccaggtaacaaaaactcatgtcagtggtgcaggtacgatggcgtattctcttcataagaaacactatgcaaatgaatcgcaaagcgtgagagagcagaacttttcactgctgccttctgtcaagttgggaacactgaggtgaagattgagtgcaggggatttggggtggggagggtcccctgtgaaacagtttctgaatgaaagtgagggaagcaggcatgggatagaaggataatttggtctgagatgcaagtgcggctaaagcctcagccagtcccacggtgagctctgaagttaggttgtcccttctgagatgacctaaattgcataaacggatctgagtctttgtacctcccgtgcccatccaaacatccagtcaccatatgaggccacacccattgactgaatccggttctggagagggactgaggtttggtgcaagttgtccgcagccaggacttccaacatctggaggatgagcaccctaatcttgaaggctgaattcagtagcacatccactgcaactgaatatctgattcaaggccaaaaattgtggagctcagagccacaacgggcttctgatcttccacaggctgctgaatgcccctggcagtccactgaagtgataatgttaaggaaggaaatgattagaagtaatttgctgagggatcagagttgcatttggagctatcagcaagtaatgaagcaagaatgtcaatcgacaggtgaatcaaagtcagggcaaaagaaagggaggaggaaatttgctcaaaaaaaaaaaaaagccattactttcattgaggcctgggatgaggtaagtagagaaagtttgcaactgccagagattgctaaataggaaaaaatcttttgtgcacgtgttgctggtgggattgggacatgaaagatgttgtgggacagaatctcactggaaaagtcaagaatcagagctggtttcaaaaaaactcaaccttcaaataaaggatcccctatctctatattgaacctggcaatgaatacctctttcttttccttattggttggcaaggatgtagaacactaagatacacacacacacacacacacacacacacacacacacatacattctttgtttgtttgttttgagacaggatctcgctctgtcacccaggctaagtgcagtggcatgatcatagctcactgcagtcccaatctcctgagctcaggctatcctcctgccacagcctcctgaggagctgggactataggcatggaccatcacacttggctgatttttaattttttgtagagatgaggtctccctgtgttgcccaggctggtctcaaactctcggactgaagggatcctcacacctcggcctcccaaagtgctaggattacaggcacgaaccaccacacttggcaaatatttaattaaatattaaatatatctaattgtttgataaaaagggagagaggctctccttgatggaagtaataggttctggaatgcagtgagttctgctcggaatgccctctgaccactgcctccatgtgtctaatataacctatgacattacccatagaggtgccgctttttcattgggggacactgctccaaaagtgcctggaaccaggttaaaccattgaggttataaggaataaagggcctttataataaagaccatttctgtgactgtgttctgaaactgataaaaagcacttctttctgtctttggtgtcttccttgatagttgtaataagaatagtagtagttattcttctttttcttttttcttgtttgatttgtaaaataaaaacacttttcctttcctctctggtgtttgaatgcacccagtctcatttcagcagtccacaatgacatactgaaagttgtaatagagctacagctttgctgtatagaggtccatggatatgttttctaattataatcattcttgagctgtttgtaactatttcagactgcttacccagctgtatgccactggcttgtttctatttcaggaatcatctcttcctcttctcctccttccccctccattcccaaatccccacattagtagcggccaagttattttcaagtacagtgtatatgtaagtgatcttgatctgctaagaaaagacatactgtttgtttttattgggcaggcagcatcctagggaaaaggagaattacaagtctaatttggttaggaagcatcctttttcgcaacagtgaggactgcaggtaccactaaaatcattgctgttcattactaattggattaagtcctctctgttccaccaaccctgcttttaaaatttcttctctgcttttcattcagaaactgcctcagcctgcactccgttatctacctccaggctttattgcaacacctcccactgcctctctcctggaccaccttgtccacgctgcacacagttgccaaattcaactttctgtgttgcaaaccttgttgtggctccccctgtgtaaaaaccttttagtgtttctcatctccatgaatcactaatccatggtgcttagtagcatgtcaaaggcccttccgaatctatctctagcctacctctgtggaccttatctcttggctctcccacctgcccccacccacacctctaccccttgctttttgcttttcttttccccaaattctgagctgcttatacgttctttcccttcatggtgttttatacctcagcgctttcatgcatatagttcccagtgtctggaatgatcttttggataaatagtgacacttcaagaaatatctttgtcccaacttcagaaacctaattttcattgtgatgaatagctcccacagttttttccccgggctattttgcaagtattgaggattcacatgttaatcctgaaatgtgcgttctaaaaaaaaaaaaaagctccatctgagaacccattaaacctctagtttaaatacccaggcattcttaaaaatcgaatttgcattgtctttgctgcagtgtcttctcaggtaaccaatgcagccatgtcagattgatacatcatgttgttaagacccccatctgtctctagggtagtagaaaagatgcagctacggaagagaacagaactgtgctcctgaacatggcatggctgccgaacctcacagataatcctgaagcaggcaatctctgcagacttctggggtgatttgagcatgtgtagcttttgctggcagctgagagaaatgggaagtcccctgagctgaaagttgggagcactacatcctcatcaacctaaatctgccacatacaatctctgtgatcctggggaagtcactggacctctttgagtcatgctgtcctcaaatgtaaaatgagttttacatttaaatgttctaaataagttcctttagaatgtttcaattaaaaatttatccatctgtatcagataatattggtgatctcattcaatttttttagttccctttttgattatttttgtacccccaggcctcagcgtggcttctcttgcaatagccagcatggcttgttcttaagaaagttgtcctcagtctactactctattgcctctggctggaaaaactcgggtaggtgcaaggtgtccaccagcattttctcctgggatcgggctgctgccagctctggcactttgcctgggactgtagccttgtctggactcccctttccctctgcgtgggagtgcttccttatcaatcatttgccctcgaatccatgtcttaggatctgcttatgggttggactcagcccaagatattctctatctaggtatcctggttgagtttgttaataaaagttcggtttggatttagacgagacaaaccaaacttggttagggtaaatagaggaggaaggtgccttgtttcctaaattgtgtttgataaagtgcttaataagggcggcttccaaagtggttccaggtaaagaagtactaaaaaggcctctttattaatgtatggattttctgtcactgatgtttgtctgcctatgaatagtttagactagatttttcaagtaagcactttataatatctgtaactctttctaggtgttttataaacaactaactgagtagagcagcaacaacaaagagctgtaagttttctgccagtaacttctagtttttacctcctcaaaagctattttaaacaaatatgtgtctaattaaatctcaagggaatgtgaaataaaaactggaatttgagttcagagtacctgaaagagcatttttggaaaagactttgtttatgccatttgtgcatatgtagatggaatcaaaatgtataagataataagagaaaggtgccattgagcctccaagtagaagcccgatgacttcacttatgcccggctgatcacccaagtgtacagttagtcatgatttgatatctgttgtagattaagcctgttgcacacagtttctaccctgatgtttggcatgggccatgcaccatacattgaaacaagattttgaagtaaatagaaccacattttccactttctttcatgcagttattttctctgcaagatgcattctggctccttttgtgaaacctcagatttgattctacaagctgctgagaaacacagcacctgcatgccacccaccaaagagagtgtttacatagtctgttgtacatagaaagcatgtgggtgtgagtatacgtatgtgtgatgaaatggttcaattgacattgtacttacaagataaactgcatgtatcaccaaattatttgacttctctactcagaaagcattaaattttgaggtttaagtagacattaaacatttataatttaatatacatttaataaaattaatatttatgaacacatttgccttgggaattaaaagtggaaaacagtgtcatttacttgctaatggccaccacggtgccatgcagttacagatttgatggcctgcatcccagtgacattgctccaagaccagagacaagaccattttttgtttgcatggagctaagtattattttcagaaaatcaaaaccaaaaggtatgttttgcttcctagctcagggtctctggagacctgacctgccaggtatcatttgctcattttatttaaagaaaataaaataaatattcaatggagaagttaaaagtctctttccaactcaactctatatctcaaagaattattttctcattctgtcaagccatgttaaaattttcaagtaaagtcgtaatcatttctacattttctttcctgtttgtcttgcatctcttaaaatggttttaatgttagaagctacttgacaatggatgtgaaaatagatttaactcagcaatcaatatattatcaataataatcattaatttatacataaacatcacatgggtagctttccaagtccatcctgttttttgtgggctcttatgctggttcagagatgatatatgccatttttataaggtgaagaagtggagcagtataaattgtaccaagcaagtattgagcactgcgaagttcactgttccttagagaaatgagctatgcatttactgctaaaaacaaacctttcataaaatatttttttgggcaccaacctagtgaaggagtaaggaaaagaagtggatggttttagcatttaccctatggaagcttatagcctggatggcaagatcaaattaacatgagaaggcagtttggtgtaatggttaagagcctttggattcagccaaggcagaaagtgatttgaattctaattgagcccctttttagctgtacaactttgtaaaagccctttaccttctatacctcagttttcttatctttaaaatagaaatgctaatatctacctaatagtgttgttactattgtttcttaaagattgacaacaaggcgtatgaacagcatgcctggaaaatactggatgctcctcataagtagttatttatttattaatatcactgacacaagtgaaataatccatctcttcctaccccagcacacttatcataacaaatttgtaatttgtatgtttacaatatcttttctgatgaattgatccccatagtatatttagagcagtggtgtctggatttgtataaatctctgtaactctagaacttcacccagtggccaatacataaaagattctaaataaatatttgttgttgtcattgtaataggggaagagtatgctccaaaacaaagatactgattttaaaaacgaccacactttcaaaaaaaaattttttttaattctagagaccagcatcgagagtaggagtactcagtacgattatttacggtaatatatttattgggtaaattaggcaccatctggtgtgctagcttagatggctctagttctttattaatagatatatgagactctggggtaataggttgctagatccatatgctattcaggagacaaatttagtatacggtaagcttgctacaggatcaagtcgcataagaaaatgaattgaagtcgaagaaatgcttaggttaacccaacaactctgataattgaccaatgtggcaagggccattctgttccaaaaataattaacaatatgatcagtactgaattaatgttgttacggattataggtttcaaattttcccttgttaggaaaatcaccttttaaataatctcatagggttttgaacaaagagcacagtgtttctttttttttaaatagaaacccatacttgagaaggtagcaaagagtagcaaagagacctggatctctgtagcaagttcttggcctggtcttcattttcaattctaaaaattttgagggaaataaacagctgtccaaacaaaatgctgaaagaatatccctggacaaacagaaaatctttttttttttttttttttttttttttttttgagacggagtctcgctctgttgtccaggctggagtgcagtggtgcgatcttggctcactgcaagctccgcctcccgggttcacgccattctcctgcctcagcctcccgagtagctggaactacaggcgcccgccaccgcacccggctaatttgtttgtatttttagtagagacggggtttcaccgtgttagccaggatggtctcgatctcctgacctcgtgatctgcccgccgcggcctcccaaagtgctgggattacaggcgtgagccaccacacccgaccgacaaacagaaaatcttagaggggcatcaaagcaaatcatatggatggagagtgtgaatatgaagaaaagcatattctttcttcacacacacacagtatgtgtgtgtgaagtaatcttcagccaaagcaaagactaaaatgacctgttcaataagatggaagcaaactttaaaaaacaaacaaacgacaaaaaaaaaaactgtcctccttctccgccaaattcaggatacatgttttatcagcccatgtgctattaatctatttgtgattattctatttcattttctctcccatgcttttctcatttcttctcctcattctaggtgagtataggaagcatcagggctggggccataaaaagcctgtggccaaggacattgcaataagacagagaattttagatacttcattaattatttttcctaccagttaaggattccttgtgtaatgacagaacaaggagaagacagcaaaataatactaatgctaataaaaatatgtaatacagagtacttatgatgatataagcattgttttgtttgcttagattattctgtctggtgttcttaacagcctgtatgctgggcaataaaaatagagtctcaggaaaacagaaccaagtttgctataatttggagagacaaaactaagctaagattctttaagtaatgttcatggggagtttgtgcatatgatttatcagaaagagctgcttctaccagggctcataataataatggttcccctgaactggatgctaaatttatcaactggttattttgggcttctcttgccagtaagcctatagaaaacaaaaacaaaaacttttgctataaccttgattattcagagaaaataaggtttctgctacacagcagggacaggacatggttggcaactgggaaagacactcagcaaatattacagataccagaaggaacctggagaaactctgattctttttcattttgttcttaaaaagcaggcgtctgaaatgtgcccaacttcagctaaagaaaaaaacactattgttgggtctagacacaaagcctgatttgctgattttatttttcttcatttagttattttattgttctgtaaatatggacttaccttttttgcttctttattttatcttttggtagaaccttgagcagggacaccctagacgttcaactgttccgtgtgatcagtgtctgccttaaaatgtctgaattcctgtactgcatttcccagtgaagtttagtgtttatggcaatcctcccgatggggagagaaatgagccggcgaggccaaaagcagcatctgtgacttgctaggatcagctggctctgtgtgcatgatttccacttcaaagggtacacagacaacttggtgatagtccatttattgcagcctggtcttgtcaattagtcaaagttatcttctatacagctacagtaagtaatgtaaaatcatttacaatataggtgttagaacagcagagacccttagagttcatgtatttgacttcctccttgcacagttgaggaaattatgaaatgcatgtctttagcttcttcattctacagtatttattgagatttttttatgaagaagaaggataaaaagatacaaacttgtatgaagttagggaactggagaagctaactcattttctcttttttttcctgtgtctttggcacctctattagatctggtccgtagtgggtctaaataagtatttattgaagaagtaatacatgctttataaatgatggccaaatagctgtttgaatggataaaaaagcttcataaagaaagtgatacttgtactacgtcttgcaggatgtgggagaattggaaaatgagagagaatagagaaattaaccaatattatagtccagccaacagcaaagattgaactaaaattctggtctggtctagaggtaaaccaataggctcactttccaaaagaaaatctgaagcatttaagattatttaataaggaagaatttcctctggtgtcctgaatgaggaatctttggggcaagaagggtcctgtcctatttattatccttaagaaattccttgctatttttagttctcaacatcagctacttctcattactaagtaaaagccagattacttaacttgcactcaccctaattcatcttatccactggcagcaaattccttccttagaatacttccccactggtttttgagaagtgaaaaggattaacatatatggcagtggagtgttttatgtaatagtctttttattaaccccattatccagctgttggggtgctgggtagagaaggaagggaggaggaggaaagtagttgttggcactgggggttcagagccgccccagctccttgagatgaagggatgaaaataaatcctctgtattactgaagcatgtgaatgccatgaagtagtgggacctgaatcaatacattgcatttacagcagagcaaaagaaagaatagggttttcagagtttatttatcctgcttctctgaaaaatacccgtgtgaactattgggctgagagtgttgagtccattgaatttgactctttcactgccatatctttggagagaatgccttcccaaagagtcatatccaaatgtaatgtccctcccttctcttatgagtgacttacttttggtattccactgggtggaaaaaagcttttcttacaggatatatgaactaataatagttatacgactgcttcggatttgtcgcgctccccttggataagtttaatatgattttgtacacattaattaattatcttaataacagacaaaatagaaggaagccactaccgtcctttccagtgcatcagatgaatcaaaatgaatcaaagggctgggcatggtggcccacacttgcaatcccattactttgggaggctgacaccagtaaatcacttgaggccaagagttcaaaaccagcctcagcaatatagtgagaacccatcactacaaattcctttttttaaattagctggacatggtgacccatgcctgtagtcccagctacttgggtggctgagtcaggagggttgcttgagcgcaggggttctagactgcagtgagttatgatcaccactgcagtccaacctgggtgacagagtcagaccttgtctctaaaaaaataaatttaaaaataacattaattaattaaaatggatcaaataaacacatacatattgtggagattgtgagaaataagccttgttctatgtgtctcaggtttacctgaactccaagtagccctgatgactatatggcagttatcacaataagcaacagcataaaggactttgagaaatcaacagatcttatttttaaaaatgaattttcttaaacatgtattcactcagctggcagtggtggctcatgcctgtaatcccagcaattttagaggctgaggcgggcagatcacgaggtcaagagatcaagaccatcctggccaacatggtgaaaccccgtctctactaaaaatacaaaaattacccgggtgtggtgacacacacctgtagtcccagctactcgggaggctgaggcaggagaatcacttgaacccgggagtcagaggttgcagtgagccgagatcacgccactgcactccagcctggtgacagagcaagaccccatctcaaaaaaaaaaagaaagaaagaaaaaaagaaaaaaaatgtattcactcaatatgattaagtacctactctgggctagatattaattagatcattgagagtgtaggtgtaagccaggcagccagacatcaattctcatggacttgcattctagaaggagattgaagagatgaggcaacagttgtagagaacaccttactgctcatgggatagaaaattaccactgggatgagggaaagttgctacttttgattgtggtcaagaaaagcttttcaggagatcacccttggcttgaggctcattgataagaagaggccagccatgcaaacatctgggggaagaggaaagagcaagtgcaaagatcccaaagccacagagatgtttatgtgctgggagaacagaagaaatcccagtgcttgtagtgcagtgagcaaaaggaagtatgaggccaggtaaagtaagaaaggttggcaagggtcagatcatggagggcctttggggctgttgtaaagagtttcatttcattctaaggcaattggaatccatttgagaattgtgagcgggagagtggtagggaccaatggccagtatgtgatgacaggtaatgtgatctatgctcctatttttaggggcaggcctccttaaagatccatttattgatttaacaatattaaatgaaagttcactatatgccatgctatagtgttctagggtttcagcagtgactatgacaggtctccagctttattgagcttacatcttattgaggagaggcagacaaaaacgaataagaaccgtgaagaaaatatagagtttatatgataaaaattaatgggatgaagtgctggaaatttcactggattggagaccactagggctacttcagtaattagttttgaggtctcctgttgttgtttctcagccctgatggtcaagaaattctttcctgttttgcttgtttccatttctgtctactgctttttattctgttgtcctcttaggtagtacacagccctttttctgaaagtcttatctctgatgaagaaaacactttttctcttcaaacagtaacttagtcttttgctttatttcctagagactctgatttcctaaagtttttcatatttgttctatgtattcattcttttcattatttttgttgctctccacataaaaatataaaaacttatcctgtaaagaagtattaatttagacatcatttagccagaatatagcagaagaattattttacagttcttataaggtacctactaatcctccctcctccctgccccctccctgtcttctcttttctcctttccttcctttctttttctcctatcccaaaatactagttaaatagtttctctcctttaaagtactttaaagataacttcttcataatgaactcttgtgtgcataagcatttcttttcctgttaagaagcagtggacaatttttttgttttaaagacattctagaagattttaaaaaattattgtggtaagaacacctaactgtgagatctatcttcttaatagatttctaagtgtacaatacagtattagtaactgtagacattatgttgtgcaggagatctccataacttattcatcttgcattactgaaattttatacctgttgattaaaactaaagatccttttcaaaaaatacttcttaagccatggcttcccctggttgtggactgtaacccttgatgttattgaccatcttgggattaagttccattaagaaagacagtgttagacattgtggagaaataatagcaaggaaatgtttgttctggtccaccaaaatattgagggaccaattttaacctccacatcgttccttctggggttttcaggataagaaaaaaggagctgtggcttgctgctatttcagtagtcaaataaatatttttaaattgcttgtttcattagtaggatgtttttctgaaaagacagagtatatacccctcaggatatttctgccaatgtgttaaagtatttgtaaaaaaaaataaaataaatggctttgtagaatgttcttgtttcccaaatggctactgattttcttaagaaaaaggtagcagcaatttgctgaaaaacaaaaatgaccttttattagtcaagagaaataagataactaatttagattgaatgtgtttatcctaccagggtccaaaatttctattttcatgtattctccttttcttataaaggctccctttggaactatctaggaaggacctgccaacatccttgaacagtgaccattcagtctctactatactagaacccatctgatgatgaaattttgactatatttttggagatttcattctgtcattggatagctctaggaagtgcttttacaccttttgagctctggtcttgagtccagtaatttttacgtatcagtccttgttctgccttccaaaaccgcataatcctccttcaacttgacgtcctttatgtgttttgagatggcccccatgggcttccaagtgtttctggctaaatatcctgagctcatacatgtgttcttcatacagcagcactttgaggcctctctccatgctggttaccttcctcccaagtctgagttttaatgtcctgtttaaaatgttatgaacacagctacttagaaagctgtgcagtcatctcagagtagaatcagacaaggacctccttcacacgaagtgcttcctgtgaggacctatgtaatctgctctgtcttctgctatcatttgtttcttcccttctctcctttgcatcatccactccagcgacactggtttccttgctgttcctcacacaagccaagcaccctttaacttccttttaaagccctttacccttatttcctctgccttgaactctcctccttcagaagacatggggcattctccctctctgcactcagattactattgctgtcccctcagaggggcctgcccttcccaacccattctaaacagccctcccccatcatgactaccccttgtcatgcttttattagcccttgaaattcccagacattatgttatcattccatttatttgtttattgtctgctatcattattagagtatgatctctattaagtcaaggactttgctagttcctgaatgtcttttcagtacccagaaaagggtctagcatatagaaggagcataataaatatttgtgaatgtattgactaatttactatccatgcagattatctttaggcagaggatagagaataagactttttagtacatatttaacagtgtgtgtagccatccatacagtaaagaattctgcaactcacagtcaccccaaacagcatttgagcttttagatactatagagcaacctgtgtctgtgtgtgcatagatatgtgtgtacatgtacacacttatgtatatacatacacacatacattcgtatacatgcgtgtacatttatgtatgtattatgtgtatatctctgattaaatgggtgaacatgtggtttggggacccgtgtccaagccctctagattgtagaagctggaaatgacaaaagtgaatgaagtgagggaaagtgagccagcaggactgctcactgcacatgaatttccaaggatacagttgttcttgaacaatcacagtcagtatatcaaaataagcgctttattgagtagggtaaaaggagttgctggaaagactgtaaattctctcgcagaacaaatgataactgagcccaggagcccttttgttcttgggggagggggcataaattccctgaaagtatctgtcgcagggaattgctctgcattcatcatgtccgcctcctgcatcattcatgaatgtcataagactctaaagaattggcacttcatagtgaagatgattaaatagccactatacttgtcttttctgctgcacagtgctttttaaaggaattccatttaggttgtagcatgccccttcgaatcccttcgcatttcttgcaacctgaggtctctgacatcagaggaaggcccttgcttgttgggactggacagagctggtgggctagcacttcagtttgcttattttcctttgatggagacaataggatctggaaaaaaaaatgccataaagctcaaagcaaatcattttttagggagtatagaaattgctgtttagattctgcagtgaatgagctgtaatttttttcagatattttcacttctcttatcacttccttgtggactaagaataatgaatcagaacaagacacttttatatatgatttgctattttatatattcaaatataaggcctcaagtcattttgtagccaataaagcctatgtatgcagtgtaaatactgatgtaacagagtataagatatagaatcggccaggcgcagtggctcacgcctgcaatcccagctctctgggaggccgaggcgggcggatcacctgaggtcaggagtttgagaccagcctggctaacatggtgaaaccccgtctctactaaaaactataaaaattagccgggtgtggtggcaggtgcctgtaattccagctgcttgggaggctgaggcaggagaatcacttgaacctgggaggtggaggttgcagtgagctgagattgcaccactgcactccagcctgggcaacagagggaaactccatctcaaaaaaaaaaaaaaaaaaaaaaaagatatagaatcttacttctgtcctctcccctgcatgcatttcttgtcatgtatacatattctctttctctctctccctctctccacacatactcactccctctctctctctaagtgccctagagtaattcttacttcccaaacagcatccttaagtgacagagtgcaaatgattgaattaacatttatctactcaggtatatgtagaatctaaaacagttgaactcctagaagtacatagtagaatagtggttaccagaggcctcaggttgggggttggaaggagcagatgttggtcaaagggtacaaaatttcagttaggagaaatacatttttgagatctattgcatagcatggtgactacagctaataataatggattgtaaattgcaaaattgccaagaataaatttcaaaagttctcaccacaaaaaataataagtatctgaggtgatggatgtgttaattagcttgatttacatcattccacatagtttacatatatcataacatcacattgtaccccataattatatataattatgatttgtcaattaaaaataaggccaggggcggtggctcacgtctgtaatcccagcactttggtaggccgaggtgggaggatctcttgaggtcaggagtttgagaccagcctggccaacatggcgaaaatataaaagttatctctactaaaattataaaagttagctgagcatgagggcacatgcctgtaatcccagctacttgggaggctgaggcacgagaatcacttgaacttgagagacagaggttgcagtgggccgggctcacgccactgcactccagcctgggcaacagagtgagactctgtctcaaaaaaaaaaaaattaaaattaaattaaaaatataaagttggtcaataaacaaattttcataagcacttatgttagaggcaacagaaagtatttagagagaacagcagactgtaattaggagagaggagctctgatttgtttccaccagtcatcactgtcacctcagacaaattctgtaacttcccagggcctcaggatttgcatctgcaaatgaggacacaaatggtggctccaggattctccttccactcttatgacacatggctttatgtgtcaggaggggctcagccatcaggagggaacagaaaaaaaaaaaaaaaagctcaggatatcaccactatttctgaggaactcataatttaatgatctctgcaatctctaagctctgctgggaaatgagctccagcataacacgggttctgggtctgtagtggcatcgctgactgaaagataggtcatttttaaaatagtggtatgacctttggctgtgatttcctcataataaacataatatgatttttgtgccaattttctgttaattatgggcttctcctaaaagtttatgagtttaggaagaatgttctttttaaagtagaactttggacacatgttaggagatccaattaaatagatggatcatggaaattgggtcatcactggttgttaccagtaagaggatcccttagagataatgtgttcacctgttaccatagaagtcttatgagctgtgcctgtaagttaccagtggcttcaaggcaggtagaccttttgagctttaatttgttcctagaaggaacctcttcacttctcattatccagactttccctagaagtgggagggctgatcaaaatgccagccttggccctttgcattctgctgctccagccatgtgggtctgatttgttcttactgctggtttaagagagattaaaaggagcaaagctgttctctaagtttcttgatctgcaccgtggcagccagagtcagaggaaatggagacaatgggaaagggactaaatcctagagagtgatgtgtctgggatctcgggaagcagacccagcgttcaaatgcaggcttcaaatactaggtcattgctttggagaatcttcttgcacccaaaacaacttgccacaacctatgtggcccaatgtgcagcaaaagctgagcctgagataaggacagacaggatatatggctgaataaagaactttcaatttccttttcttagtagacggacaagtatcccatcattaaaaaaaaatagccacataaaaaagcagtttccaatctaagtgcacatggggtatgccaaaatctttgcacatgattgacttaatcagaaggcccaatctaatggagagaagtactgtattaatttaaatatggcaggtgctttctaagtttattgcaagagttaaagaccaattatcttgtatttttccataaaattgcattttctaaaaagagactggtgtgtctgaatacatccatcataataaatcttcaagcttggatggaagtgactgctgtttatttgcagcatgtcatatctgtactattgaatcaatgctaaagttatcatattagaactaagatgagggcccggaaaatgagtttttatagactcacagcgtgattttgtgaataaaagcataagaccaggaccaggtgtagaaagtgccttattccagggcctgatgacctggaaggcaattttcaaatgtagggattatgcagtcacctctcacaaggtccagggtgaagaacaagtaagaaactttctattttctggggaataggcacactttcaaaggaggaagaggtattgagatgagacagagaaattgagatggaaagtgtatttgaaatatgtgtaattaggcaggagaaatgagaatcacaaaacactagcaaaagtcattgtcttgctaaaaataataaaggaagaaaaacaaagtataagctaaggctttgaaggtgataaaatattaagaaattttgcttctgtatttataggaaatcagtttttaaaagtataaactaattactaatatattacataataatgcagtgatgttgcttgtccatgataaaaggtaataaataaaaatttgtttaatgaataatgaaaaatagctttcacatttggagttgattttgattcattttgatctcttatgtggctcttggctgtagactatctttgttttaagaagagcaaacccatttgtcctaatattcctggagaattatttcattcaaaagaataaaaatatcagccaggcgtggtggctcacacctgtaatcccagaactttgggaggcagaggcaggtggaacacctgaggtcaggagtttgagaccagcctggccaacatgctgaaacagagatggtgccactgcactccagcctggacgacagaacgagactctgtctcaaaaaaataaataaataaaaataaaagtaaaaatgtcatgtatataatatagagagaggttcaaatacgctaagagaaaaagaagccaagatcatgtaagcattatgattacaaccacatgcagactatgtttttcttctggctgaaggccagagagaaaggcaagtagctgtatattcagtgggtgttatttggtcaaatcgatttacatagtcttgcaggtcttccaaatactaaatattaagtacttggaaaatagctgagcaaaatctgagtgcattctatgatgatacagtagcacagtcttgcttgggacttaaaatcatggttgtttatggtcatggagttctaaccaaacccttgaacacaaaattcagtgagctcaaaatgaaactaacactttcacattctaatctgtatttccttttctatctactattttatttgtccaaatttgaaaactctgaaccaaccccagatccttctttttttactccccaaatatcaaatagatcacaaaaggcttttattcttcatgtctttcatatctgcttcccctgatttctcatgctcactgatccaattccaattttcatctctcgtgtctggggtattgcagcagtcttcctctaaatccccatggtcacacattatcctccctccatcttctctactgcagacaaagttatttttctcaaactgtgcattttcccactgatcaatgtagtcattctccaactttttaaatactaaaatcactctttgaaaaattgatatggaactttgtttttttttttaagacagagtctcgctctgtcaccaggctggagtgcagtggcgtgatctcggctcactgcaacctctgcctcccaggttcaagcgattctgttgcctcaaccttccaagaagctgggactacaggtgcatgccaccaagcccagttaatttttgtatttttagtagagacggggtttcaccatgttggccacgatggtctcgatctcctgaccttgtgatccacctgcctaggcctcccaaagtgatgggattacaagcatgcaccaccaggcctggctacttttgtatttttagtagagacagggtttctccatgttggtcaggctggtctcgaactcccaacctcaggtgatctgcccaccttggcctcccaaagtgctgggaatacaggcatgagtcaccgtgcccagcccaatcatatattctttaacattgttgtattatttcccagcagtttgtagcttattttgttttaatgctttattttcctagtaacaaattctaaaacgatgttgaataatattgtgataatgaacatctctattttcctgattttaatggcaaaggctatataattttgccatttagtatgacaatactttgctgttgataatctctatcatatttagaacatcttaattctatcttaattaaattttagagggaatggctgctgaattttttccaatacttaaaaaaaatcctgagtaaaattatattcaaattctactttaattaggtaaagtaatgaattttgttaacagatatctttaagctgaaatacactacttttcatgtttctgaaatcatatttttcttctaatataccattgaaatgctattcaaaaaatgtttatcaatttttgtaagtgaaattaaagtgttttgtttttgtgtagcatatttattaggtattggtattaagattatgttggatttacaaatgaattggaaaatttcttagtctgtttgggccactataacaaaataccataaactgagcagttttgtaaacaacagaattttgtatttcatagttctggcggctgagaagttcaagatctaggtagattgtattggtctctggtgagaatctcttttctcttcataggcaacatcttcttctataacctcacatggtgaaaccttacatggtgatgtctgttttataagatcgtttgtccccaccatctcccaaagaccttaccctataataggaacacattgaaagttaggatttcaacataggaatttgcagggggatcataggcattgcagtccatttcatgaagatttctaaccttgcctgtagtatggtataaaatggagtaatttagaaattatctcttatcttaaaagttatgttgaaaggtagatgaaaattacctgtaaaatcacctagatctgtattttttaattattaaaacttgaatctcctttccaatggtgtctatggtcattagcctattgagtttttctactttttcttataaatctttgacaagttatactttttcctagaaatgatccattccttctgactttcaaatatattgctttaaagttgtacaaagtatgattttatatttgtaatcttttctattgtgatggttatataatttctaatgttctatttttctcctttagtttttatttctgtttttttagaggtttatatattttctttgacattttaaagagcaaactttgggatatttttaacttttatattatttcaaatattatcgggtaaatttcagcttttatttttaatcatcaaaaaccatcttatttatcttatttttgtaatagtgcattaaggtgaaagttcagtttatttatgtttattttccttattattatttgagacattttcttctgagtttctgagtaaagctttatctgaagtttatatgacttgatatataaagctgtctcttcattaatactctaattattaggttttggtcttttttactgtatattttaagattgtatgtataaagagtactgtttgttcaataacttaattatagaaatcattaaggatttctttgtcaacaagaatattatcagtttaacaaatgttccaatttgaaatatatacgaattactgaatatgcttctttggtaaaattcctgagttgcttatcacccaatcatcatggtcattctttgccaatttatttaagcacttactgtgcccctatgtgttccaggcactgtgataggtaccaggaattctttcatatccaaactcttctagttgtgaaagaacccaaatttgaactagcttagactacatgagttagctattaaaagttgtgtataagaaagacctggccaggcacagtggctcatgcttataatcccagcattttgggaggccaagacgggcggatcacttgaacccaggagtttgagaccagcctggacaacatagtgaaaccctgtctctactaaaaatacaaaaattatccgagcatagtggcgggtgcctgtaatcccagctactctggaggctgagacaggagaatctcttgaacctggaggcagaggttgctgtgagccctgatcaccccactacactccagcctgggtgacagagcgagactctgtcaaaagaaaagaaaggagaagagaggagaggagaggagaggagaggaagagaagcagaggagaggagaggataggagaggagagggacaaaggcacaacttcacaatatagattataaaaactaggtattttaaaaatgataagatttttctctctgtggccagatctaaattcaacagcttgtctttactctttcagtcaggattgattttctcatgactttctccccataagcagaaatgtggccacggcagctgtgtgtctcttatgtcacagttttatcatcagagaggcactgatggagtgtttctctggttccaggtttaaaaaaaaaaaaaaaaagttcattgaagttctctagcctagcttgggttaattgattacaccttagtccatctgctgtatataagagcagaatcttttacggacatgacaatttcagttcaaatcacatgataaatatggaggaaaataataatttctttgtgaagaggcttaatgtttcaagatagagacagaggatgtgctgcgccgatagaataatgaaagtctcctatagtcaaaaaacaaacaaataaacttgaggcagattcttcacttcaaggtgctcaccataaaatggcaatactaaactatttctagaactctatatagagtgcctgttagttattttgatcctgttacaactctttcagatgatgaggtagaagtgttgtcgccttcttaatcatggagaaactgaggctcagtgaagataaatgattgttttagaacagaagcatggactttaatagttgggatttgttcttttcatccaattctgacctgggttctatgattaagaggtatgtgtctcatagaatcaaatcatcacccttcaaaaatattagccagcttttccagaaaaatcgtgttgtatgaattaaagccacaaatacaccaaagtcatccgtttacagcccctggcctcttgtaagtatgaggatcatataaatcaggcatttaaatcaaagcactggaaataagcaactgctttttatgtgtattgtttttccagagaatattcaatacttagctaccccttcattgttcttattaaaaaaggtatttcaaggctgtgaaataaaaggaggaaaagaagacaaatgtgtatgttccaaacttctcctttcctctaatcatgtctcatgtcatcagaaggaatgcacttctgaaaaataaaatgctacagaaaaggctgctgagtaattataaaatgattacttttgtttttcctttattcatttatattttgcttatgaacaaatgtatatatggtctttgcttttagttaatgctctgtaaaatagaataacgtggctatccttaaagatgtcacgttgcttttctgttgtacatccctgttaggttaaatctgagatgcacttatctatttatttttacaaaaacaatttgcaatgtgatttagaaatggaggagtaacataaaacaatttgactaaaaatgggtgtgattttcttatctgagactgccaaaaattcaccaaagaaaaatcattcaaatgtctttgtggttaggtttcttttataaattgaaagttgtgttctatttcatcatgagagatgctgtgagctctaactgatgagcatttataaaatatttccacgttgagatgaaatgacaaaaaggcaagatgaattaatgaacattgtatattcttattcctttattcccattctactccatgcctgaatggcaacgtgaagatatgtaagcataggtaagccaggtttcattgattagttcaacagcatttatttcctgtgcattcacagtgttgagagataaataaattaaacagccctggcttccaggagctcgtagtagagaagcattctggatttccattttgtttgacaataaaacttaatatttattttcttaagcctgaatactgtgcaatttcctagaacttattttgttttgctatataagaaactagcatggttatgaaagttaagttggctgtgagttaatttctcacatagacctcattataaatttacccttcagaatttagagttgtctgagtgtggtataattaatcaggaatggactattatctgaccttactttattcactttataagaggacaacctcatgtaaaaccactgtcatttaagtaagataaaatgagtacctctatactgccagttgcattgtgaaaggattgggttttcatcttgtttgctgtttttgttttgtttttaattttggccacatattagaaagccattgtccttctttccatcatcatcaggtaaatggtgagaatattagagatacagtttgacataatgaaaagaatgtagattgttgagttagacctggattaaagtcctaattccattcgatatttggtaaaagatcttggcaagtagttttaccttattctatagcttccctcatctttaaaaccaagatagtaactgttatgagctgaattatgtcccctctacaaattcagatattaaagtcataaccctcagtatctcagaatgtgactgcatttgaagatagggttttctgaatgtggtgtaattcatcgggagtgggctatttctgaccttgctttatttttcagtttcagaggttattttggtgggccctcatccaataagactgatgctcttataagaaaaggaaattagggcatagattggtacaaagggaaaaccatgggaagatacagggagaagatgattgtctacaagccaatagagaagctgtagaaaaagccagcactgctaacactttgatcttgaaattctagcctccagaattgcaagacaatgaatttctgttgttaaagttacccagcctgtggtacattttacacagccctagcaaactaacacagcaaaaaatatttcaagtgaaaaatatagagttttgaaatattatactgtatactaagatatataataaataatatatacacatagctggtattagtattaatattgatattaacattagtctagagttagtattgccaaacagtaccaaagagtttgtgaaagaaataattgtcccaaaggaaaaacaatgagcttatgaaaattcctttaagcaagagggaatttgagtgtgtccgtggaagctttatttttaggtcaattttagcgtctacagcattgcgtattctaccactaatcatctttttccttagcggaagtatcctgaaatttgatgagtaaaaatgactttcttttatatttttgtgatataacagcttctaaagtaatgtgtttctgaaaatgtcattacccctaagacttacttacaaagggtcatgatgtgtttgtcaaaactcatcagtgtgtccagaaactatgtgcgtgtgtattttagtcaaactttctgggagttaaagtatatataaggtaacacagcaatggaacatcgcaatagttggcatcagatttgcaaatggcacaattatttgtttcctcttcactggtccttgaaaaatacataatgttcccatcaaaagttccagccaagcatatttgtaagaacagggtttgaacataacctattatatcatgaagaatggctctcttccatggtatttaccaccagaattaagtagtggtagacttttttttattcatggaaaacatttagtgaatgggtagaatgttatttgttttatatttttctctcatcagctcctttggagactttggcatcgggcagaaaaagggtctcactctgcacaccaatttgagttcccatgttatcaaacagatttaatgctaaactaaactggtgtttgttctgcttataagtctttgagttgaagccttgtttctggaatattgggacatgctctgaaatgttgcctctgtagatcctagaaagtaatgatgttttctgctttcatgcgatttagttttaattattcttccttcaacagagagaaatagattgccccacagggagggaaccctcaccttgcttgagcattgtctaagaaatggctttttctcatgatgtacttaactgttaggcaatgttgtcagtttctcagcttactgagcagcaaatctgctcatttctttgccaaggaaaaagaatgttcttaaaaatagatgaactttctctcttaatgttcagtgcattcaatgttgctttatttaaggctgctttatcatcagttctggtgtttatttcaaaaaattcaaagtagataaaacagatcattcactaaattccatctattcaataaataatttgcagagctgtttttaaaatgtgtatcatttaccctgtactccctagtggctccctctgtaatgcagaggccttgtttgcagtttttccatctgttattcacctttctcccctccttttggagctcttgatctctagggatgtttttagggagtctttatcccattagtcattgggacagctttggagaagagggcatagttaagaaagggaggatctgattctattctcaactccactacttagcaacagatcaagttgtttaatctccttgagcatcaattttcttttttattaaaatagtaaccaaaatatttgccattaatatttcagtgagtgttgagggaagaggcatcagatgagacactccaaaagaaagcaatttgaaaatcatttaattctatggcaatataaggcccagctgttataaaatagtgaacattattcactcctaaaacagccagagagatgagcggcagaggaaaaccatagaacaaactaagtaaaagaaattgagaaaatgtattctttggaaaatcagatattacgagatccttcagttaaatttatgtctctatttgctagaagagatatttatcagttccaaagcaacaagcctttcccttttggttttattagctacatggtaattgatatgaatttaaaagataggtttaatttgatagcaataactacatctactggcaggatatattttatgtcattgatagtccttttattttccaaaaggatttaccagtttatagtaaaaaaacacgaatgtggataagcttgtgaaagagtaataaaaaagaaataaagaataagaaacctgaaatgatagaggaagaccaacataccttaccattatgagattttatactaagtcctgaggcaatgatcaaagagaactagagcaggagactgacatcttgtttctcatcctagtttatctatcatgtactttgcacataattgttatacttattttattacttaatttattgttctacttgttataattgtccacaagtaaattatccagttctccttaaatttaactctcagaggccgggtgtggtggctcatgcctgtaatcccagcactttgggaggctgaggtgggtggatcacctgaggtcaggagttcgagaccagcctgaccaacatggtgaaaccccgtctctactaaaaatacaaaattagccaggtgtggtggtgcatgcctgtaatcccagctacttgggaggctgagagaggagaatcgcttgaacccaggaggcagagtttacagtgagccaagatcatgccattgcactccagcctgggtgacaagagcaaaactccatctcaaaaaaaataaataaataagtaaaataataaatttaactctcagatttcccctgggagatgcttccaaaacttgttccattttaacatcaatagaattatttgagggaaggctattttgatatatatatatacacacatatatgtatatatatatataaaaaaatacatgaatgagaaaaaattatattcctcattctcttaaagaaacgatagatcactcacttaattagctatatatatatatacacacacatacatatattcacatatatatatacacacacacacaaccaatattgtattattgtattttagtacttttattaagccattttacctgtaattatttgatggggtaaataataaatgaattctagtctattgtattttttaactgaaccttttttgtttttcacacacatgcatgcacacacacatagacaaatatatatatgcttatgtatatgtatatgtgcatacacaatgaatgtatatgtatatgtacatacacatatgtatgtatatgtatatgtacatacacatatgtatgtatatattatttgtatatctaaagtgaatcttaagacaagaattctatttctgttgatagtctcccagaaaaagtaatatgctatttggctataagactggaaatagaacccatgccataaaggcagggccagggggtttctaagtcaaaacaacaacaacaataaaataattacctaagtgatcctaaataaagaaaaagtaaattgccatcaacaattatattctaatacaataagcaataaaatgcacccaaaatttaagaaccttggagaaatatgtggatgagaaaaaattatattcctcattctcttgaagaaactataggtcacccacttaattagcttgttccgtaactttcacccaggactcctttatgatcgcatggaagactgtttgatccttttcttctgctggatcaccatcccaagcacacactcacagaacacataccaaaacactctgtcaatatcaccatcagctccatcacagtaagtagttagccaattatgaaaacaataagccaggcccattatttgcaggttgtgagttaaaaaaaaaagagtcatccttgttgactatttgaagatgagatgtatcctcttaatctttgttagtggtgactgtgtagagatttcattcctggaatactgtgttggttaaaactcagcaaagcaacctcagctgcttgcaaacttgcaaatcctgcagtgttaaatggccaaaatgctactatagcaattttttcttcagttgaattggtcagtttttgccaacaaggatgaaatttacatgattctgaatataaacataagtagtatgatcttgcatcagcatactgaacacggtgagaaaccagcaatcagaagtacgaggctcaggggagaaagcatgtaatgtggtatagcatgcctcagaaatgaaaatctttgatgaattaagaggaggttcttatagttcccaggattttcccaagaagttgatttgtaatccacattttaaagtaacacaattaacttttttatttgaatatgtaaaacaaaataattctatgtttcctgtaggactctaggcattttatattaaaattaacacgaagtatgtatttacctttaaaaaccatgcaagatggcaaagcatgaaatgtaaagagaaaaaacaataacaacatcagagtagaaagttataattgttaattaccttcctctaatgtcccacagtattggactatgggagcattcagggcctttattcactcttaccagcaaatactttaccaagaatagatattttcatatttttttcttcatagcaaagtaatcatatgccaggtactttgtatcttttatgctttcttcacctataaagttagaatcatctaacatagtgacatcataaattcagaataacaaaagcaatacaaataattttaaatcaaatttttagtctatcctatcaaatattgtcatagtgaagttttgttttttgtttatttaaagattaaagccactgtgactttctaaccatatataagaaattatatatttatgtattaaaatattcttctcctttgtattggagcactgagaattactggtaggattgtggatgaaaactacaagtaaaatgcttaaagttgttgatatggtgagatggccagacaagcttttgaaaacatgccaaatttgggggctgtgactttgttttcattctgctttagtctgataaaaagatgtgaaaagaactaagtacagacaactgtttgccccattggtgtagtttattgatacagtttattgtgtaattacattggtatgtggtgaaaaaaggctttcagaggtagaaggctcaggctggagacttgaaagtggtactatttaaatcagataattgagtctctgtttccaaatctgtaaaacagtgttaagatataaaatatcccatacaattgttgcaaagattcagcaaatgaatttgaaaatattttgcaaactgtaaagcagcatgtatatgctgctatcaattttttgacttgttatttttgtagtgacaaaattatttcctgatagagtatgaatttatctctgtagcagaatccactatatatttaggatagaaaagtaaaagatttttataaattgccatgaaatgtcacaggctgatttgcattttctggtgattctatacattaatcactgagtaaccttcagttttccaaataaagaataaagagagtggtgatgacatttgtaaccatctacagaggaattatttaaattcttcacagatggagcgatatcaagggtaaatcattatagccacatttctaattttaagaagctttgagggtgtttgtggatggtaggaagtaaacattgttttgcatatagaattaatcatagactttgcataccacaattccaaatcctccagatgagtgtagagggctttcgagacaccatcccctaaggatcgagaaattcataaaaggaaaataatgttatgctacatgtaatatacaaattgagcaaattggagcaactagaatagtgacctttcaaagaagacaaattagattctgtatgcctcagaatttaatgagtcttagtgctttaggaaggatgacatatgacacatattcttaattctagtctcacaagagttaactttattatttctcaacaagatgaataactcacttcttctttggtcaacataattctacctaatattctctgtaaactagctctggaaatacatgcggaccagtgcttgagatttttagtaaatgtaaaaggtatctgaatggttgtataatgctgctttaaaagagttttaagggttggaacatggtcactgagaaatacacaagaaaatctgttaccaaatgtgctctgaattttgagatgagtaacccgtggaagtattcgctatgggtaacaccacttgcctaaaaccacagaggcaacaaatggcatagcctttctggtcaccaaatctaaatgattttctccaactgaaattaaaaatgtgtttcttgaaatgtactttttataatttctgaattacaaatattttctttatttttattcccatttgctttgtaagtagttctaaattaatatattcttagtaactcctgagttcatatggataatagtaaaaacacaagtaaagagtaaacatactggtaaacccactaatcataattgacaactaccacttgtcatgttcaaatctcattatcctgtgatgttttttctgtttcttgtatcttcttcctaagatttagtttgaaaaaggaaaagaaaatgtatttaatgccagataaataccaccactagggaacaaaaaaaaggtccatttttaaaggactcctggaggccaggtacggtggctcacgcctgtaatctcagcactttgggtggccaaggcagtcagatcacaaggtcaggagattgagaccattctggctaacatggtgaaactccgtctctactaaaaatacaaaaaaattagccgggcgtggtggcacgtgcctgtagtcccagctactcgggaagctaaggcaggagaattgcttgaacccaggaggcaaagggtgcagtgagccgaggttgcgccactgcactccagcctgggcaacagagagagactccatctcagaaagaaaaaaaaactcctagaaatcatttttgttaccatgtttatagcaacacaatagtgaaataggcaaatgcatttagtcacataacttggttttcttgggccactgctttctttcctgtgggagtgggagaaggtacaagcaggagagacatgatgcctttggactgctctgttaccttcagttttgtaaggctcctggctccactgaccagattatgctgatagataagagataggggactagttttctaccttgtgcctgtcctggccaagatgcaaaattaagcctactgttgaggaagaccagaaagttgtttattgcaatgtacccaggctcccagacttaggatgttatttaccctccaccgttatgcagcgggaacttaagatgttaagaacgactcttaccaacatctgctttgttatgcattcattctgcctgcatctttaatttggggtgatagctgccttcagaagctttgggagccgttcctctcagtaaccaaatactgtcccatgggggacatttcctctctgcagctgttctgtgtagggtctcaacagtgtgctacagctggctgtatgcaatgtagtgccttgatgtctccctctctccttgcttttgcagctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagtgagtacagggccttggcctggattttcttatgttactggtggtctgagttagtgattcaggtagacgcagcagaacattctagatcaatatggcaaaggtgcacatgcttataaaaattgttttcagatgtgaaccatcatatttacagggttcctgggggaaaaaaacttaaaaactcttccttcttccccatgtatatagggaggaaaaagaaattcattctttgcaggctcccttcccaactgtgtggcttggcctgtggcagaatatttagcagacttctagggtatatttaagagatttacctggtgtggatcttacctggtgcaagcagcaaagccaagtggaatgttaacaatctcctaggctgggatttggcaaaccttctgtaaagagacgtatagtaaatattttggactttgcaggtcagatagtctctctcagagctactcagttctgcctttgtaatgtgaaggcagccacagacaatacatttttttgaaatgcatgagactgtattccaataaaaatgcatctataaaaacaagctgcaggccgtaatttagtgacccctgtcctaggcttcaagcatcactgtaagagatgtaataaatgtgtgataaaaactgagaccagagtgccagagtgggcggggcaaaagggaaacagaacagtgatcaagagttgagtaattcatgtgtattgcatactcaacattttgcttttggtcttgtacatatgcacttaatagcactgcacccttaatccctgtagatcataagaacacagcaaaggctaagaaattaaaaatgatttagaagaaaaaattcttttgttataaggatggaaaatatttttacagcaacaattaacccattttatcacctgtgcagtctgcagttaagaaagtaggctaaagagagatatgattctcatccataagtacccaaagtgcagtctccaagagcaaagagaggaattgttctcattagttagcaatgacaaggctagaaagaatggatttaatttggagcaataagaatttagtttaaatagcaggaggaaaaggcagttaagaaaaaagatcaactggggattactaccaacctccaaaaaggaggaaaaggaacattgattaggaatctctgaatcagagttttgctaatgtgcaggtgtatagagagaagcagaggatacaatttcattgctggtctctggagttggagatggctggccggaatcatgcatgacaagcccagctcccacagcagtgcgcatgtctgacacttgctcttccagcatgccttggaaatgagagcagcttaaagtcctaggcttgagctggaagtcggtctagccccagtataagccagatcagggcaagactctgcttaggagcttaaggaagaactggttagagatgatcaccttcaaaatgtggtggaggagtcttgaatagagttgtgaacttttcaattttttctcagatgcttcaggaaccatatggtgctatgagcctgagctaacacattttaaaaagctatgccaaggagcaaaaagaaaggcagccatacttactacactttatctttatttggcctctaagaaccaccataatttacaaaactctgtgagatttatgctacatataacttaatgactatttcatggcagctataactaggctgttattaccagctcacttgcatttccacagtgatttatcttctttttttgttcattgtgactgcctaagaaaaatatgatttggcacagacatgagcatctttttgagtcaaatagtgtactattgttttatccattcctgctcattcatgttttgtagaacatctccacttttaagagagaggttttcctattttctgatggtttacttgaaattagcagtgttttaataaaattgtcatgcagattgtggtaacttctaggaggaaccagaacattccagtatattttaatataccattataaagctctgtcatttctttggggtctttgaaaagtgaatactctaaacatactttgagattcaggtaacatccattgtgtgcatttattagtgtgtgtattctgtataagcatacccattagatttgacatagtataatattattttctttgtatgagcaaaattaccagacattttatatcaaaatgtaaagagccccctgggatactgtagacacttgggtgatacagccgattgcttaaacgttctgtgaaagcccagtagattttcctccaaatcttagattaggaaatgatgtcacctgaccctttcagaaaaaaggaaaaaaggatcctatgctgtggggaatctgtgtgattctagagtgaccctgacatgttcatggccctctcgagcaccaggccccttcatgggtctagtcatttgaagccatattttatttccttgcagattatctctttgtctactctgaagaaggcaggtttctcatcatacttgaaagtaaagaaatctaagtagaagactaaatggcttaattatgaaaccagctttttgttttggacatttaagtagatacatcagggaaacaaagccataaatacttattaagatacttttataacttttacaatctgtaaaaggtggttctgtttgttgaatggtttgttttcttgtactaaagaaaattactgaagagagaaagagctttggggccattaatgaaagtggaagggattgagcataaggcagaagatgctatttctccttacagtttgcctagaagagaaacctcctgggaaaaagaaaaagtgatagaagacacaagggggagatgaaggcaggtggttttctcagtttttttactgctataacagaatatttgagatttggtaatttataaggaacataaattaatttctcacagttctggaggctgggaagtctaagatcaaggtactggcaggtctggtgtcttgtgagggcccagtcttcacctctaaggcgagcactgcatcctcaggaggggaggaaccccatgttttcacatggcagaagggcagaaagagtgaacccactcttgcaagccctttttaggatagcattaggcagagccctcatgacctaagcgctttccaaaggtcatacctcccaacactgtggcatcggtgatcaagtttccagcacatggaattttgggagacatattcagagcatagcagcagaatatatttgcagcagaatatattccagggataagggaagaggacagggctctgcctaccgatgtgcttcaacaagggattacatgggggcaaagcttcattctttgaatatgagtgttctttataaaataacaacaacaataaaaacctaaagtactttggtgctacttgtgagtggtggtcaggctagtaaagttggtcaaaaacaaagtacaaactccaaaattagccagcggtgtatatgtgtgtgtgtgtgagagagagagagaaagagagagagagagtgtgtgtgtgtgtgtgtgagagagagagagagagagaaagagagagagagtgtgtgtgtgtgtgtgtgtgtgtgtgtgtgtgtgtgtgtgtgtgttggggagaaggagaagagacaaagaaagtttgtatttttttaactttcaaagaagacaattcctagaaattcctgaagtgttttgagcaacatcaacattgtcgttggaatatttcctttttacccccaagtggacttatttgaaggaagagaaaatgctcttccaagaacactagagagcctgaccctggggtaagcacccactctagaatagccccagggcaggagtggcaaataggcttcatcttgcctgaaaattctcagtgcctcactctctctcttcaagctttacaccaggaagatttatgagaacagcgggcaaatccacaggtaggagatctagcttccattagtcatgtctgccacatgtgccgatgtgaggttttgtgaacgtgcactacacattcatcacatctgctttaagctccacagtattcctccacacgtgctccaattttcccatttcttttcctttgttatcctgaaatccctatgtattaaaatttctttggaaaagcagtatcttaagctcatgttgcactgcaagtcctggaatgatttatcaattcatctgaagtagtcaatcttattgccatccttctcataccagcctaaagtcagctcctgtgacagaatttaagttttgataggagagttggacagaaaggaagaaaagtggccatggctagtttggggatgtgcaatgttgtgtgggatggtagaaatgagtgggaaaacttgggcaaaatgaaggcatttgtgtcctagattgagtaactggggcaaatgaagaaagggtcaccaagacagttgagtgctatgagcacttttcttcttttatgtatgtattttaagttcaggggtacaagtgcaggtttgtaggcttgttacataggtaaactcgtgtcatgggggtttgttgtacagattatttcatcgcccaggtattaagcttaatatccattagttatttttcttgatcctctccctcctcccaccctccaccctcccaaaggcccagtgtgtgttgttctcctctatgtgtccatgtgttctcatcatttagcttccacttataagggagaacatgcagtatttggttttctgttcctgtgttactttgctaaagatgatggcctccagctccatccatgtccctgcaaagaacatgatttcattcttttttatggctgaagagcacattttttctatttcatgatttgctcagattgtctttcattctggccaagggagcagaggctcttatttctcttgctactttcttttaaacctaaagtcttcccactcatctgggccttataaaagttaaataggttttgacaaaaagtgttgaacaacacaggcctttggtcattttaaaaaatcagagagggccaggagataaaaatgatttagaaattgcttgcttcaaattaactaacatttctttgtttttggttcacattccatgatgcaatattttctgaatgaattataaactgttatattaataaaattttgaattaagcatgtttgaaaaaggcaaagagatctttattgaagtatatgtgcatgaaatgagattctgtagagcgagggtgtcttagggtagaggaattttttaaaatctatttcaaatgttagtttccttccattgaaatcgattgttgaggaattaaagctcaattttggagaaaagctgctatcgcttgcgagtgacatctgcctattgaccccacatctaggctttaaggagcggtgtcatgttacactcaccttcatttatacaacagggaaaaaaaactgaataggactagagaagagattggcatgaagtgcttgttattactatcatgaaactcttgtcaacctctttcaccatctgcaaaatagaaggtcggggagaactgggcaataattagcttccctttatgtagttaatgctgagtgtaaaaaagacatcctattaatttctttctctctgtatgtaatttacagtaaatcctcttggattcattttttaattatgagcctttcaggaacagtgaaaatttatgtgttaagatatctgttttgtttgacaagaatctataaccttccccaactatttccttcctgacttaaaatgtagattgttacatacacgaggatgaggggcagacaaagaactgctgtccagactgacccccatttcacggtggcaaagtgttctccttccaaaaactggaactttgaaaacagattgataatattctatcagtgtcatatttggggaaactggatatttattaagtttcacttgtatattattgtttttacatagtttatagcacccaacgagagtcctgtagaataaatggaagtaaagctgaatgatgatgaatggtctgttcctcccatctattgcatttataaattgccagcctggatgcttcatttgggctgtctctatgtgggatatttacagtaaacgatcagcatctgctgggatagtccttagtaaggttaggtggctgttagcttagattcatctctgggtttggccagtgacagaattggatttgagtcaagaactgtatttggggaactttccagtggagtacagaagaatgttggtgtttttgagactggtaacgcaaataaaaaaggaacgaacaagaaaacaacagaggtatccaacagatgcaatttcgtttcccatggagtgctgtgcactgcaggttgactccgtatttccttccatcgctatttgttcttagtgaaaaagacctctttgggatttctgagcttaggagtttttccagatcattagccacttatacggagaggacctgctgggcattgtctctccagctttcagcttagccatgctatcccagcagagtcggagaagaaggtgggagaagggagtagaagtgatgattggatgaagtgactgcttatgtaacctggactagaggcagctctctgcaggggagctggtgtgtgttttctcagatctctattattcccatgatatttctatctaaatctgtttactttgattccacacatggttttgagaggcagcaagccatagtagaaagatgtgcttaatttgaaaccaaaaaaaagttggatttgagttccatttttcaatccatttctgtcagtgagctatgtgactttcagcaagtcattctactacttggagcttcagcttcctcttcttataaatgggcataaaatattatgttgcagggttttctcaaagatcaagtgaaataaaatatttagaagctgttcattatcagcaaaacactgcactaatggagaatggtggttttcctaataaaatgggtgctgtagaggtgatgactgcattagagaaacatatatagaaggaaagttttagtttaattgtttgtataagtctgcttggactttttaggcaaaattttttaatttctgtttcatctgatcaaatgtcaattttatgaattaaccagattcacaatgaagacttttggagcatctctttagcataaagtgaagaagcagttacctctgagggaatttaggtcatgaccttggttaggtcaataggataagtgaccctatagcctccttggtgtctcattatatagcgttgtgtctctatccctgttacaagatgataatgcattgcgcttctattctctttagtataagcttccaaagggctctagactcagcagtgaaattgtcgcctgccttgccctgaagtttattctttaattttatcgaccatgggaaatgggaatatgccactttgcatgaaaacagggaaagaagagaagaaggaagagagggaaagaggaggaggaaggaggaggagaataaggaaaataaaagagcaagaagaagatgacaatagccatgaccatcaccaccaccaatagaagtagtagcagtaggaaagcaaaacctttctagataggcctagtatcaaaatggttttagactctccttgggtaccagataaagtcacaaagagcttggtcgtatactcggggatagagcccccacaaaatgttgctagaaccaaagtcctaatggaggtacagccagactgtggggagctaagtaggtcttgccaccaagtacactggaaacctaaaaccagaaatataaacagaaatacttcatagatttggattccccaaaatatgaaggaaaagtgaattataaatttactatgcaaatgaaatgtacaataatgcaatcataaaaatcaagctgacaaagtgtgtggaaaataggttatggctgataggaaattatgagaaggaaaggccaaatggctatatctttctcatttatggttcatacaagagcccttagactgttagttaatgacagttatgtttcagaatcctcaatgcatacaaataagaattttgaaaaactaagatgaagagaatttagctcctgagcatcattcattttatatatatataaattgagtttttattatgtgtcaggaaaagtgctgtgtgttgagggtactgtgaccaaccttggcttgcatagcataaacaggcttgagaggccacgacaattacaaaaacaagaaattaggttttctactcattatgaggtgatgtatatacaactcttgcacaactcctggcatatagtgagctttcaatcatggatagattttgatattattggtactcaaagatttttcttcaactaactcattttaactcaaaaacttgttatattttattttcctaagcaatgaataaactttaatcaggcctctgaaatttgaaatgaagcaatataaaattctaaggagctgggatattactgatttaaagacagctgggtggcacatatactgggttattgcagttatcaagctagctgaataagttctgaatagcagaagctttttagatatatgaatctaaaatgcaacaagcaaggcaaactctaagtgccatcacgtgaatgctggggctcacaggacttaatggcaagcctcccttaacaccatcagttggatgaattatctcattgacccaccgcttacactgctccttgtcattactcctggggtattgttcagtgcaacagggcaagaaataactcattgactccctgaagctatagatgatggattttagatccctagctgtattcagaaggcataggagctcagtgtattgatgggggaattcattagccacccactccacagaatcagtttcttagatcctggtgctgtcactgctgctgttgcaacttgttagtgtttcagggacagacgtcagagggaactgtataactacattagcctcacagatagtaccgacagccagacctgtcatttcctggcctgcgatgacacctctggagcctagaatcacttaaagatatttagataggccctgttgatacgaccaagctaaccttcatcctgaaatcaattcatactcaggatgacaggaaatgagttgtcattaaggctcatattctatttttgagtccttagttaacctcttataattcagtttatttttcctcctccatttctgtaaaatggcaggtaatttaatgacatagattattacttcctacatttactcgggagcatgtgtttcagagaccatcttacattgataccattactatcactttccgctaatattgattgacaaaataccaggtaccagacactgtgcaagaactttgtttacactgtcttataatgagctcatgaccactcagtgaggtagtcactattaatatcctcattttataattggggcaactaaagtttgaagaagctaaagcattttcccaagatagcactactaataaacagctgaatgggctttcaaatgcaattctgacccttaattactattacacccctaatgaaagttttagagtagaaagcatagtggtaataattttaactcaattcatacttatgaaacagcaatttacttgggattgttggagatgtgaagaaagttaatatctagccggggggtagaggggaatgaaaatcatatgtacgaatctttttaaaaacagaatcagctatataccaaagaaggtaaaaatactgctggttgctgagatttttttttttaatgtacatagatgggatgggacagattttgactagtggaatctgaagaaagagcatacctgatgaagataccagcatgagtgtcatatcaaaggaaatacaggatgtgttctcaaattcatgaattcaattggaccgtaatgaatggcataagaaaagaggcaggtaatatggattagcacaaagaacatatgatttaggggcaattggtctctgattcaaggtctagttctgcctccaactagttctgtagcctcggatgaattatttgactactccgtaaaatgcagatggcaataatgccaatttgtagctctgtgaatatttataacctatggaaaaatgcccagtgaattatctggtacatagtggatgttccattaatgatagccatgttcttgtgttttcttcccaggtactttagggacatagtgtagaagatttgagttttataccaatgatcgattgtttctgaaagcaaaaggaagacatttaaagatttttttagaagaagatgaaatgcccagcacttaatttttagggagattattttggctctgttaaaagaatgttgttcagtgggttcaaggaaaacagcagggtcttgagtaagtgtttctagagaaacgtctttaaagacttattctatgatgatgcatataggaaggtaatgaggataaaaccaaagaacagttcagagattgaatcggcaggtgttgtcagcaggttggattaaaaaggagagaactgagaaatgtctagattgggaaggttgtgatttcattaccaaaaacaaaacaggggacagataagtaaaacagataagagtttgactttagtgatgcaaaacataaggcatccaagagccaggctattgaaatttccaattggaaatacatgatgaactcagaggagagataagggctagaggtgggggcctagagaattcacagcttggcagtgacagtggaaggtttaaggagtgctaatgtctcaagggagatgaataggaacttgggaaatatatacatatttttatatatttaaatatatattattttatatatttatacaaatatatataatgtatattaaatatatacatatacaagataaaggaggaaaggaagagaactaaaaaggaaaggctagagggtaggggataacctagatagtgaagttttacagaaatcaaaacaaatgagagacttccaaacacaagttgttccagagctgttttttctatacctgttaggcctctttcatctgaaatcagtttacagagatgtcttcttcatctttattggtatttattatggtgtaatctttgccacttcagtcctcttaccagtattctgcatttcttctctgtcacgggcatcattaactttgagccagaggacccagcatctactcctagagagctgccaccaattagcagttaccctatgtaaatggtagaggtgtagctactattctgccaccctcgtaatattgtgggaaaaatccaatgacagaatgcaagtgagcatgccgtgtcatcattgaaaagtcctacaaaataaataaagtcgtttttatatcaatattggtatacctaccactcagcacagctcttggtacctaaggagatggtgattggagacctggaaatgaagaccaaagagatgctgagatggttgtagtttccaataggaagattagcaaccaggcaagtggcagatcagagcccaaatgtgagtggctcaactgctggaccctgtaagctgttgtggttctcaaatgatgtccttatcttgttcatctctcagctcttggcacctcaccttttggagcttcagtttggaaagggcaattcggatttaaatcatactgcagtttcctaaatagaacaaatcccctgatcctagtgatcatgtgcaatgaggcatggaatctgattacccttatcattatcttagcttggatagctacaaacgttactaaatggttatgaaattatctagccctttattaagtgcaaaaggtagtacttaggttactaaacttttttgaaaataattccgctggctgacttttcatggctaaaaacccatattcttatctgtggagtgtatctttttgtaatcacatctgtgtttgctgtttttttaattgtccaggcagtatgttagccattttgtgtctatcagcccatttggtcctgacaacactgttaaactagtggcattacctctattttatgaagtaaaaaattaagcctaagaggattaagtaaccatttgttaaaggtgttaaggaaagaaaagaggacttagacttaatcattgatatgtttgttttcagtgtcatagatatagatatatactgcttttcataattttctattcaatataatataatatatatgtaatatatgttggatgtgttgaatttagcaggacctgtaatatttatttaaatccacagttaagaatgataaacaggactagagaatggaacacagaattttggctaaagcagcatacataacttaaaataagtcactttctttttggattcaaagaaactcattttacattacattttttgcttcccagtatttgtttttctcaatgacgttaaggcacctaattacccccaagccactttcttaaatactcctatgcaaaatgaaaagattggcctggagactaatctgaggttttgaatgcagtgcggtagaataagtgttttagaggtaactttagttcccaaatctcaataaaaacacttccaaatttagtgtatcaaagaaaagattattggataatgcattctcatctttcggtgtatgataaatgccatatcagaagtcctcaaatactcttgattaaaaacgctaaatgatctcaaataacacaaaaacccatttattcctactggagtcagtatttaattttctatatttgtaatttaaatccagatgtgggtgtcttcacagcgaccatggcctgtcatcccttggtctgttagcttctaatgtctagcagcagagtatagtaaatacttgaaaggtagaccttcacactgaaaatcacatttattgaagtgggagcagattccatttaaattgtcccttacctgatgcctaattcctaaggttaacaggttttcatgtttgctacttatatcagcagtactggagctggtttttttgcatggctaaacagcaaagcttaaattcaatactagagcgtgaaagaggaaaatgagttttggtgtgacgtgtgaatgacgtggttttcctaaataccatgaatgcacaatgaatgatccacaaagcacagccgcctcttaaaagaagacaaaaatctccctgaggtttagttgagaaaagatacaggagcatatagcaaaaactacaacatgatacacttacgtaagatgcaggtgggaagaatagaatttccaaattaaaattagccaggccagcagaaatgagtaacctaatgttatggcttggatccgtgtccccatccaaatgtcctgttcaattgtaatccccagtattggaggtgggccttggagggaggtggttggatcatgggagtggtttttaatggtttagcaccgtccccctagtgctgtccttgtgatagagttctcataagatctggttgtgtaaaagtgtgtagcaccttcccctctctcttcctcttgctccagacatgtaagatgtgctagcttcccctttgcctcctgccatgattgtaagtttcctgaggcctccccagccatgcttcctatataccctatggaaccatgagccaattaaaccccttttcttataaattacccactctcaggtatttctttatatcaatgccagaaaggactaatacacttactttcgtgaaaacaacttttctcttaaccacctcctactgtctgtcaagtgtagttctaagtgcttgggatccaagagtgaaaaggatagacaaactccctgtcctcatggtacttacattctagtgggggagtccttaatgggcacaagcaatcagaacttcaatttgcagaattttgtgaaaatgtgctatcatatatattttattaattaactagttaacaggcagggaggatctccttcaaacttttgttttcatctttgtatttttctttctttgccaaatttccactttaatctctttcattctaatatgctcacgagtcacttaatgaggaggatatgttctgggaaatgccctgccaggcaatcttattgttgtgtgaacatcatagagtgtacttacacaaacctagatgttatagcctactacactcctagctatatggtatagcctattgcatccaggctataaacctgcacagcgtgttcctgtgacgaatactgtaggcaattgtaatgcagtggtatgtgtgtagctaaacatgtctaaataaaaaagcacagtaaaaatgcagtattgtaattttatgggaatgtaacaacccagtgggttctgtttgtccactgcccagatggagccaatttatcaagacaggtgaattgcagtagagaaagagtttaatacatgtagagctggctaaatgggagaccaaagtttgattatcactcaaatcagtctccttgaaaatttggaggctagggtttttccaagacagctcggcaggtaggggtctgggggatgggtgctgctgattggttagggatgcaattatgggatctggaaaatggtccttatgcactgagtctgcttctgggtgggggccacaggactggttgagtcaagagttgtgggcccaggtgggggacatctgattgtcagaagtgcaaaagcctgaaatgacatctcaaaaaggccaatcttagctgctacaattagggatgttcattataggagtaagtgggaaagttgcaaatcttgtgacctccggaataatggttggtaattatttaactctgcctgcatcttagcataattcaggtgtctctcatcctcttaacctggtggctttcattagttttacaaagcagtttagtttttgtgaatggttattatcatttaaactctaaactaaatttctcccaaagttagcttggcccatgcccaggaatgaccaaggtcaaagaagtttggaggttagggcaagatggaattggttagatcaggtctctttcactgtcataattttctcactgttatatattttgcaacagcagtttcaggaccaccttcacatactcagtctatcattaaccaaaatgtcactgtgttgctcatgactgtaatcaaaaaagcacagagagctctctcgctatctggttctatttctaccaccctgacaaccactatagtttgttttcaacaccaaaagaaaataacaaaaaaatagcatcttcaccctcgattctagtttcttttttcttgaaatgactatggccatttctattatttcattttgaaattgtgcagaattccttctgaacatccatctacatttcacagacaacaaattgctaaaaacacctaaacaccactaacctgggggggagaaaaaaaaacaaccaaaaacaaccaaacaaaccaaagaaaacaaatcaaccaaatgaaaacccaccctctctggtggaaagactgcaccatttttggtaaagactttgcaatcctgcctagactggatgactgcctattgccctaacactttccttcctacccccagttatttacaagatcaccccttatggtaacagtattagtacaaatgaggtttttccctttacttaactgaatgctagaagaaacagaatggaaccacatgttccctttgattcacacccaaacactgcaaaacacagagtattcgcttcctttttcaagctgtgtgtgcacattaaacacatgcaaacattggactgaaacagacacagtaagtcagctctaggggaaaactatagaagtctttttattttgtttctctaaatctcaatcttttatttaagctaggtctttgcagagattcaaagaatgatattttgtaatggttctccaaagagcagttagatgtgtctcatccaaatttgtgtatttaccttatcatcacagatactgttctggaactgggaacttagcattagctctcttcttagaaatgactattaatttttgataaaaagaataaaaaacaccacattacataatggatataagagaacatagacggcatgataggaatattctgcctgtgtttccatgaattgcttctttgttaaaaagtgtttggtataaattaggccagtggtgtcccagcactttgggaggccaaggcaggaggattgcttgaggtgaggtgtttggtataaacagtatattaacaaagaattctcctatggtataaaccctaactctagcaggaagatcaaatttctctttgaggcatgcagtctgagctccagtgactctctgcaagagaaaagctgatattgtcacattgtgagtcatagtgactcccaaggatgtatttgtgtggatgtggttggtcagaaggctttgtgtgcactgtgacatctttatgctgcagatgccaagatcacagggtccacacagagcagttcatttcacacagtgggaaatgatgcgtgtgtgtgtgtgggtgggtgtgtgtgtgtgttttaaaaaacctaaacagagcaacactgttctgtgcactcaaactctacagctaaccgccaagggccatcttataaatttggacattgaattgctaaaatttgaaaacacagccactcctattcacactctaccatctggaaataaaccctaagtcactgtgggtgtccatatggaagtcactgttctgcttccttttatcttcatggtagttcaaggttcgatttcctcctagggagactttctgttgttcccattgagccagctctgctgtccccactggtcacgaaccggatcagtacatggagattcctgagcatatgcagggcagcggcatgagagcatctaaaatagagtcattcccattgccccagcacatccttccttcctacattcctgggagaaaagagcagaaacaaaggcttttctttcttctctcttttggatgtttggtgatttgcatacagaagttaactcacttcatctactggattccaatcattcccttcctggttcctgatcttagagtacagggtgcttcttgccttccccttgtcaatataagggctttagaaaacgtgcccagctggtattctttaaacctcctccaacgcacaaatatatttttaaatgcagatatttcatatacaagttgatatttctagtttctttttgaaaatcggaaggtttaactctactgggccagtgttattcatagcattggtcaactggagctgaggagccattgccatttttatggatattcttttaagccccccaatctccaccactccctgtcacctcactcagcttcatccatctgcctgacccctggagacatttgattttgtgcttcctctcacacagaacttgtgttcacaatttggggtcataccttcacatattatatgtaaacagcactctggaacgttttcaaagtcacagctattttaggtatttagtttagaagaggttagaagttgacttttacattagtatcttaaaggaatatatttgcctgctcagaaacatctggggcccacatattcagatctttcgtacatataatttgctatatagcataacacattgaatgattttgactcagtagctcgacttattttttgtgttcttttaaaatctttcatattaagcatagaattgtaatttattgatgaatattttattttctgagaaaagttggttattattcttaaaatacattacctataatgttcatgtttcctatgttttaatatataatattacaatattgatgtgtcgtgattttttttggttgttctctaattaggggtctttatatgaatctctgattacttagcagttctctgaagggggcagtctttcagagatgcatttaagagctctgaattctgttaagaatattaaggaacacaatttttaatctttactttttactccagggctttgggctgtctgtatcaaaatgcttcagatacttcctctagggattgctttgcctgttccatccttaagagagtaaagaatttcttctccccaccaccccccaactcctgacaatttcagctaaatttttttcttccattgctttaggccattgcttcaagttatatcaccttctgagactatgaataattctttcccttcaattatattgttaccttgaaggtatttataggctgtgatcaaggcccctggagtcactgctttggcagactttataaatttagctcttaccacttctcctcacattttttatcttccagcctttgtagcactccttttgtgtgtgtgcgtgcctatctgtgtagcttctctgatattttaatatccttcctaaactagggaggtcagaatagcacatcatattccaggtattactgtgagtatcagattttagagagtgaaatcaagggagaggattaccttgaaattgaacttaatctattttgtgactcagaaaaatagacaaaatggtagaaaaagctaacggggcactgtcaacatgttttcatatattttaacgtactgttagagcaatcctggaagcttaagggggaaatgatgatttttcttagagagaattctggcttccattagatgcttgaacgtgtcctttagagtaagattttctttacaaatccaggcttcaaatatggctatgtaataagatgggttttttccatagtacatgagctcttaaatctgtattattgttattattattattattaatattatcagacctgtctttgtggcttaaaattaagaaacatcattaaacatttaattttacaatgaagaaaacaaattgctacgtaaaccatcttgctactagctttaagctctagtccaggtcattctgcattttgtcaatatagtaaattgagtaacagcctctgagggccctgcaaagagccaaggcccaatttaactccctagtgccagggtctccaaatgtttttggttgtctatacatactagaaaaaaattaactctgcaccaattaaaaatatgtatatatgtatgtagaatacacacattgcttatattatcacacatacagaaacatcaggcattttaaaagataagattagatacatatatatcccagtattattccctgaagttcccatgaaccaaccttggcacccctgtggatgcccaccccaacttggagaccactgctgtggtgggaaaaccatggtgacaaacggagccaccaccctcagcagttcccaggaggaaccccagtatcaatggttatgtactgcagagcctataagcgaatatttagttcagacactcattttagatatgaagatatggaggtgcagtgacttacctacctatggttacagagttggatgatgagaaagctgggtgtaaaatgccagccttctaatttatcagatttcaacacatgcagaaaatacatagtgttctgttttagctggaatctcaggaaaatggggactgaggtcctgaatgaatgatgaagaaggagagggtgaatcaatttccaatcggtggtcttaaaggtgaaatattgttagcctaagtaatctctactcttttgtgtcccttctattaaactctctttacaggttctctctctctctctctctctctctctctctctctctctctctctctcccacacacacacaccccaagataaaatccaaagcttctgattcaatagccaacctcttcagcaagaagagcaaaggttctgcagccagattgcctgggttcaaatcctgatcctatcactgaatagcagactttaggcaaattatttatctatgactcagtttcctcatccgttgaaattggggataaaaaagttccataggggttgatgtgagcattaaatgacacctgtaaagcactcggctcactgcctgatcccacgctaatggccctttatatgttagctatttttattattttattctaattcttcctaaaagcttaaagcacagtccttcatatcactgcatcgcatttcattttgtaacatgttcttgtgctacatgtttcaccatgtgctacatggtgaaaggcattttcctacccgctttacaaaaacagacaccgaggcccatgtttagggccaaaatcagtgctgaatgccaggacagactcccaattcagtgtctcgtatcaaactgcatttcctttcaagatgaaaattgttactcaaaaccctatgcagctgggcgggaacacagattccatggtttcctttttcttcctgtttccccaaagcaaagcatctcctctctttgcatgggggatctatccctccagaagtctacccagcctgaggataatggcagctgcagggttacaggggtaactgtccatctgtctgaattctcagttgtgtgagagcctgtgttacaaccttagtagcttctgcacctcactagcttttcccactcccttggagtgcttccattttctccagctttcggtatcagggagtgttattaaatgataaggagctggctggctggttgtgtattgtgagaggctgagaaacaatgagtgttacaacacattagattgcatgttagctctgattttgggaactttgtatcacagagctcatcatgcaacaggactgcatctgggatactgcctcccttccccagagggttattaatgggccttcatacctgggaggacagattacaggagagatgtgataattagagatacttcactgatcataagcaggcccccgagcaccaagggctagcagctgtgttacacatatgaggcaagctccatgctccagagacaaaagtgaagtagaatttgctgcagtgaccttacctaaaagaggtcatctcaaaaatggtcacccatggacattgattggcaattggtttgaatagagaaagagtgttctgagctgaggatcagaagacctgagtttcatttctagttctgccatcatagagctatagggtcttgatgaagagtcacttaacttgtgacagtttttttatataagaaaaatgggagctacatatgtcttacttatcacaagagattgcaactcaaatacttcttcttccaaggtagtagggtggcaacaagagtgtgtgtgtgttctgacgataaaggaaatataagaatattttgaagcaaaagaaggagccagtacaaaggcagaaattgacaacgcatgggagcagaagtggataaaattaaccaagctggggcagaagaaggcagggaagggtgagagaaaaacagtagacggcttaatgtcatcaccaccacaacaaatgatggtgataacttgatgctggtgatgatttggagctcttcctatggagtaagaaagaatgcaagaattgggtcattgaccagaaactctgaggaggaaattaaagaaaattcatatctaggtgtcttaaacttctcagtaaagaaagttttaagctcatcaatcaacaggggcaggggtagatttagggacttgaagaaagtataagatttttagaatgatctctttgggggatcccaaaataagtcaacaaggcatcttttcaatgttgtcttgatctcggagtcagaacaacttgggtttcaacctagctctatcttttttcctcctagagcacccttaagcagatagatgcccataccttacccatcagtactttagggttataatctatatcttgcaggcatgttatgaaaattaaatatgatcacatatgcagtgtgcataacatcatgtttggcacatagtagcctgtcattattttggaaaagtgaccataatgaaagagaatgcatcaaatatataggattgttaaataacaatgtccaatttagaagctgagttgtgttggcctatctgcttgcaccaagattaaataatattctttacaggtgtctacacctttttctctccaaggcatgtcttcagcctcagtgctttcatggctcatattttctcctctcatgctttcctacctgctcatatgatgaaccacatagaggaggtgattctccgaggatttataatgtgtttcctgtgctcctgaattggtgccaatggcacaccaatccagtcgggtgggcctcaaggcacaccttgctcctgactgagaaggaaaaaatctttgtggagtttgcacaggtataccaagtaattgagcatttgcattagtatggaaccacctactacagacaccgggctcgtttcactcaaaggatagcctagaataagcatgaaggacctcctttcagaatcttgtttatgtaaagcccttcttggatttcctctttattatattttacataattgatcacaaatgtgaacatctatggaaatgagttggagtataggcgataattaacctggaagggaagaaaacccttcaccagaagcaaatagatacccctgcaaatatctggtaatttcggccgggcgtggtggctcacacctgtagtcccagcactttgggaggctgagatgggcggatcacgagctcaggagatcaagaccatcctggctaacacgttgaaactccacctctactaaaaatacaaaaaattagccgggcatggtggcaggcacctgtagtcccagctactcgggaggctgaggcaggagaatggcgtgaacctgggaggcagagcttgcagtgagccgagatcacgccactgcactccagcgtgggggacagagcaatactccatctcaaaaaaaaaaaaaaaaaaaaaatctggtaatttctctttcattagaaagctccaagtgaggtacaaactcaattcaaatattctatgagaataaaaacaggcttatacccaaagataggcaataacaaatgctggtgataacatggagaaaagggaaccactgaacactgttggttggaatgtaaattagtacaatcactatagagaacagtttggaggttcctcaaaaactaaaaaattgagctaccatatgatctatcaatcccactgctgggtaaatacccaaaagaaagaaaatcagtatatcaaagagatatctgcagtcctatgtttgttgcagcacttttcacaatagctaatgaatggaagcaacctaagtgtccattaacagatgaatggatagaaaaaatgtggtacatatacacaatggagtactattcagtcataaaaaaagaataagatccagtcatttgcaatcatatggctggaactagagaacattatgttaagtgaaataagccaagcacagagagacaaatatcatacgttcttacatatttgtgggatctgaaaatcaaaacaattgaactcatgggcatagagaatagaaggatggttaccagaggctgggaagggaagtgggggttgggggaggtgggggtggttaatgagtattaaaaaaaaaatagaaggaatgaataaaacttatctggtagcacaacagggtgactgtagtcgataataactcatctgtacattttaaagtaaagagtataattggattgtttgcaactcaatggataaatgtttgaggggatggatactgcattcttcatgatgtgattattgcacattgcatgcctgtatcaaaacatctcacatacttcataaatatatacacctactatgtacccacaaatttaaaaaaaatgaataaaaacatccttcaaacgaagtggctattttgttgcaaaaaataactattacttctcaagcactgactgagtgccagggtgtatatgtatgtgagtatgtgcgtgtgtgtgttttgttctgttttttctcttgtaaatccgtcaaagattgcaaaggtaggaactattatcctgatttttcaagtcagaatccaaaatttagtgaggttaagtgacttgccaccatgcttgctgctcacaagtagctgaggcaaaatttgaatccattttgcctggagcccaagcccaggttctttctcctaactgggatgtcctgatgcctacacaatctgctcagtgaattactcagcctccatgtttttctattctatggcacccctacgtcatactagccactagagtgaaaagtgataagatgaaaccaagagattgtcttatcagcttctccattcacatgtcttaaatgatttctacctttactaacaagagaaaaatccaggtacattctggggaaaccattagtgcttagttggtaaaatcttgagacttttatcttactagtagaccctcaacatttttccaaagaggcactaatgtaccctgtaaagaaatgacatttttcgtctcaaaaaaaagcaaaaacaaaaaagaaatggctacttttcaccctaaaataaaaaagtgtgtgtgtgtgtgtgagagaaagagagagagagagagagaatgaatctatctccaaatgccaatgagcatgatggactagtggcaagactttctacagaatatgtaatttggtttaggcagggcaatctcctttgtatgaagtaaatagtaaattcagttacagtatatataaacattaagaagaatcttcttctgtttaaatattgcttcttaaaatttgttttgctatttaaaaaattcattttgaagttacaagtgtctctcctaaggagacaattctctgacaaacataaccaactggcaattacaaatcataattgtgactcagaccaatattaagtgagcaccttcctgctttctcgtagatgaatgtctataagttgttagtgcacatactgaactagaaagcccacatcaggaaggtactgctctttttttgttactgttaaatttgcttggccaactcagaatgaatatccagatttctcaactcttgagttagtggatatataaactccaaaaaaattaattaaaattgaagtttaaattttaatactgagaaaaatagttgattagctagaaaaatcaccctaaacataattatatgtatcagtaagtcaaggaaaaaattaaatttgtcaataggtccctattctccagtgctgtcttttcaaagttactttgcaaggtattcagttttagtgctaacgtatcaatcttttttttttggtgggcgggggatgggggcagggtctcactctgttgcccaggctggagtgcagtggcgccatctcgccttaccacaacccctgtcacccaggttcaagtgattctcctgccttagcctcttgagtagctgggattacaggcacgtgctaccatgcccagctaacttttgtacctttagtaaagatgggttttcgccgtgttggccaggatggtctcgaactccagacctcaatgatccacctgccttgtcctcccaaagtgctgggattacaggggttagccaccatgcctggctaatgtatcattttctagaatacatttatcaatgaaattttcaaagaaccttattggtatggtgaattatgtaaagtctcagaagattacttttgactttccacggccagatactcttgactcacttctatcaatcatgcattggaaatactctgacatcgtcaattctaccgtgatctactcaagcatctcacctgtttccttccagaaagcatgttttaatgttggagattcattggctagtaaatgtatagtgtcttaaatgatgtcaaatgaagaaatgccaaaaacatgcccaacaggaacagcaaagtatttaccttcatgtgtaaaatgccagtgtgagatagcccaatgtgatattgaactggatcaatggtggggtgccagcacatgaggaatcgacattaattcaagttgggacacagaagttggcattgtgaagatttttaaattctaggactaaatggatgatccactgggaggcaatgtccagacagatcaataccacacaaaacgttaattgcttttcttggtgaatcctaagaaagtgctggggctttagggaaattgagagagatttcttttcttccccctccacaaaaggtaattaatgagtacaacagacaattcaaagcaagaaaatagaatctgaaagcttgaaagccatacattcagaatccatttagagatttacagaagggctttagcccagaacagtgcctacaggagctacagtggtgacagtgtctccttgatagatgcatcctggaatcttctactgggcaagcatccaaaaatatttgaacaaatgaggtatgccttccagcatagctgggtagttagaaaagagtcaaacatatagaaaaaaagcatagtgactgaagtcatcttaaagctagtttacaaatgtagtctgaaatacactctatcacgggatgaataggtatggattttattccaactatgatctactgtgctttctgggactgtaaaaagtgactacaccatccattaataatatataggaaggcagtttgggaatgtcaacccaaagcctcttcgtaccttgaaattcccatgcaatttggttacacagagtatatcattactcaggttaatattataagacaagtattagcattatgtttgaacaaaggttttcacaaggtctatattaactttacaaaggttctgctgtatactgaatgacaaaggctgtcacagtagcgaccaatttgttccaatttgcttacttctccagatctctctgtcagactttaagttccttgaatatagggtcctagtcttcttgcccatccttgtatacatggtaggtgttccatcaatgtttcttgaatgaatgtataaaaagtgtattttaattgaaatcttaacaagtatgcattaaatgtatagttggtgcttggtactaattctctcaccagtttattgaaatttgactatatttgagcttgaaatggtatacctacagatatagatcattaaaaccaaacaaaaccctttctttatgatatcaagagatttgcctcctaacataaaaatgaataatcactgtctaccctaatggattagactttcttcattagcctcctgtttcttctgagaaatggctacattttcagaaactctgactcctaaagggggtcagtaactctgggaagactatttctattacgtgaaaatttcaaataatctcctagaaacttgaaaactggttatacacagaaagcaaaagaggtgaaaagtgagttgcagtttcattaaacatggtcatcctccaacaccgtctttcttaccagccttgcatgaaacgtcattaagatgcatcttttatgcaagggaccaaaaagggtactacttttaaaatatagcaaaaacaggggttgcagttgcccttttattgagggtcagtttatatatgtagtctgatatatatttcatccagaaatatagttttttaaactttttatcgtgaaataattttagatttgcagaaaagttgtaaagattatatagtttctttaaacccttcactgagcttccactaacgttaaaatattatgtaaccgtgatacatggtttgaaactaagaaattaacatctgtacaatacaatttgctcagataatcccagtttttccactactgtcctttgtatgtgtcagaatccaatccaggataccacattttatgtagctgtcctgtctccttagtttcttctaatttgtgataatctacaaatactttttaattgaaagaattatctaaacgtatatttgtcagatcaataccgtcctttctatctttcctttctccactgaacttgggcgtcagtctctttcttggctactaactctaatttatgcattggatattttactactttgggctcattattttaaaaatctgcaagcagacacagtagtctaggactgttcctgaggctggagggccagggtatagcatgtgcgcaggccaccaaggccagccttgtcattgattctgctttgttaccaagcaactgagatcgctcccactaaagaaaaagaagcaccacttccacttcaaaggtaaatgtgttgaaaaaagaacagaattgacacagcttcctttatcccttaggtacaaggatgccatgcctagtcagagttctgaattcaggttctcaaagcaggaacagggagatgcagcagctgcagttgggaactcttctttctttctacattttttttttctttttgaaagtccacatctctatcaatccagaatcctaattacatatgatataaagggccctcaaaagacccattacccctgttaaagtatgtaaattcaggggcaaattatatgaataatggctaacatttattgagcgcttattacatgtcaggcactgttcttctaagcattttacatttaatccttacaacaaccctgtgatgtaggactgattattaatactattttacagataagaaaactgaaatacacaatagataggaaaattgctcaaagttgcacagctagtaattgaataatcttccaaaatcttttttatttaggtaatagtatttttgataaataatttatatattttatgaagacctttacaatgatggtgttattccatttccaccctagattaaattagcatcttgagaaaaagccataaacccagtgatcaaagtcgatggtatttattttatgtttaaaaggtgtcatctctatcgagtagtcaagtgctaaaaaaaaaaaacaaaaaacaaaaaaacaaaaaatccagtcaacagaaacttaaacacttgagggcaaacattgagcaatgttggggttttgttaccttgcactaattttgggtttaagaagggaaggaaatgatgttcgtaatccagtgttctggaaggaggagtgcttttggtagattaatttacaaagttttctgctgacaaaagaaagggaaaggaaaaaaatcagataataattccctttacaggcctaatttgaacttaattctctctctctctctctctctctcacacacacacacacacagacacacacacacacacacacgacaactgtgagctgtaaatccatggtcatctagttactagcgcagtaagagcagttgtctgatctgatcaaagagtgtcatgctccaaaaaatctgatctgtggtgaaaatagattccccctggatactatccagggattagatattttcagagaccaaaaatacagtgaagtgccctcagcaagatagaacacagtgtagtcattcttggtgaattggaaggattttgccgcagggctgtcattatgaacatcagtgatcattgtaagaatatggaaaagtgctagtgaataggagtcccaattacagaacactgggtgatacagcctttgctataattatagtgtgtttagattgatgggcctaatgagcagtgttccttaatctaaatgttgattttggagcgagttaaaattagaggtaaaactgtgatagtaagtttgtttactagattgactatgtggctccacgtagaattcagattagttcaactaacacttcctcagcaccaaacccttgtcaggccttgggctaggtcctggagacccaaaagcagatgaagtcctcagggagttacagcccagcatgggagagggcatttcaacggcattagtaatagcagtggatatgaattgagcctttgccagatgctaaacacttgttctaaaccctctgcgggtattaatccatttactcactccaccataaccccacaaagttgggactaggtgagaggggagccaacaggcctggaagactacagtaacttttccaagcttatatgtgtgataagtggcagagcagagcttaaacctggtccggaccttgggttcttaactctaaccttagtattccagagaagatttcaatatacagtagttcactgtcctgggaccaagaagaggtacaattaaccatgttgcctatgctgctggtgatgaagccagaacgtaaacagaatgatttatcctcactcctttgttcgtgaacaaaggaaccataatcccccatgaaccattctggcctctttactatcctccagacaggttgatcttgtttctacctcagagcctttgctcttgttgacctgagtgtcccatcccagataccgttgtatggcccttccactcaatcctttcccacctccctccaaatgttaccttattaatgaagacttccctagctcattctattttatctgcctttcttccttatcccacctccctgcagttccttctcccttaccctgccttactttttcccacagattttaccattagcaatactattaatttctttttacttgggtttttgttggtttgtgtgtctgcctccccacactagaacacaggctcccaggggttagtgactttttaaatattgtttgtcactgaatttccaatgcctaaaataggacctgaccacatctgagtttaatatatacttttagatttagtgaattaaaaagccagaatgaggctgggcacggtggctcacgcctgtaatcccagcactttgggaggccgaggtgggtggatcacgaggtcaggagctcgagaccagcctggccaacatagtgaaaccccgtctctactaaaatacaaaaattaactgggcatagtggtgcgcccctgtagtcccagctacttggaaggctgaggcaagagaatcacttgaacccaggatgcagaggttgtggtgagccgagatcatgccactgcactccagcctaggcaacagagcgagattctgtctcagaaaacaaacaaacaaacaaacaaaaaaaaccaggaagaacatattccaaagtgtttaaaatagttatatctgagcgtcggaattatactattttaaatacacttttaccaagtttcctataatgagcatgcgttctatgagaaaagggctaaaaatagatgaaagttaaacattagtcactaattcatctcataaacctacttactcctgggaactattaacttctgtgttattattgcacattgggtttttatacatggtagatgctattatcgaggatcccttggggaaggtttgtgtatgaaatgatcatttctttcctgcttactccagattgagattgccagccttgactcacctgagcgggagactcacatgtgagactgcccgtgtgaagagcttccactgtgatacccagtaggcatctgaaaagcatcaggtccaaaatggaattcttgatcccccaacctgctccttacagagtgatccttgtctcagtaattccaacatccatcagttgtgtgatccaaaaacttagaactcatacctccctttcctcatgcccacagtttgttcatacaaagttctatagaatctacctcccgaatacattcaaaattagaccacttctcactgcaactcaataccatgctcctcacttccatctctactactcgaagccactcgagtcatctcttacctgaattgctgcaagcactttccagctggtatgtttgtttccaatcttttatttcattattttttaagagacagggtcttgctctgtgtcccatgctggagtgcagtggcacaatcatagctcactacagcctcaaactcctagagtcaagtgatgctcctgtctcagcctcttgagtagttgggactacaggcacacaccattatgcccagttaacttttttctttctatagaaatggaggtctcactatgttgctcagggtggtcttgaattcctctttctagttttctctgacactctcactccctgccaatcttttctcctcaaagaagccagaatggtattttttaaaaaatataatcagcctttattaccaaccacccccaattaaaatcctcatgtagctttatattatattaccaatccaatctaagtgcattaccaaagctttgaagaccctgtttgatcctacctctcaataccctccagaacatcctcctcgtctaccactttcctccacatctaccacaccctgggctgtttgtcaaacatgcctggtttgttctagctttgagcttttctctgtctgggagacttcttccttcagcaccagagctgacttttccttgttttatacatagtgagatgtcagctcagatgttacctcctcaaaatgatctttttgatcatcataacttagtaagctctctccctccaccagtcacactgtcccacatctcttcattctgtccagtattagtctgtaattaccatgtgcttacatgtttaatatctgcctcacttttgaatgaaagtatcaaggggaaaaggaatgtgactgtttaaatcactgctataacttcagtatccaaaacagtgcctggctcatagtgaacccttcataaatagtcactgaatgaaggaataaaggattggagcaatgaatgtttttgtgacatctagatgaaaattagagatgataaccggtgcaattttgatcatctatctcccttcataccagccaccctaatctaggggactagaataccgaaagaaaatttgcttctacgaacaaggtaatgtcatgatatggactgactcatttatttgttcatttgttcattcattccttcatcattcttcactcatcagacatgtagtgaggactttctttatattaggccccctgtgtttggttttctgtcagttatcttagggtcgtgtgtgtgtgtgtgtgtgtgtgtgtgtgtgtgtgttaaaggacgaataaagtaaataaactaatgcaatgtaagaagtgttgtggttttttagtaaaggttataaatctagacttatgtgcgtattgttttgagaatacaaagaaaggtgcttctgtttctgtttatgggaagtcactttacagacatttatctttaagtcatgatagatgaatttctcatatgggcagttttcctaaatctgagttttagcataatgagatctggagaaaaagaaggcaaaaaaaaaaaaaaaaaaaacccataggaaatgatacagagactaatgatcatttacccaaataaaacagataccattcaaagttagacactgagcctctggtaatccctgttcttctccttcatcttgagcgagggatactgaaaaagactgggctggctactgtttaatcagggaatgatgaatacttttcattagcccaagaaaagttagtttctattccagaaatattttgtaaagaccagttaaaattattaactattatgcatcacttgtcaactataggaagcattactgcaacctctccatagatgattagaataattgctgtcctttcatctttcccatctaacaatactcacccagtacctcccactttcgtttgtgtcttagtatgctgcatgtatctgctttgctaagagaacatcaaggcttggcataattgggctatttccctgtcatactggtttgcttctaaatctgcctcctctgtgggttgcagtgaggtcaatcagatgcagtcaaatggcagagaagatattaaaagtacatatatcctagaactaaatatacaccatctgtgaacttcagttacaaagggaaacttctcttaatatgaccttaggtaaagccattggcagttttattgtatctgtcagcaatcaccaatagctttgattaacaacatgactaatacataagttatgttggtctctttttttcataaataataagagatagggtttctaccaacacaacatttctcatacttgcctgatcattagaccaactgtggcacctgagaaaaatatgccacagacctactaaatcaaaagttccaacaggcctagggatctgtatagttcataaaaactccaggggatttgattatcaggcgaagtttggggagctttgtatgaataatattcaatgaattgtttgtatgtctgtccgatgctttccagactgggttaatgcctgggtctctttctttaattaagctttgattaagatgctcccagcaaatcccacactgaacatttccattgccccctccctcccccgcttctactatgagagaccgagatccatgtgaggtattctgtgatgaagatcttgttctgtttttattattaagcgtacatcttccccttttctgatattaccactatgcatcatcagttaagctgtcaccaacctgacctctgaggcattggaatcattcacttgatgaagcttactttggcataagctaagggttaggaaaaccaacagatttctaaaatattgtgcatggaagggccactggaagtcctccatcacagcctgatagctacaaaaatgagggaacaaaggcccttgagggacttgccaaagtcaaatagtcaattacagtgagagtttggactaaatctcctggttccaattattacattcttcctatgacaccattccctgattcctacaaccaaattagcctcctctttgagctttagttttccctctaggaaaaaaaaaaaaagcatgttagacgaggtcagggactctaaaactgagaccctaggttcagttaaaatgctgggaaggctactgtgataggggtggatgtcggagaggaaggacagaggtggggcttcccctagttatatttttatctgattgggatattgaaattatattaagaatttatttggaaaagccacttctgttactttttaaaaaaagatgtagaggcacaaggctagatgttgatccttgagtgcagatctgattcttacatttggagatccttagaaaagaagtctgtgaaggcaagcatttgtccttttttgtcataaaacctgattcttgggtattcagtgaatgacactcattgaccaactgcaggtctggcatgatcatcacaaagaattggcactttgaaagtgagagaacagtgggaagagaaattcttaggaagcaagctatcttttctaatcctctttaaaaggccaaaatgttcacaactttcccctaaaacagaaaggtgacattgctccttaagcagcagtatcatgcatgctgtcctctgccttcctaagaagtgcagacagagggcagaccctccgagtgaagtacctttttttcttatttgagcctgctctgcattgagggagagtttgacacacctctttagggttctgagaatagttaacagctctaagaaagagatttttgttcataagaaaaaacaagagaaactggaagcagttctcattcatattctctctctcgccacaccccccaccccacctcctcccgcctctccctctccctcttcctctctctccctctcttcagtatctaatgtaaacccaggctttctttatgttctgtgcagttggcctgagttctcttctgttttggtcaagattcaagtggaaaagacctgagcctgtgtctgcctcctttctcctaattttggtttctaatgttttacccaagaagggactagacctttgtttccctactcctttatcatagcatgctggttctcagaccttttctgcacactgctaacatccttctcacctttctttgcttggctttttttttcactgcaagctctcccatgttcatttctcatttgccatcagatttagagtaactggcttatggcatcaaagaatgaatcagatgggagcagctaagtaaactgaatgaagctgcttcctttctcttttcccatccacaaatgataaaatagcctgcccagccaagtgacgtggcattcaggggttatggtggcttggccatttgtttaagtttgcttatttgcagtcacagttctttagtatttcagtgatttggttatcactcaacagtgcacacatttcttctataaaatttgatagttacttatctatctctgatttttccctctgtgttttattatatctagtttaatttttcccctttgttgatttctgttttgtatatcttgttgcgggatatacatggaagggagacgagtttccaaagataatatagatcccagtttgcctgtaaattgataacaccatttggaaacaaatcttaaaacctcactgacacagcataaatagaatttacagatcttcttgaagcaaatccaaatctccagactctactttctccattctcccccactcatcctaaccttcacgtacagggaccgcgttaccaagtgagccaactagactctttcacacctctctgcctctgcacatgctgttccttggccagaaatgccttttttttctgctttacctgacacatttagattagtcttttaagacctaatagaaatgtcaagtgctctgatatgccttcccagatgcccatgagcaaagtcagatgttctgccttctgttcccctatggtactttactgatgtccctgtgacagcttcctgccactccagcccactcagttgggagaacttcaagaggtgaacaaagttttattcctttttggattcccagtgtctcatagaccttctgggacatatggcacattcagtctagctgaatgaggtgatgaatcaatccacttactctctccagtgcctgaaacttctcaaggagcttgtgctctcctttgctcctctcttttcaaccaatctgaaaatgcttttaaaagataatgtctgttttccagtgcagtcttctcacttggcatgtaatttctccatttttatttcctttgtgaatatcaaggtacaatttccatagctaccagtctaacctggaatcttttcatctcagttttggagttccacaacagtgtcctggtggatctatcttctatatattcctactataatgtacactcttaccaggtaccaatcagttgtttcaaaccacatttctactaaatgacctctctgaagtgattctgaactggcttccctattagatgaagaccaaacctctactctaagcacttaagacaaatggttgcattcatctcaatgctccttactcctcaatattatccattacatttttttgagacagattgttattctctgacagattgttattccttcatcgtccaaaaggagtcctcactttgcttagactggaacacaaaattttatctattttaatgttccgtcatataattataattatattctgttatctattccaaattttcagaattttatctattgcaaattttaagtattccaagttataaacttacgtcttccaaaaagactaccaggattaaaccaaccactgaatcatcatttcattacttcatattactacaagttagatttgggacactgtaatattttagccctgattttgccctttttatagtgtccatagataatttaacttctttgtataaacttccattataaaatgaagttttttatatatatatatgtatatatatatatatatataaaacattacacatttaggacatttcatgatgaaataaaagtgtttcaaatagaaaatgatggtttatttgggtttataaatcaagaattctcaagagggtatgaaacccacttctcccttatcaactctagggattttctgtagttttgaaatttgaaaagcataaagtaaaattattatcattttgatttgcttgtagtcataatatttaattcacttagaaatatcaaataacattaaaagaaaggtgtgaaaatggctgcgctcagtggctcacacttgtaatcccagcactttgggaggcccaggtgggcagatcacctgaggtcaggagtttgagaccagcctgaacaacatggcgaaagcccatctctactaaaaatacaaaaattagccaggtgtggtggtgcatgcctgtaatcccagctactggggaggccgaggcaggagaatcgcttgaacttaggaggtgaaggttgcagtgagccaagatcatgccgttgctctccagcctgggcaacaagagtgaaactccatctcaaaaaaaaaaaaaaaaggtgtgaaaaatagggtagaccacgtgtgctgttacagtagaccccaaacataaaagatgtttatctcactcatatacacagtccaatatggttccagttggtgagggttagggttgtcattctgggagttggccagtagagatgctaccatcttcagcatgtcttccaaaagcttcctggtatcaaaatccaattgttgaaagcagagagaacatgaataagttcatatggaaggattttatggactaagactaaaagtagtccacattaattcagttcacattccactaaccacatggacacccctaacttcattggtgactaagaaatgtagtctagactattcccaggaataagaggaaatggttatactggagaactagatgtctaatatatattaccttacatagttatcaaagtcatttttagtttggacatggtctttactaatgggttgcaaatgctctttatgcagatgttttatgttttatattactttcctatgcccaacagcataaaatatagaagtctggatggattaggcacttgatgtgtgtattagcttttgattgctatgtaacaaatgaccacaatgttagtggcataaaacaacatatgtttattgtgtcacagtttctgtgggtcaggagtctaggcacagtgtgactaggtccccagcaaggctgtaatccagtcgttgatcaagactgtatttctcatctaaagactcaacaggggaagggtctgcttccaagctagctcaggttgttgtcagattttactttcttgtggcagcatgattctttgaagaatcaagaattcatggttgcttgcttcttcaaagccagcaacagagactaaatcaaatctagccagatggtcttatataatgtaagataactacaggagtgacatcccaacacctttgtaatattggttaagcaaattacaggtctcatatacattcaaggggaggggattttacaaaagaatgactaccaagaagcaggatcactggagcctgtccaccacagtaaatgactgaaaaaatctgggtattccagagaactaccactttacctgaacatagctctttacacaaaactacacagaattatgaaagatctcaagagaaaagtgttccttattgccaagagctggttattatgctagtaaaatcagcagtgctcaggaacaatatttgctaagtttcacagttatcaaccttaacccacacaatcatctttagaattggatccagaacaagatgggaccatcttaaacctggtacattctcataaggttcattctcataagaccctaaagccttcattatatggcatttttgaaactcctttgtcattttaaatttttgtctttcctagctcccttttcctctactattctatctaacttaggcagcattgaatttcatttttttttctccttagtctttctgtttgacattttcccttctagcttcatttgtcctttaagacaaccccataacctttcatctaggggaaagaaatctaaaagaaagctctagaatgagattttagttgacatattcaatttgctttagaggggcatcacccatacctcttcttccactagtgagatctcctgagaggtgaaaatatgagagaatcagagctgcttatttatatatcaactatggaaagatctttcctgcctaatctgacctcttctttgaaactccaaaagtgactttttgtggttaattcttccaggatatctatgatgcagtcccacagatattaaaggttcagggcatcaaactgaaagatataacagctctaatagacagagtcacatttctaaaaaggaaaaccaaattctgaagatattttctggctctgtgaacagctaaaaatacaaggataatcgttcctatagtcctggacttttaacacggaagctaacttggaaggaaaaatgacactgagctataggaagagaagaatagaacagacttcagtgaaatcggccgcttttcttttcaaggcacttattcctagattagctcatctatctttaagtttcatatgatttttactatttggcatgacttaaaactaccaagttggtgaaaggtacataggaactctctgtactattttgcaacttctatgtgtctaaaattattttaaaataaaaggtagcaaacatacaaacaaaacaaattattgagctgggaagtgttccccttgcaaaagtctagcaactggggtaaaattgtttctttgaatacaaatgcctagtctctgattaataaaataccaggaagaggaaaagaaggagctgaagaaagagagaaagaaatagagaaatggggatttccagttgctgtagatcttgagtaggcaggaccttagcacatggtatctaggtgcatattgcctgtcacttttcaattatctttgctggccctgcctcaatcaaagcccaaaccataccccaagggcactctgcatcgttgaatttatagatgagatctttcttttgggataaagagctattctcaacttgactattataccttggccttcattccctaaagaaaatgggcagggaggcttgcagacagaagtatatagtgtggaaaatgaaccacctcttttgactctttgcaagatttgtgatgtcctactgggatgcctgggcccaggcacattcaccttgattctacatcagagacttctgtgtcttctttctcatagtatgggttattgggttgagcaaatactttgtcatcagtgtgtcttatggagtaattgagagccttggatttgaactcatatctatttgggctctattttgggctgtgtcacttatgaactgcatgaccttgagcaaatcactgaaactctctacagtccagattcgtaatctattaaatggggctaataatacctcatgcatatggctgccaacgggagttagtgaaataatgtacatgaaatatttaacactaaacttggtgcctaatgtatcttcagtaaatgataactattgtcatagtcatcattgcttttatacttttcggcttccagtgatttccagtgactacagccctaaggccattgggggatatcttttttataactgaattttctttataaaacaataactgattttttttttttttttaagacagagtctcgctcttcttgcccaggttggagtgcagtggcacgatcttggctcactgcaaccttcatctcccgggtacaagtgattctcctgcctcagcctcccaagtaactgggattacaggtgcctgctaccacgcccggctagtttttttgtatttttagtagagatggggtttcaccatgttggccaggctggtcttgaactcctgacctcaggtgatccgcccgcctcggccttccaaagtgctgggattacaggtgtgagccaccgcgcctggcctaaaacaataactgattttttaaagaaacatactcatgactatttgtcattttagtcaaagaggatggagaaaaacagggttcagttttattttcagttcaatgtttcgaccatgacatccagtgctggcttgattacattttaggaaactgaattccttctctaaagaaatagtccaaaattaaacacatatggttactgtaatcaataataatgctaaccaagcatgctggctcatgcctataatcacagcactttgggaggcagaggcgggtggatcatttgaggatcacaggagtttgagatcagcctggccaacatggtgaaaccccgtctctactaaaaatacaaaaattagccggttctggtggcacggacctgtaatctcagctagtcagatggctgaggcacaagacttgcttgaacctgggaggcggagttggagtgagccaaaatcgtgccactgcactcaagtctgggtgacagagcaagactctgtctcaaaaataataataataataataatgctttgtgcatttcaaaattactaaaagagtgtaatcccaggacttttggaggccaaagcgagcagatcacttgagatcaggagtttgagaccagcttgccaatatggtgaaaccatgtctctactaaaaatacacacacgcaaaaatattagccaggcatcatggcgtgtgcctgtagtcccagctacttgggaggctgaggcaggagaatggcttgaactcaggaggcggaggctgcagtgagccaagatcccaccactgctctacagcctggccaatagaggaaggctctgtctcaaaaaaatatatatatattatatatatgtgtgtgtgtgtgtgcatgtatgtatatatatatgtgtgtatatatgtatatatgtgtatatatgtatatatgaaaagagcagaatttaaatgtttttaccactaaaaaagatatgtgaagtgatagatgtattaattagcttgatttaatcatttcacaatgtcaacatatataaaaaatcacatcatactccgtaaatatataaaattgtaagtcaactaaaaataaaattttaaaaagggaaacataataacttttattattttgtatttttaaaaatcaaagttaggacacatattgagtttctctgctactcaatgaactgaaggttttggaaaacaagaccaaaaaacaacaacctccaaaaaagaaataaaagaagatcatagttaaggcctttcatgcagtcagctcagggatcaagggtagatctcaacccgcctgtcactgagtatgcagtgctcacagatgtggggaatacctatgtacatcacagtcctcagggaactgtaaaaccagttgcattgaccaaaccaaaacacgtgccattagaaagcatataattgtaaaccaagagcttcttttccgtttacctaagataattgcagaggctttagtctaagagaatcaaagttaagtgatagcactgtcaaaaaggtttcttaaggaagaagatctaggggttctcgggattcgttgaatttgatgccatggctgaaaaattaagtggagatacactgtatgccattggagtcaggcactcatgtgaaagatcagcactcacatttaggaattggatacagctaacagcaggggaattgataggctcatgaaaagagcatgggtagaggatgacatagaaaattaagcacagttagggaagacttaccagccaggttacaagaagcaaacacctatcccaccgattcagaataccttgcctcactcctgcatgacaggacatgtgtgttctttacgttaactgagaaactgaggccagataggaagacagatgtggccagaagaagttgacattagtaatgagagaaataaacgaagtgattttggggctggcgttaactatctagaactacccaggagggtagatttagagacacttccatctttgaaatacccagaagtctgtttctccaatgccttgactctgcctaaagcagtctaccattaatctctgaggaatctcttcaaacagctttctgccaatgtatcactgaagccttttgagaaataagtgctgttccagcttagtcatatctcaaggcagcgtggcatgggaggtggagactacgagtaattaaaaataactcccagctcaagcagggagagggctgtccctgcctcatctgtattcccatcacaggctccccagtgagaccccagctgttgagcaagagactctgtagtgtctgatgcactcaatcttgagttgatcacaaaagaatgttaacaacgttaagggcatggagttctaggttttggaagaattcttaatgattctgttaaagaggaagaaataggaaaaagaccaaaaagacagggacaaacaggaaaaacggacccagctctactgcagtaatagccattgatcactttacctcccttggcagtctgatcagtttcactggaaagatagcaagtggaaaaagtgtgcagagatatgatgtgaaaattatattcaagctttagctccccagcacgtctctaaggaaagcactataggaacagctgctggagatataaacaaaggcccaggaacatctctgccattcatgtcaggatctgagagagccaagggaaggacaagaggggaattagctcccagacatgcttgagtctctaagctgttactccgtgatccccatgttctaggtgcagaagcattgcgtctctaagcaattcccttaccaccagctatctaatgctgtcagaggaccaactatttgctgttaacagtaatgctcatttgaagctattcagcctagattttctttgtattaggtaactgtttaataaattaattccaaacagtacctcccatctctctcagtctgaccattgagcgctcttagtcaatctttgcaaacttgtccccatttagttgttaaacctgctccatcaacccaataatgaatcaacctatatttgaggactatggtttgtgcctgctccaaatcctatgttttctctgatttcagaccccttgcctcaactggatgaacttttcaagctcagaacaaataagtgttaaaaaacattattaaacaaacatattcacctttctacaagtttggaaaataacagctaaggaaaaagcttgtaatcaatattttttgttgttgttcttgttgttgtttgagacagttttgctcttgttgcccaggctggagtgcaatggtgcgatctcagctcactgcaacctctgcctcccgggttcaagtgattctcctgtctcagcctcccaagtagctgggattacaggtgtgtgccaccatgcccggctaattttgtatttttagtagagatggggtttcaccatgttggtcaggctgatcttgaactcctgacctcaggtgatctgcctgactcggcctcccaaagggctgaaattacaggcgagagccactgtgcccggccttataataaatagatgtatcaattgtagcttaccagcaccaaaaacaatagttagtaagagtgtggagtctagaatttgactgtttagagaaattatgcctcatcttggggaaaatttcctaatgtgtccaatctcctgtttccttatccataaaatggagataattgtaggacctcctccagatgactattaggaagagatgatacatataaaactcacagcactgtgtcaggcataaaataagtaatctataaacaatgttatttaacacttttatgataaaaatatagaaatagaaaataatagtttcagtgacagatcaatgttgaagcctcaattcaaaacataataaaattgctctttatggttcttacgatgtacatttatttcaaatagtaacaatgctgttcatggtgaaacgtattgattttaagattgagaaattggacaaacaaggctagtccacaatagtgggattgcagtagaccctagaatatgtataccactttggaaggtataattaatatgtttatatgtgtcgtccccaatctttccattctttattaccaccattatacctccatttactccacagtccgtctcttctagaatgaaagctcccacaaatcagcaattgcatctgtataacctattctgtatggcataacacctatatacttttccaaaaagaggtggagagaatatttattgacttaggtatgtctgtgatgatctaatgaaatgtcatggaacaacttaaagtcatagccaaaggaagaggaatgttaatatgtaagaatttgcagatagattattaacatggaatgatgccaaaatagcacagtagaaaaactaaaataaattaaataggcctggatttgctgggtaacctggggtataaccccataaggatggtgtatgtagaagaaaagtcagtgaatcattagtaattcataaactgtgttttttctcaggtgttcaaacattggaaagctatcttttgcaacctgatgctttccctggaatatgcagtgtttcttgactcgtgcagtaatggctgatggagtaggtgttcagacattttatttgttggttttatgtatccaggtagagaactcctgtctaaaattatcaagagttggtggtgcattcaggacaggaatttagattttctgactccaaggacatttcaccacccactaaaccaccctttgccatgagctcccaggaagagcaattgttcagtctggtacagtgagggaataatctgtccctagcacaggaggctgaacacagcagtgaataaaagaagacaaaaccagttctacaatataaatgacacattccattaatacaagtggatccaaatgaactaatttcattcaatagtactttcacattctgtagctatatgggcttggatacaaattgtaatgtcagtctgtcaggagagtggatggcagtgcataattacaagttcttgttcagcacttcaggagctaatcagagcaaggatgtgaatctgtaatttgcaaatgtgcaaagacagaggttactatggcactaacgactctgctgataacattcttgccaccacatcataggactgtgagcacaaattctacaaaatcatttgacctcctgtttagtcgtttgcaagaaacagcctgctggcagtacctagggacatttataagtttaatgttgttcaaaaatctaaaatgtcactatacaataaattaatacttacattctaagggactatacacaatcgtaaagcaatatatagagcaaattaatacataaaatacagagaaatatagaaaattaatatactacatcatgcaacctgcttctaaacaagtgtttctttcataggactgaatcaggaaagattaaataaggagttgagtagaaacatatatagatatgtagagatagagatataggcaatgttttctttttttttatttttatccaccaccccctccccccgctccccaccatagcatttctgctttaaacacttattctctttctctaacaattttattcattttcgttcttggggcagtagaaaaacaaagcagcattttagagttcagtactggcctaaaattcaagcctctctctaaaagattatagaatttcgctgtcctctcagttcacagcagcaagcagaataatttctgcttgccattttcctcaacttagtcctgcaaaagtaacatcattggtctctgcttctttcctcccattattacctgatcctgctctacagcagatgcttcctcagagaaagaaatacctcgaacatctccatcaacttcttcatggtagtaacccttaaccctaaacttttcttgtgtagagatgggtgcatcatgttgaggattcattgaccattctgttaatatatgaatttaatcaattttaattttaaagaatcaggagtgattacgtgcatcacaactttcaggttaaataattttatcatgggtgctaagctagaaccatggctcacctggtcagatggctataggagagtcagcacaatagaagcttcaggcaatgtgaatcctgctgctccctaccagggatcaaaactgaggtcactgtgtggtatgtggaagtcaaatgactgcttctctttaaaaagtgttggaatgatgcgttttctctcaccgattctgtctagggggtaatgtgctagggtgcagtaagttaagtgttagtcacatatttgcagggttaaatcttagttccacagctgactcactgcacactctaggcagaattatttaactccttcagtctttgtttcctcattcaaaaaagaaagagagatactatctgtggcagagcctcagaggattgagggagttaaatgtaaaaatgacacactggtgcctgttacagggagggctccctgagaagcagacctgtgggctaagtttagcatgcaggatgtttattaaggtgtgcctttgagatcaatacctgtgaaaagtagggaaagaaagcagatgaggcatagggaaaaggtggactgccacaggcaacccagcgaacctcaccagcagctctggagctaaaatagctcttcagaattgtccagagttgggctgaggaggccagaattttatttgtgttcccacgatgatgactcagtggatggggtcatttcaggaagagagcagggcatcaaccttgagcaagaaaggtcactgcagcttagtctaaccctgaagaggctggcagctcagggcatctgttgacagtattccaaggaggcagggcgactagaactttagcaaaggaagatggcacatcacagtgatcatcacagtccccagtcataaagagtagtttcttacatgtgcataccccttagccttgttttcatttctcctcctcccgccttcctgtcttcctcttcctctcccttccttttcttctttttcttcttattttgattttgttttactttatggaattaaacctccataattctgtagtgtgccaagtatgagggggaaaaagtctctttcccccattaatagataatgacaccttgacagataagtgagcaattctgcattgattcattggggaaaactatggcaggaagtgggtagcagtgtttagcgtggcataaaatacatatgctatctaaagaggtggcttctttcccttctgggggatttatgtgcttaaatcagggcccacaaactcaaagcacgcatttgggctaaaggaagcttggctaagagtaaaaggagagccaacagggaaagggccttgtaggctgtgacctttcaagctaaactgcccctagagaaagagagacttatttgaatttacagatgccttaggactccagtgagccacagctctggctcttttcctctggggcactacaaagcttaggtctttgcagatcaattaaagtcattagcgctccatctaatgaatgttgatttccatgaggaggctgagccagctggcctgccctaaacagcgcaaaggcaagcagggtaccagagttagagcaaatggcaataagccacttgaattagaaggcccccagcttgcagcagagttaatgctgcctgttttccaggtgacctcaatcactgcctggggcagacactggactcagatgctctccagtcacaagagagtttgtaaatatgatttaaaaattgtcactggctgctcaactagcaggagtgttcagaaagctgcaaggtatgagacactggatgcacagatgtgttttcatctggggaatgttgcatttttacaattttctctcctggctattatgatgggagatttctagtttttaaattcagtgtgctttttaaatttttgaatagataataagatgattgcaaaaaaaattaatgctgcctctcatttctgttcttcatctactcaagaaaccagttattctttttgtgtgattctagagttttctgatatatgtacaagcaaaggaaagtgtatagtctcatattctcatagtcccacctactaaacaaataacaacatactgtatatataattctgcatctcgcttttcttctcttttaatatatcacagctgccttaccgtatcagaacaaagagaaattctttttttttacagctctgtcatatttcattgaatgaacatgccttatttacttaactgttcctttactgtttgcagttacaaataatactgcaggtaacctcaaatatgtttcattttttacgcatgtttgagagtatgtgttgaatacaatctcagaagtagaatgacttctaggaggtatatgcatttgtaatttcaatagatagaaggattgccaaattgtccttgagaagtattacacaaatgtacagccccccccccctcaacgaatgggagcgcttccccacacctcaccaatagagactgtggtcacacttttagaaatttgtccatctggtatgtgaaaatggaatttcagtgtagttttattttctttttcttatgatgagtgagattgtacatctgtttatatgtttaggaactttttagaaatcgtttgtatgaactttctattgatattttttgaccacttttgtagtagtttgctgcttttgtttttaattgatttctactagagagactaatctccatgatatgggatgcaaatatccttttcctcccctagttttttgtttgccttttgattttccttacagcttttgcccctgagcttttagattttataatgttgaagttatcagacttttcttttatggcatccttatttcgacacttaattagaagggaggacttcatattctagagtggtaaagtaattcttcatggttttctcttagcactaccatgttttgctttatattattcattttcataatttttaatgtattcctgtagaggacgtgaggtattgatacaaatttaatattttttttcaggtggctacccaattatttcaataactatgtttctataagtcatcatttcccatttaagcctctgttatgatattttaaattcatttctgcacttttattctgctgtattggtctgtcagtgcacatttttcaattctgaaacctgtacaatagatttcagaatctaaaagggctaattctcccttattactttttctttcagagttttcctgactttcctttttttttttttttttttttttttttgagacagtgtctcagtttgtcatccaggctggagtacagtggtgcgatctcggttcactgcaacctccacctcctgggttcaagcaattttcctgcctcagcctgctgagtagctgggattacaggcaagcgccaccacacctggctaatttttgcattttagcagagacagggtttcatcatgttggtcaggcaggtctcaaactcctgacctcatgtgatccacccgcttcagcctcccaaagtgttgggattacaggcgtgagccacggcacccagcccacttttcttttatatttttttatagaagcattagagtatataagcagtttcttttaataatttgtatatgttagcatatgtatatataaattagataatgttaatttacaaattaaggagagctataacttctatgacctatatgtgtctttctatttagtgacatgatctgtctctccttttgcttaaattttattttatataatttcatatgtctcatattttgttaggtttatctctaaaagttttttcttctctgtacctaattatgaatggttcttttctgttattacttctactaatgagctgtgtgtgtatatatacatgaagatcatgaattaaggcatactaattctgcatcctgcttccttacagaatcttcttgttaatagtaatcattttcagttgtttcttctgagaactccaggtgctcagtcatatcatctaaacataattttatcactctctttccagttttatatctccaatttctcttgtttaattgcattagataataatcctatctaataatatagtaatgatattgtggatactttagcctcgttactgactttagtaagagtgattctgatgtttccacaatcattatgagcctggcttttgcaaacatatacatccctatggtttcttaacactgaatggtctggtccttacattctcaagttaaatcccgttagcattgagtattctttataatatagaactagatccttgtaaacaatttaattattttctttttctatgccacagaacaattaacttggcattaaaattctctactctttaaaagcttggaatgatttatctgtgaccttttctgggcctcgtgctttctttttctaagggtggctcaggtgacagacaacttcctccatttcatcaatggaaatgaataggttttgaatatgtatcccctttagaattatttttaggcaattacacttttctaggatattctctatctcccaagttttcatatatatttgcacagagttagccaagactatttttgtcatttttctgtgcttattttccacttactatttttaaattttatgtatctgcaattttcttcctctttttcatgatgagataatctaatgtttaccctttttaatttttttgtaacagaaactttaaatatattaattttaccacttttgcatttcctagaatattaaattctccttttccctatatgaattggccctttatgtttttcttaaacatattttatgtttgtttaaaaattttgtattaaaaatattgaattgattttgttattttctcctgtcaatataaatatgtaagaccaaagatttcctctaagcatggcttttcctgtttcccatagattatagaatatgagtgcttttacatttttattgttctaggaaacctgcaaaatgggctgtattacattcgacccaagaattaagagagagttttaaaatttctgattggaatgggattctgtttccgatcttgttgttaacatctagttattacactgtgatcagaaaatgtgtacaatagtatttcttttttttttttttttttgaaaaagttgcagttttctttttggactgcatacagttacatttgtgattatcatgtggattcttaaaaagatttttttaattttcaatgcataagtctttaagtgtactgtttgatataccttataaattatgctatttaggtcaattatagtcttacttttgactacttcatctatcattgaataagcaagatgatttaaagtgtcttatttctgttttttggctgaatgtttcttcagataactcttaagttttctgttttttgaatgttatttttatttcatttggttcataactagttataattctgacaccttcattgcgaatttcatcttttaacattttaaacaaaaaggtcttttctcaattatttaaaacctgaataccactttctctgattttaagatccctatcgctgatttatttttgtttgcattcttccggcatgccttggttgaacctcttattttcaacgtgattaacaaatttaattgttttatttatttacttatttattttaattatactttaagttctgggatacttgtgcagaacatacaggtttgttacataggtatacacctgccatggtggtttgctgcacccatcaacctgtcatctacattaggtatttcacctaatgctgtccctcccctagccctctaccctctgacagtccccagtgtatgatgttcccctccctgttccatgtgttctcattgttcaactcccacttatgagaacatgcagtgtttagtttctgttcctgtgttagtttgctgagaatgatggtttccagcttcatccatgtccctgcaaaggacatgaactcatccttttttatgcctgcatagtattccatgttgtatatgtgccacattttctttatcactggtcattagagaaatgcaaatcaaaaccacaatgagataccatctcatgcaagttagaatgacagtcatcgaaaagtcaggaaacagcagatgctggagaggatgtggagaagtaggaatgcttttacactttggtgggagtgtaaattagttcaaccattgtggaaaacagtgtggcgattcctcaaggatctagaacaagaaataccatttgacccagcaatgccattactgggtatatacccaaaggattataaattattctactataaagacacatgcacatgtatgtttattgcagcactgtttacaatagcaaagacttggaaccaacccaaatgcccatcaatgatagactggataatgagttgttttttaaagcaagtctcttgttcatagcacaaagttggttctgctttgtgatctattgtaaaagttgaaagtctttgtcttttaataggtatattaagccagtttatatctaattatgtgatagatatatttgttcctggtcctctcctgttactttatcatatagtttctctttttcttattttgtttgtttgcttgtttgtaatgtgttctatgcatgtctatatgtatgttttgctatttaagagtttgcattttctcccttgtcatttttacagttataatgtattatatttttagtgctcaatatatttaaaccagagcttctcatccaatataccacactcagggcttttggatagaccctctggccatgaacaatcttgtcttctcctctcagtctcgacaaatatattatttgctttttgacctatcatttgaaaaatattgggaaatgtcactttaaggaatatgcactagctctttactatgagcagtgaatcatctttcttaatatttaatacagaaaaaaacatgcatgtattaaaattaattgagttgatactttatatattatcctttgactcctagcaatcagataatttacttcctactttctgtcctcttctaactatttttagttgtattacttctgtattgtcagggtttattccattttcattctggtcttcagcatattattcccattaggttagacatagttcttctttaaaaactatactctgtgcttaccttcaatttcattgtcatagttattctaattatgttttggttgatcaaagtcatttcctagtagtttcctcaatattcccagtgttcctgaaggtaaataccatttgtaaactatcattgagtatagtttggctggatataaaatgttgggtcatattttgctttttgttgggaggatgtttctataaacttattaatacagtcctggtgagtcagagaagcctttcttgaagaggcattgtctatgtttaatctctaatggatgatcgtcacagaaacatagacagaggaaatggttccaggcagaatcaatggaattgaaaaaaatcatggtacttctgtggaacaggtagttggatgactgtaatgcacaggggaaaaggtagacacaagttgacactggagaagtaggaggggatagagcaagaagaacttgacagaccgaggagtctggattgcttccaggacaataatctaaactgcagagtggtatgaagcaagaaagggatatccggttgtaactgttcatattaagaggggtgcacaggggtatatgagctttctcttccaaggagcctttgagtcctcatctctgctgttacagtacagacccagaatttcttatgtaggagagtaaatacatttatgaaataataatggaattcattttatgctagggccatatttctaactaccttccaatgtagcaggagatagcaagacttaaggatatcttagtctgactcttttaaaaaagaaaaaataaagaattacagttcttgggtatatagtcttgtacctctgtaatctgtgaactgtctttcttccaaggatcccatggaaacctttacaaatctagctgatattcactatagttctaaaacatttccttccttagctgttccatggggagttttctgtgatctcgcagtttcaagctactttttggggaccttccatacttcattcaggtgggagctgccatagttaactagtttcggagcacaactctttatcaaacactatatatgtaaaaaactgccatgttaaataccacttgttgctctttcatcttcagtcagctatatgcaaaataggtctttacaggcaaatttacattctatcacagaaacagtgactatcagataaccaactcccttctcaattcttttttttggcttgttttcttgcttacttgcttggttgctttctctctttcctagctgaatagcattacaggccacttctaaaataaactgggttgtggaatttccactgaaggctggagatgaaaaacatactcatttacactgtgtgcgaacttggtggactaacattggttaaactttgaaattaagagatttttttttcctgatttttggccatctctttaatgcaatttcaggtagccacatggttcttaaaaccccaaatgcagctatcttcagtaagtacaaaatgaaaatatgttgcatcctaacagataagaatttcttctttctcatgatgagagctgttacctaaaggagcaaagctttaatggggtctcagcttgattttgccatgtttatatacaaaagagatgaggcaagctttgttttgaagatgttaattgattctgtccaccatgctgtctaacagccaattccctgaaaatgtagtgatggaaaaaaaatctgttccaattactgtataagtaaaatgcttcccttccacctccactaaagaaaaaaatggcactcactgctcaggatctgagatcgacagctgattctgcacatgcaaagccctgctgccatttgtcatttcaggaactgctttatttttgtcaaaatggaaggaaaaaaaaggagagagacattatacagacatcagaattcaaatcatttgcaacctgatttgggtaatgaaggctcaaggcggagttgagatttagggactaaggtggttgtataagtatgtaacttcacaagaatctgttttagacccagagcagattaatagccagattacaatggcatttcctgggcttaggaatctcattatcctcttctttcatatttctttaaagtggaagacccttccactacggtggtgtcatttgaactcaagtgtcaggttcacatccttgtgccctgaagtttcaaagtgtccagttgctgtaggagctttttctattctgatattactgatactgagactggataggaagcataccctgtttagctgcacatctaaataatcggtaatgagaacatccttgacaaaactatcttgcggaggagaggtcaggtcttacctgcatgcctgcgaccttcagcaaacaaaggcagagatctaaggagaaaacaggatgtgggatgtttccagtggaccttggcagtggacttgctttgtgtttgcaatggaagaaggaactagaggggggataacctcatggttgtcttttcttctaaatttctaagacaaccagtgaagcttgaggccttttctccagaactatacaatctttgcctccagcaagctctgtttttactaataaccagattgtcaggtggaaaactttttctaagtggaccttacttctctaagtaaaaaaacaaatcccctgaggcatgaagacctccattttacacttttgttatatacttcacaggtacctgaaatggttctggacaaaggatatgatgatcgacaataaagaaatcaaagatcatattcataattataaccaacaaaaaataattctggggataatattgtcaaaatggattccactgcaaacaggcagtaggatttactttgacaatattctccccagaattattctggatatcactgtagggaccaaaggagagtttttcccttggccttccaaagattctctgaaaaatcaacttgcaaaatgcaaattgatcagagaaaaagtgtacacatttatttaatgtgtatacacaggagccttcaaaatgaagacccaaagatacaggagaaattgttcatttttatgcttaggttcaaccaagtgtggacatctgtgtagaaatatgattggacaaaaagggtatgatctaatggtaatggactgaggcagaaaacccagcgaggcctggccgtgtagactcttcttggcctctctgagcccacattcctttttttctgggtagggggcaaaactttttctgaaatgggggtcttatgacctataatcaaacaaggtagtcaggcagtttctgcgtggtcagtttttacacagaaaggcagagggaaattggagtaatatttttaggtcttatgactagctttgaggaagagggatcctagtttctatggctagcattggggaagaatgggactgagaaacaggagggcaggggaaggtcagaaaaacttttgcttctgaggccttcattttggggtattgtttactgagccccaacaccacctcgagggtttccaggtatattttttaaagaccttctaacaaatgttccttttatttatacatccatttaattattggtgctagttccaatgcaagacttaaaaaattccacttctaattccccacctgcatggagggcacaaatctccaactcatgatcagaatttcctgcaatccgtatgtcatttaatgaattccactctattcttctggaaatcgaacactctagaaacatagttttccttttagctgcaaacctattaatgctggcagccataaaataaatgcagtcacaactattccccacaaatgaatcagtcagctcagattaaaatatactctttgcatatcactgaagggctcttcctggtcagcttgtaagtgttctgttttcattgcgtggtattcattttccttttagcattgcacttgatttgtgaagtagtgttgactgctagattcccatcattaacattaagttttattgccttaaatctctgtcttatgttcactataaatgttttaagtcaacataatgctagcaagaggtgctgggttaacagactacagttggcatatgattctcatttggggcagggaattgtgcagggttattaggagctttctacctttttatttatttatttagggacagggtctcactctgttgctcaggctggagtgcagtggcacaatcatagctcactgcagcttctgacccctgggctcaagggatcctctcaactccgcctccagagtagttaggaccacaggcacatgccaccatacccacctaattttttttctttttttgagacggagttttgcttttgttgcccaggctggagtgcaatggcgtgatctcggctcactgcaacctccacctcctgggttcaagcaattctcctgcctcagcctcccgagtagctgggattacaggcatgtgccaccacgcccagctaattttgtatttttagtagagacggggtttcttcatgttggtcaggctggtctcaacctcgcaacctcaggtgatctgcctgccttggcctcccaaagtgctgcgattacaagtgtgagctgccacctggccccatatccacctaatttaaaaaaatttttttgcagagatgtgatcttgatatattgcccagcctggtctcaagctcctggcctcaagtgattctcctgtgtaggtttcccaaagcatgtggctaacattttttaatcctatacaatgttagcactggcctcatctagtcctaagaagtttgctcctaatcatgtattcattagaattgaggaggagaatatttcccatggtgaatttatatgttccgccaattcaaccaacatcaaatatttattagctgcataccgtgtgccagatacagagccagacactcaattttgcagacacagtatacctgctgtcctagagtttagactctaatgagggagagagataataaacaaggaaataagtgtatgtaacaatgtacagctagaaacgctgggaaagaaacgaacgtgagagacacttattggaatttaaatgcaagccactccactatatctactaggtgtgtgtgttacaaaatacaaaaaaagaaaagcctcctgggagggtagcaggagttaaattactcaaaattaagccacagtttaagacagcaaaacataacagaacccagagatgccccaaggcaatacaaagttaattatctaagtagtagtaacaagaataactgctggccaggcacagtggctcacgcctgtaatcccagcagtttgggaggctgaggcaggtggatcaccctgtcaaaactctcaggagttcgagaccagcctggcaaacatggtgaaaccccgtctctactaaaaatacaaaaattagccgggcatggtggcagaagcctgtaatcctagctactcgggaggctgaggcaggagaatcatttgaaccggggtggcagaggttgcagtgagctgagatggagccactgcactccagcctgggcgacagagtgagactctgtctcaaaaaaaaaaaaaaaaaaaaaaagactgctttaggatttaaggaagagtagtgtggcgggttagagatggtggttagaagaggctttctagaggatcccaaaatgatgaggagattgtggatggaaagtggtctcttaagcagaagaaaaagcatggaagaaatactagggtcagggaagataaaaaatattacgctgttatgaacaatcaattatatagggaaagtaaataatgttagaaaggtagtttaaaattttccttttttgcttatcatgttagaaagaatttaaaatagtggccaggcatggtggctcatgcctgtaatcccagcactttggggggccaaggtgggaggatcacttgagttcaggagttcaagcccagcctggccaacatggtgaaaccccgtctctactaaaaatacaaaaattagctgggcgtggtggtgcacctgtagtcccagctacttgggaggttgaggcaggagaatcgcttcaacccgggaggcagaggttgcagtgagccgagtttgtgccactgtactccagcctgggcgacagaatgagactccttcgccaaaaaaaaaaaaaaaaaaagaaagaaaaaagtaatggcagtagtagcaggagtagtagtagtaacagataaaacctatcattggcagcaacccaggcaagcatttatttctatatcttgctgatggggttgatggggttagcaattgctatagtctccctagtaggggatttaggagacagatgaaaaactgttagactatttacgtatttaaccaaaaggttccattttggggtattcatcctatggaaatagtcatgaaagtaggtaaagatttagttccagagatgtttattatagtttcttgtgaacattcttatttgaaaagaagataagtgcccaataatatcagattgattacagtacactcaagcggttagcacagatattcatcatagctgtacttgataacagttgttactattatcatgttcttgtgtgagaggtaaagggagataagattaaactttttgatgttataaacaccatcacatacttcaatctaatattttagaagaatatttaatactattttaggtttactgttgaattacatcaacagatgtttgtaaaacacagagcaaaaagtagagtaagttatacaagatcaatttagtcacatctctatgtgagtatgtttgcatcaaataaatactggaatgatatatgtgtgtgtatatatatgtatatacagtatattcaaatgtgaacagtgagtagtgagattacaggtaattttgattctttttgtttgtttgtttaacattatgttctaaaatgtgtatggtaaaaaaaaaaagtagtttttttttatttctaagactagaaaattatttagcaaacaagtggaccaaagatattacagatagcatttcctaaacatgatgtgccttttgtcatggaaaaaatggatgattttgttttcttcttcagcttaatatgcgatataataagctcagtcatcgaagagtgaagtgcagcatactgaaaaagtatgatttggtttcacacagatcttggtttaaatcccagcttcatctctcattaatgatcacatcctgaacaagttaatatgtatgtctcggtcttctctttagaaagctgacaatggggacatgtatgttaagtgactagcacagcgcttaccagaggaccattctcccgctgtagcaggacgagccgcagacgaaacctctcagacaccaaattgtaaaaggaagggctttattcagctgggagtatgggccagctactctctcaaaatccgagctctctgagtgcacaatttctgtcccttttaatggctcacaacactaaagatttcacgtgaaagggtggtgattgatttgagcaagcaggcggtacgtgacaggggctgcatgcaccggtggtcagagagaaacagaacagggcagggagtttcaaaatgttcttctatacaatgtctggaatctatgagtaacatcggtttctaagttatgagttgatttttagctactgggtttaggccaggcaggcccaggcctggtttcgggcctggcgccgggctgcctgtctttgattttacttccttgttgttttttcttaaaacaggtactgagtataaaacaatataaaacaatatgagagggtctctctcttccctcaccacatatgtgagaaaagagaaaatatggctaagtcatgtacttaactgagtattaaaacacatgtcttaccagaaatagcaatttttcaagtgtgtgaaacacattaaaaataaactttgaaactccaaaaatctttaaaatatgtaaattcatttagactttactagaaaaataaagttatctctctgaaattttgttgttaaatatttgtagaaaaggatgtaaagtggaatgaggtctagagagagaattttgatggatgtgtgtatttgagtcagttttcatcccactgaatctttagtcaaatcaaataaaaatgaaggtaatttgtcagcttgcagaatcatgccaagcaaagtcgaaaactgccagcctatgttcattctcatggtttgaacaaaccgaactccaagtaattcattgtttggttttgaattacttatattcactctgttgatcccattttgctttgaaattgtactttcatgtttattttctgtagtccagaatggaggtaggaggaggaaatatctggaaatacctaaaaacatcttgaacataccttaaaagtaacatgtttaggaggtccctgagttagttttattagcacctctgagtgttacagaaatgattgcaaatctccaaactcacagacatttgcccagagtccccacctataatcatgtgctgggagagctttagtataattattaggccagtgtaggacaagcagcagcgtgcacatagtcacatttaaagtgaggatttaaatgacaacaaaaagcaaagcaaaatgacactctatataacttgggattgtttttatttaaatcaaaatttaaaaaattttaattatacatatgtcctggggtatgagtggaggggtggctatggggatgggtacacaggcatgaatgaacacaggagactatgaaagatgcttcagatgccccccggacaaagatggagaaggaaatgttttctgtaccatctctatatgggcagttcagctttctctctgtgcttgttttctctgctctctctgtttggatttgaagaaaaagaggttttttgttttttttttttcctttttcttttgtctctatcttatttattttttaagtagactgtcaaaattttagctgtgattgaagaaaagaaataagacaaataaaattagtgggaaaccaaggagggggaaatgggattgccacttcctcttgtacagagtcagcagttttaatacctgtaaacaaaaagttctttgctggaactctttttagaatggaaaatgggatgaataggtacagcattatcaaaccatttgttgtgctccctttttcttgaattgatggaaaatatagaaataacacaaaccaaagttgacactcttgaaatgacttgtccttagaatttattgtttatctcacggaaacatgaagaaatgtcttcattaatgtttttgatctcagagccccatttccttttatctcccagcagaagtgttgcagtgtcctcacatttggattgagaatttagatagataagaattcaaccctctagtcccatttactgcaattgtatttaaataccagcttaattagctgtactcatcctccttcccaatcctctttgaagtaggaaagtcccattgcttccgtttagctaatgctatgctcataccctagtttttaagctttgtagaaagtacagatatgactgccccatgtgatctctaagaagtctagatatttgatccacagaagcattttgttccatggaggacgtggagtttgttgctttggatttgagcttcatttaaagcatttgcttatttttcatcttgcaaaattaatctaaatcaacttaatgaagggtagaacattgagatatatacctgttaatagtagaataatatgacatggcacagtatccaggtatggaaaaggtgaatagggatagtgttatgagatttttagagtacgttaattttataaagcatgcttatgggaaaagccaaacattgatgacatttcgcagaaaatgttatgttcaggtttggcaaataccaataaggtcagagaaaaagcaatatgaatcagtattaagaaaattataagatagtgtatgtctaggtcatgatctttagtatcatcaataaaaccactaaggatgcctcactatagctgtgagatgggttcggaccatgatatccagtttaatactatttgggagcagaagtaactagatatatttatcctatgatattttacacttattggacacctgttgaatctctgttggcttgagatttaatttgctaagagaaaagcaactgaagttactaaggtaatagacataacatatgatctaaaaattgagagtacgttaatcaaggggagtgagcagaaattattctcgtcaatcatccatgtgtccctctatatccttcacctttattgctgttagatttggaggaaattctgagcaatgttccgtgatcaggggtgaaaagtgtcatttctgggctgaggcagtttatagtcatttgcaccttttctataccactctctttccctgccttctcttctcaatgttctgaaaatcttgtgttctaaagggacttgaataagatggagatagagtgccaacccacattagcatttatagcatatatggagcaagaaatgaacacgtgtgtatgtctttatgtaagttacagatacttatctatgatacctatcctgactattgcaacatgttaagctttccactgataattaaatttcatatataaatagataattaattttgatatttaaaaaatgtaagttacaaaagcactatgctactctgagaggaaattgagaaatactaaagttttctttcatggagccccatagttggaccttcacaaaggcttcaaaagctagtttcctaaccagtaaaagtcagcatgagacacagtgggctgagataacaggcccctcagcctaggggtggtttgctgaagtaggaggccagagcctctggatgagtcatcttcagttgttacgacggcttactctgtggaccatgcaaataatatcattttcgatgtgttccatgatgcgaaaaagttagagaagtaccataggtctttgtatcaggcaccaatataaccacccctacactccagatcttctttccccatactcatttctccactctcctccaagtcctgcctcaaacgagttattattttcacataaaactgagaaggaactgttgaaatgactgacatcttcagcaaataaaatagttgtcaaattaataaataaatgtcacttgaggcacttctgagcttctcaatatgtcttcttttggaggactatttgttggcataggagaagatttcctagcaaccctcaaaatctttccaattaggaacctaaattctattcccaaaggttatgatataaagaggaaacttgaaaatttgtaactgaactctattgaagtatggggtatttcaattgagtaagcccaatatttacctgcatcacaaaaaaactagattttaataatttcttatcaagtgtttatgccatgtaccatatttaacatatatttactcattagtttttcaaaattcttatgaaatgatattgtttttatacccattttacagatgagaaaactgagagagaccttaaggagctttctcatgatgcatggctagttaatggcagaactcatgttaaagcaagcagtccaaccctgcctgggctcttaaacagtggagtctgctgtctccttttaataggatgaaggtgaagttctcagcttgatatttttgtttcattcagtgcaaagtgtcatcttctaccccagtgccaaaaattacttcaaagaaaacagctttttgactaccgacagttatgtacaagaggtgtgatttggggttttaagagcttactttgacacagctcagatcccttttttggtagtgaaaattatgctgttatctcctaaaaaacatcatctgctctgtccccacctctttaatttgacaggtgattccatatccatgtaagagcattttggtgtctgaaaaacaataaaaatcgtcccagtaaacccatgttctattcaaaaaattttggcatattgattgtctggggtaaggttcaaaattgcataaacttccttgccccacaaatcactttgttgcatcgacaataataatcacaattattgatagtaaaataatttggccattctatgaatagtaaggactgcacatgttaaaaagaggcaaaagaatggatagatgatcagaatccattctcagtaaccagagctaaggaaacagctcaagtaaaaacgctcagcttacttaatgctctatagtaattaatagtaattgataacaacttgtagcaattaagatctaatgcacttaatttgcaaatgtactccttaactttgaatacacttttttctctaaggcgaaagtctagaattggagactcttggattcttcttcccattcttttccttcttccttggaaaaaatcagaaacaatctcgaaatgtggcctgttggagctggaaaagagcttagagattgttctagtacagttgtgtcaaactacaggtgaaaactttgaatcttggagaagaccactggtttattccacctctctagccatcggcatgaatgtctattggtatacttggtttagctgcccaatttatggccaagactgggacatgatatggtacaaaatatggtgtttttgtataaagagctatctcttgttccttcgttgtaaggggactgagggcacaagagttctaagactgataatcccatcaacttaatatattaaaagaggttttatatctaaagcatccaacacagtgtctggcctagaggaggcactatatctatagaacaaataaacgaatgttcgaacatagcctctctaaattctatttgaatgacttaacacaaagatcagaaatttgcatagctgtttgtgttagccctttaaaacaaaactctcctaggggaacatatgtgaattctattcagagtttaaaaacagattcatgggagagccccaaaccaatcaaaaacatggcaaggtttaaaaaacaaaaaagacaaaaaacaaaccagaaaaaaaaaattatgaaaagaccctgcctgccaagagtgacttgtttgcaattgaaaacctggagatatgagtacataatagaaacgtggcaatgatcatctgggcaaaaacacaatttgtatgacaatgaatcaggaaatgtcctggaacaccagaagatgaaaaacctgggattttataaggcacattcaagttgctgcgcatgcgtcacaccatgaattttcctgtggtctgacatcctgttaaaagcattggtctctttctaaacattggtagtagaagtgtaccacaacaggcaaccttacatttaaagaaagaatgtaatagatacctgtggaaactgtcaaaagtgtcttctagagctatttttgaggtctcttttattccttcattcctgatctgaaattcattaaggctaagagtgccccttaaattacgttctgctgtatcctggaggaacacctgaagaagttaataataaaccctagagattaggcaagtggaaagaattatgaaataaaacaaagcaaagaaattgtgtaaacaaattaattaattgtctgaaagtgaaagcatgtttgtaattttgcccttgtcaaagaaaaattggagttcattatgctcgctgactgatttaaaagcttcttcccgcgtagcatcaccgggagaatgagtgtgttgtgagtgcaaagcatggatcggttgcagcatcaattaaaatagaaattcattattgaaacctccagagtaaaaggtttgtgctttctgctttgaggatgggaggaagcttttcttttcttatttttaagttttgtttattttttttctctcctctctccaattggtataggaacatttattttggatttccagtagcaggcattctacctttttgtaataaattatattaatacctgttatacattgagcacatgctatataccaggcattctatatactttatcatctttaaccctcagagcaatcatgtggtgaaaggtatccatcagtatcacttgaggaaactgaagctcacggaggtaaaattgaacagctactaagtgatgatgccaaggatttaacacaccctaggtttgtctgactaggaacttctggtctctccaggacacaacagagccttctaaggcaggtttactgtgttgagttgggtttgcccctataacaaggctatcaaagatatatgtgtgtatccaggataggcattctgtattcagttacgtgttggagtgctatcgagagcccagtgggattataggtggaataagataccttcaacacagccatctgctgcatatggtgacccttgtgctctccaaatgagcagaagctcaaccagctttgctgaaatgtgtttgatgagaggatggtgtgttttacttttgtgacatctttccccagaggtggttgcctgaagagttgaactttagagaacaaaaagaaagaaatgtaggatccatttatggtctctcctagaatcatgccatatgttggactctatatggaaagggaggaggaataaaatgaagaaagaggagtacacagagcatggaaaaccataagtacgtgtgatccatgattacatcattgcaccttgcaaaaacttgttgattttagctctggggaggatgagtgaaaatcatggagtcagagcagaatcatgaaaagagattggttttggagccaagggaactcagatttacatctggtcacaacattttttttttaatattccctttttttattaattattttttttttaatttaagttccaggatacatgtgcaggatgtgaaggtttatttcgtaggtaaatgcattccatggtggtttgcagtacctatcaacccatcacctaagtattaagccctgcatgcattaactatttatcctgatgctctctctccttctactccccagcaggccccagtgagttttgttcccctctctgtgtccatgtgttctcattgttcagctcccacttataagtgagaatatgcagtgtttggttttctattcctgcattagtttgctgaggataatggcttccagctccctccatgtccctgaaaaggacatgatcttattgcttttaatggctgcatagtattccatggtatctatataccacattgtctttgtccagtctatcattgatgggcatttaggttgattctgtgtctttgctgttgtgaatagtgctccaatgaacatatgtgtgcatgtatccttataacagaatgatttatgttcctttgggtatacatcttgtaataggattgctgggtctaatggtatttctggttctagatctttgaggaattgccacactgttttccataatgtttgaactaatttacattcccaccaacagtgtaaaagcattcctacttctccacagcctcactagcatctgttgtttcttgactttttaataatcaccattctgactgtcatgagatggagtctcattgtggttttgattttcatttctctaatgatcagtgatgttgttgagctttttttcatgtttgtcggctgcataaatgttttcttttgagaagtgtctgttcgtgtcctttgcccacttttttttttattatactttaagctttagggtacatgtgcccaacgtgcaggttagttacatatgtatacatgtgccatgttggtgtgctgcacccattaacttgtcatttaacattaggtatatctcctaatgctatccctccccctccctgcaccccacaacaggccccggtgtgtgatgttccccttcctgtgcccatgtgttctcattgttcaattcccacctatgagtgacaacatgcagtgtttggtttttttgtccttgcaatagtttgctgagaatgatggtttccagcttcatccatgtccctacaaaggacatgaactcatcattttctatggctgcatagtattccatggtgtatatgtgccacattttcttaatccagtctatcattgttggacatttgggttggttccaagtctttgctattgtgaatagtgccgcaataaacatatgtgtgcatgtgtctttatagcaccatgatttataatcctttgggtatatacccactaatgggattgctgggtcaaatggtatttctagttcaagatccctgaggaatcgccacactgacttccacaatggttgaactagtttacagtcccaccaacagtgtcaaagtgttcctatttctccacatcctctccagcacctgttgtttcctaactttttaatgattaccattctaactggtatgagatggtgtctcattgtggttttgatttgcatttctctgatggccggtgatgatgagcattttttcatgtgtctttcagctgcataaatgtcttcttttgagaagtgtctgttcatatcctttgcccactttttgatggggttgtttgtttttttcttgtaaatttgtttgagttcattgtagattctggatattagccctttgtcagatgagtagattacagaaattttctcccattttgtaggttgcttgttcactctgatggtagtttcttttgctgtgcagaagctctttagtttaattagatcccatttgttagttttggcttttgttgccattgctttttgtgttttagacatgaagtccttgcccatgcctatgtcctgaatggtattgcctaggttttcttctagggtttttatggtttcaggtctaacatttaagtctttaatccatcttgaatatcttgaattaatttttgtataaggtgtaaggaagggatccagtttcagctttctacatatggctagccagttttcccagcaccatttattaaatagggaatcgtttccccacttcttaatggggtggtttgtttttttcttgtgaatttgtttacgttccttgtagattctggatattagacctctgtcagatggatagtttgcaacatttttctcccattctctaggttgcctgttcactgtgatgatagtttagtttgccaatcgcagccacttttaacactgttactctgggtaggttatttggtctgagtgtcagtccctccttctgtaaaatggggggaattcctgaaggacagtgttaggatgaaatcacattacttataatgtcgaattcctctgtcaatgcttatatgcttctcattcattatttctaagtcaagcatttttaaagcatttaacatgcaattattcatttttgtttataaagtgaccctgtgaacttatccctattttacagttgatgaatctgagacactgagagattaaataacctacctaagatcatccagctataaagtgatcgagacaggttttgtttgttggttggttggttttgagatggagtcttgctctgtcacccagcctggagtgcagtggcacgatcttggctcactgcaacctccacctcccagtaatggtgcaattacaggcatgcaccaccacacctggctaattttttttttgtatttttagcagagactgggtttcaccacgttggccaggttggtcttgaactcctgacctcaaatcatccacccacctgggcctcccaaagtgctgggactacaggtgccccgctcaagacagattttaaacctagcattcttgctccagaattcatgctgttaatcactgctattctgcctctctgttgactctcagaacctctcttggtcaaagcaagaaggtatcgaacagacttcctgtgctgttttataagctgcctcaaatccttccaggacagggcaatgtctatataaatagatgttataaaaagtataatctaggccctatttatttttctctcagattcatgtctaattcataccagttgagccttgctatttgagtttcacttaaaagcattctgacatagctcacctcccctctttctcttatattgctacccataaggactagagaaaagatggataacataatcctgagtctatgagttgctagaaattcctcattataattgtgtgtcttctggcaaaaataaataaataactttctcttttaaagccacttataggagacaatgcacattctgtgttttttctctgtggctgtgcatggacacagactcttctgcccttctcttgcctgttccttgattcctcatgtttctgtctggtgcctacctgagatccaggtattcctctttacctcgtcgtcttgctattttttctagggacttttcttctcccaaagttatgttgaaacaggcaaaacacctagaaatgggtcatgtgggtgagtagaggggagtgagaaggagagggaaaaaattcccaaagctcatattaggcaattacagttctaatgaatagaagcagtctattcaggcttctggcaatattttatgctcacctagtgtagtctgtattcccttaaatgggtaaaagatgccttaaaaagattgctttgaaggatgaagagacttgaaacaactctctgaacaaaagaacttgtttattcattcatttattcagcttgcatttattatgtgctgggtattatgcatataaatattttcttaagttttgtttttaattaacacataatagtatatatttatggggcacagtgagatgtttgatacatgtagacattatgtaaaaatcaaaccagtgtgtttagcgtattcatcacctcatatatttacctttttcttctggtgagagcattcaaaatcttctcttctagctattttgaaatacaacaatacaatatttttatccctagtcaccctgctgtgcagtagaacaccggagcttattccctccatttaactgtaactttgtacctgttgaccaatcatggtccctattctaaaagtgtcacagcctaggtaggttgacaaacaggtaaatcaggattacaatacaaaagtaaaatagcctggatcaaggaaagcacaggttgttatggaaacacaagagaggacatgtaaataagattgagggaggttcaagaaggcttttcaggagagatgacttttgaactgagttttaaagaccactgggtagacaataggagaaaaaaacatttctggctaagaggttagtgtggatgagcaagtggctctgtatagctggaggagtgtctgaattttccaacatgaaaaggaccacaaacttggtggaatcaaacaaagattttttttttcttttgtcacagttctggaggttggaagtccaaaatcaaggtgtcagcaaggctggttccttctggaggttctgaaaatgaatcccttccatgcctctctcccagcttctggtgctggtggatgcatcactctgatctctggctgtctttacattgccttctctgtgtttctccttttctgcctgtatcttctcttcttctaaagacacttgccaggccaggagcggtggctcaaacctgtaatcccagcactttgggaggccaaggcaggcagaccacctgagtttgagaccagcctggccactgtggtgaaaccctgtctctactaaaaatacaaaaattagccgggtgtggtggcgcatgcctgtaatcccaacgattcaggaggccatggcaaaagaatcgcttgaaacccaggaggcggaggttgcagtgagccaagattgtgccattgcactccagcctgggcaacaagagcgaaactcatctcaaaaaaaaagatacttgccattggattcagagcccacctagataatccaggatgatctcatctagacagcctttactaattccatcttgcaaagactcttttttcaaataatgacacattcatacattccatatcttttggggagacactatttaacccactacaaggtataaagatgagctataggcctgatgaggtaggaaagaggcagggcaaggtctcccagacactcatgtacctgacaaggtgagtctcaagagacacaagaaaaccttggaactgtaattgtgaaattgacatctatctctggaaaatgactattactcctaatgcctctagccaaagactatcagaaacccacctgtagctgatggagttgcatttgttactcattgtttcgatgaggacacacatcatgaggaaccatcatgtctcagctagagggtgttggagaaaacctattgtaggaatttgactttggttgggtaatatgaggaagcgtccaagaaagcctagttcactttagattagatgctgtcagaaagcagaggcaattctaaaaatgtgtatcttgattaaatcttctctgtatggaacaagagtgaggataaagttgtaaatgataaagaagtagcaatcactagccaagagaggggactgtttgctattttgtgggtgaagcagtgactttgtttttctgtgcattgattaaattaagatgtagctttgttttgactcagtttatcatggtctcagagtgacttcttctgagattggtattctgtgacattgctcatgtgcaatagaagaataacaagatctagccatgagtgccaggttacgttccagatgtcacaggctgctcttttgttttgtttttctttttcaataccaagtgataagaatgagcatgcctaaaattccagcagttgtaataaaatacatcaaccaaaaggttcagactgtcctgtaagacccataataagagtctcaatgtgttcttaaaagaacattctttcttagcctacgtgaacatccttctctagacttaaattacttctgacccacatgttgggccgtatctattttaaagacaagaggagctaactgcaaagttccttgtctggtaagctgtttcatctgatagttgtaatagcattttctcccgtctcactgtagggcctaaccccacaagcatccttgtgaagaaagaccccacagtcctctttttaagctttctccctccctttcctggggtgccttatctatttaaatattagaggtgagtcaaatgtaattctctttaatgaaaaacaaacaagtgatagaaccctaaacgctcttttggcaaagatcccttcagaacaaacaatcttcttttaaaagaagtcagagctaggaaagggccacaggagagcagggatagccaactaaactatgcagcaggcttctctgaaaaaaagtgagtgacttttttggtgtggcaagaaaaaaaaaaagtaaagtttgatataactagtagtccttggaatgacaagtgacaagagaggtctcttccctccctatagtcccaaggagaaaagggctctgtaaaattaaaggcacaggtattcagttgaaaggacatatttttctcctctaacttataattagcctgcgatactggcttctgtaggctcttatgaaggcaaattgctcaggacagtgactctggcgatgtcagtcatacaggcaagcactgggatatctatcacaaacacatgccagttgtcatcttccaaggcatcacctgattgccaactcaggtcaggaagaaatcattcctctttcttcttctgtgatgttacttatctgttgcaacagaggagagggttagcacctttcatgacatattccagcatcctgttaaattgatcagaagaccaattgcacacagtgtcttctaccattgagattggaaacacagccaagggtggagatggtcagtgaggcttcccagtgtcttgcaagttccaggtcagttgtttatgcttagagtcccctgacagagagatggatgtgttagcaggttctagggcctgtggtttcccttgtggaaatgccagtggaccatgtgtgctccttgggtatcagggtgattgggcttgggttggttgtggccacagcatgaactggagagtcggctgtatttggcatgacaaggttggcacaggccagctgagaccttgaaaaatttggagctgatgcagaggtgaataaacacattgaaaacagaagctgcaacctcaaatttctacagggaccagacaggtaatatgcctgagtgaagcaggccaggtggcaaattgtacagtgcaggccccaatcaaagtgcacagtggccactcagctgccactggattataattgtgtagagatgtgagtttagagttgtcagcttttcaagagaagccaacagtctggtgtgtatgttaaatcccctgattctggcatctaattaatgcccttagcagtccaaaccaaacaatgtgtgagctgccatttttgcaaccttgagctaatggtgttaacgtccagtttctttgtttcataacatctatggaatggctttgtgaatgcaaatgttgaaacattgtgagtctcatccccaacagtgaaaataaatacaaaatttaggcaaaaaataaaaataaaaataaaaatacttcttaaatgtcacagcgcccccatggggctggctggggcaacaaattaagggacacagctgagctttcgattctgtcagtaactaagtagtaatggtgcctcagggggtctgagtcattgaacaagcgctacaggatagcacaatactaggtacacaaagtaggcgagcacaggctccctacctttgaaaagtttataagttcattaacagtattatgtttccatgcactggagcattagaggaaaaatgccacgataacatctaaacaagagtgcagtgggccctgagaagtatgatgattctgtttccttctttaaagcatctcttcttaataatgtgcagtagtagagagaatagaaaagcagcatgatggccatgtgacttgctggatggatgccatttctgttggatgagattggacatcaataggtaaaaccaataagaggttgtgtgcattttcagattctggaattctggaatctatgacatttttggaaaaatagctctcctaagacactggttctaaatatagcagtgggtttcaatagttctatgaattgaaatcaatagtactaaggagcgaagagcctagatcactctcccaagaatcattgcttagatgagtggttctcaaagtgtagtctctggccaccagcatcacctggcaacttgttacaaacgcatattgttgattctcattccacaactattgaatcagaaattctgggactgagtcctagcaatctgtgttttaaacaagccctccaagtgatttaatgcatgccaaatactaagaatcactgttatccttggaagaggggaaagctcagataacccacaattgaggtctagagatgttcatagtctcttctacaagtaagtcttaccagtgagctatagtagagataaccaagatagcatgtagctggaggagctgttgcttatttgactggattttttggtcattttttctttctcacttatgtgtttgttctccacttgttttcaagccccattgatttctgtattagctttctattgctgctatgataaattaccacacattttcatggcttaaagcaacacaaatttatgagagttctgaaggttagaagtccaatacaggtatctctggataaaatcaaggtgtcagaattagagcaaatcccttcttggggcctctcgggaacaatctacttccttgctttttccagcttctaaaggccacctgctttctttggctcatgggcccttttcttataaatgcagatgttgtttttaaaaatgaacaatgttaggctgccttcctcgaggggctgtctctcttgttctcactcttctgcctccccttccacctttaagtatcctgtgattacattgggtgcacctggatgataggcaagctccctattttaagatcaactgattagcaaatttattcccctgtgctatagaaggtaccatattcacatgcttcaagaattagaatatattgtatctttcatgggggaggtacattattctgcctaccataagagattgtattcggagggcttgtttttttttttgttgttgttgttttttcaccaggaaatggagcctggtgaaaaatgtaatatatagcctcttcctccacactactaaactacctttctgtgtcctacagagactgtgtaatattcactggtgaagacataagctttgtagtcacaaacctgagttgacgttcctactctggcacttactagattgatatggtttggctgtgtccccacccaaatctcatcttgaattcccatgtgttgtgggagggacccggtgggaggtaattgaatcatgggggtaggtatttcccagggtgttctcctgatagtgagtaagtctcatgaggtctgatggttattataagggggagcttctctgcacaagctctctttgcctgctgccatttcacgtaaggtgtgacttgctcctccttgccttctgccatgattgtgaggcctccccagccacatggaactgtaagtccaattaaacctctttcttttgtaaattgcccagtcttggatatgtctttatcagcaccatgaaaatggactaatatatagatgtaataactttttgcaagttatgcaattttgggccatagattcctttattctgaagtggagaaaatactttccttatacaattgttatgtttacataaaataaggtgccagatacatagtagaaataaaataaatgatgttactacttcctaaaatcctaaaagtttcatttcagattgctgagtaaacccagttaaagaaaccagcctctgtgttttggtgttgtcattaatgctaagttacatttccttagggtatctgcattaagcaaatgtaagatgtttgagtttcaaagatgaacaagtgacttgtaagtgtaaagtggtatggctgtttttaataaataggtaataccacccttttggcgggtagtagagaaaagaagatgagtttttagaaaaagactcagagttactcagaattaagaaaatgaatccttactgtcaatatgagtctcccaactgctagcgcaagtggtggatagattttcttttccactagatttacttcctgatatacacatttatcactcaagcatggactgttcatcaagtcattttccatctataaccccagctgaagcctgacaggttgtgtgtttattatgtactcttaaaaaactggagctcatttgcccctgctgcggggagagcagactcagacagatagagggataaggtcattcagtggaatgcccattcactgcagtcaagcctaaataatagagaggtgtaaaacaaccaggaaaagctctgattattgccagaaatcaaatattgatcagatagtcccctaacttaccaacttccctcttaatgatctgattcccatgtattcattcatcagttagttgagcccctcctatagaccaagccctgtgcatggctataaaaaacagtatgtccatgcccacttccccctctacactcaatctggagccatgagaaattaaataacctttaatttctgaagatcgggtgctcttataaaacatcagtacttataattgtatcctgcagtggaaaattgtgcaataatctttttctgaaggcatggccatgaattgtactatattactccatctatcttcttttaacactaaacaaaatgaagagaatacattgtgcatggcccctagaaatttaccttcaaatagaaacaaagctgctaactccacacacacatgatatgctgaaaactgaataaatattgaagaatctaaattcaattaattagcaagccaaatcttgcctcaaattatgttgacattatttattcctttgttgattaaatgagttgcctcttaagccaaaagagaagatcttaagctcttgtttcttcattccaggtctcttctctccaaggaatttgggaaggagcaagcacagcagaggccagttttactgcatgctggtgctcagagggaatagggttcatagagtagaagacagtgaggagagaaccagtaaggaggttggggagctggatagcatttacagcatgggttcattgattcattgggaggcttataaatttcctatgcatagaagcacctgtttttaaacagagacatgtattcaacacatgccttcgagaactaattggaaagagtctttgatggcctatcgttttgaatttgcatgaccagaactccactatccatgcaaacacagtggacttgctgcaattgtcctttgacttaggcaactttaacaatgcaggggaggaggggtgagaagaggctaggagaggaagtgtcagtgggagaagccaagaataattgaagtagtgtgttatttcttttttttttaactattaattttttttattattatactttaagttctgggatacatgtgcagaaggtgcaggtttgttacataggtatacatatgccatggtggtttgctgcactcatcaacccatcatctacattaggtatttctcctaatactatccctcccctagccctccacccacctgacaggtctcagtgtgtgatgttcccctccttgtgtccacgtattctcgttgttcaactcccacttatgagtgagaacatgcagtgtttggttttctgttcctgtgttagtttgctgagaatgatggtttccagcttcaccagtgtccctgcaaaggacatgaagtcattcttttttatggctgcataatattccatggtgtatatgtgccacattttctttatccagtctatcattgatagacatttgggtttgttccaagtctttgctattgtgaacagtgctacaataaacatacatgtgcatgtgtctttatagtagaatgatttataatcctttgggtatataccctgcaatcccattactaggtagtatggcatttctaaccaccctttccttccatgagcttaggcctgggagttgcagtgagtgggagccttaaatctaccaagccgcaaatttctgtgttcctgaggcctctcaaggcatcaacatcttgaatagaaaataagtctatccttaaagatacagtacatttaaagattaaaaaaaaaaaaaacaaaaaaaatcatgttccctaaacacaaataacttcatctgctgcccaagcaaagaaacaaagagatgtctactaaaggcaaaaatgccaatgtcgtgcttcctgagcacagacattgcactgcacagaatggaccattttggagactttcaaagacagttttgactcagtaatctcctatgctgactttattacctaactgtgtcctgtggaggattaggtgatagtggcaggttaggtccatgggagattggattccactgtgatcagcaaacagaataaccagcatgtgtgaagtgacttttgtcagaggagtgatgaggagtgctctctgaattcagtgttttccctctttaatttttgctaatcatgggtcatttatctgtgagctactgcattgtttccactgcctgctttccaaccagggataggttttatctcaaaaaacagaagacaaaacctcttaacctaaaactaagactccctctgggagattccaaagagagacggctttgatgtaatgggaagggagctgatttagggtctaataaagtcttctaccagctgtgtgatctttggcagtttctagttccctaggtactatttgcctatctatagaaatggggttaacagcacctactgctgaagttggtatggacataatgagataccatacatgtaaggaaatgaaaagtattccacaaatactccttccctgagcttgttccttcctttcaccaaaacacacatattccatctttcaactctcctgctctacacgtgtatgcttgagtttagggccctggaataagcaatcctgggtcaacatctgctctgcaaacatcaaaaagtgtgagcaggggcagcctagccttggtattgatgtgtttcccatccacagccacattcaccattagacccagtattagtcactgggtccccggggccagcatttactgttgccttcaaaaatgcagactcattactaacaaaagtggtatgtccattattatgacctatttagtggcccagcaaatccccaaattctattgagccacatctgtctaccgaggggctctgcggttgattgtctgagacggatctgcttgcaaagaggctgatttgggaaagttcaacagccccacttagttgctctgtgacatcctgacttcctacaggttacttctcatattgttgggtgtttgtttgtttgttagtttgtttgtttgacagaggtctcactctgtcaccaggctggagtgcagtggcatgatctcggctcactgcaacctcctcctcccaggttcaagggattctcctgcctcagcctcccgaatagctgggactacatgcacaccccaccacaccaagctaatttttttattttttagtagagacgaggtttcaccatattggccaggatggtcttgatctcttgacctcatgatccacccgcctcagccttccaaagtgctgggattacaggcatgagccaccatgcctggcctcaatgttgtgttttaaagttcagctggaagatacccttattcctaagaaatccactaaagaaaactgttcttccaggagttccatttcattctctgggaagggtccatcccttgttcctgttccctttcctctgaattctataggacatatcacagcaccttcttgctgcctccttgtttgtgtctttcattaaactgtaagctccacacatgcagggactgtatttattttttcagagatgtgtcttcaacactgaatgcaacagtgacacttgacaaatatttttcaaacacattgaaatgagtttgatcaccacctgggcattcacagtagtccagaggtcccctgcactgtgagtgtgactaaagctcaggaaagtcagaaaggccagccaaggaaggaagatgctggcaagactcggaaagtgcaggagtgtatgagattgaatcacctggacaggggcacccaaacaaaggcgtctgctggctacgtgactttggttaagttgctgaacttctttgtccacagtttcctcaacactaaaacaaggagtaatcattatatctactttatagggctgttctggggattaaattagttaatatttataaagcatttaaaattatacatggtatgaaatgagcacaaataagtgggatgagggagacataaacaaaagttcctaaagtggaggttaattcagagccaaagacattgcctgggcattagaagtagtcagacatgaatttgagtcccagctaaggcatttatcaactgggtcggccttgaagaagccgcttgcattctgagtcttgctttccatagctatgaaatgttctcaatcacagttatctcccaggattgttaagagaagtttcctttaaatgttcagaatagtgaatggcatttcttatgtgcctaataaatattaactcatctactgccatcccttcctttctttccctctcattctttctcttttcctggcccataactttctgctcagaactggaaacatctttgaaggagggagaaggagcatgagagtcaggggcttgtttacaaaacaaaacatggaaatagtaaaaacaacaaatctaatagtctctgaaatgattttgtctcccactaggaccagaaaaagcagcagaattttatgttaatggattcggtggaaaatacggctttaatgaaacattgactatgattactctgttgtcatttctctgaatttctggtcctctttccatctctcttttaagaagatctgaatggttatttctcaacacaccaggattatgttttcttcgtcaagagtttgaggaacctagggtgcagcttgagctgctgagctgtctgtctttattctgacaggcgtggactccagtgtttagctcaagccccagggactggcttttgaacagcagctgttctcagtgaaactgaaatgcgcagaggggaggggaatagtacaccctgggaagtacagggagcaggtaagttgttttgctaatacatccctggggaagtttctagtgtttctgggcatggctgagcgcacagctcataaaaaatgcaccagatcattgttggcatttgatgtcagaagaagctacagtaccaagagacatggactgtctggtttcctgtgacatccaggtgacacaccaggtttccactgcttttcgtcattagcccagatgttcccagttacttggacagagagccttgtagatccctgtatatggagtcttccttcccgtggttcattagaaatggcaaagccaaactggcagtattcttcaatttgttgataagagtgcttcagtgcatgtatttacaaatacacattgttgttttcaatttgtttattcagtgaatcaaaatagcaaaacacattaactataagacaagagaaggataaggaagtaacatctattgggtacctgctatgttccaggcaatgacagagctgcttgacagaaaatgtttaatgtcttcctcattgtagctacatgtggtgtttcaggtatgattactgcatgttacagtgggaagtagcccagcattcttgaaagagtatagggtcctcactatctgtgtgaatttgagtagttacttaaaccctctgagctttattttatttctgtaaaggaatttaacaaagtggctaatagggtgtgtagggatgaagggacttttaagtttgctgaaataaactggaaatagattagcaggagagaaggcgtacaaatttattaacatgcagatgtgcacaggatccacacaaaatgggaagactcaaagaaaggccagatagttgaaggttaaatacccttttcataggggagagggaaatgggggacattgccaattttagagaaagagtaaataatttttagaggagatgagtggcctggaagaacagatgatagcctgggacaaagttcctctgcactatggggcaggtgatgacaagctataggaaagtgagggacagaactgcgcttcaaacaaaggttgttttattatacagataaagtctctaaggtaatggcccttagaagaataatgggaagaacaggtgaaaactctgtctgggtgtgttgtgggtgccctggaggtagagacttcttcttatctctcctgcatcagagttaatcttctctggttagtgtagatttcagggagcggtcaaagaccattgcattccttctggataaactttcttctggtgagagaacttcagagagagcccctccctacacttaggaaaggaatgtggggggtggggaaagctgtgcaggagaaagtcagagaaagaccttggttctgaggcctttcaaccttctttgttcaaagcaatcagtatgccaaagtaccatattttggggtatcattttctgagcctcaacaattgtcatgaagattgagtatgattgtaatataaagggctaacatttttacttgacctacatgagctgatcagtactgagagctcctcttacaagaaatggaccagagagggagggaaggggaaggggaggaaagggaagggaagggacaaaaagaaagaaaataaagaattgaggttcaggaaggttgaataatttaattcgcccaaaggcttacagctgctaggacgttcagccaaaaattacacccaggtctgatttcaaagacactaaaaccactgtttacttatagctacttagtgcaccccatctcatcccacccaatgccacctaactcccacctctattgtgagataactacatgcacgcactcatttggtaagtgggatcctggtgcctatttgactgacatttgagagttagcacatacaggtggcacaggtggtatctgcacagaaggaggaaggtggtgctgacacctctggatcttacacttgggtttagaacatagctggtcactaaagccacagggtagtggcagaacatttggatacatctttaaagactcaattagtatcccctcactgagtccccatcttattcattggttagccccctagactgaactgtcaaaaatgttctaagtctccttgtgttctctttatctttgtttttacaatcacaacacaataacaggagatactttttaatgaatgggcaggaactctccactgagatgtaaacatgttatactgggaattctgctgcagggttaatttatgatgatggagtcatctatatcatagctgaaagcaaggctttggggaagtgaaacccaggaaaggtcagttgtaatgcgcattgtctatattttaatgtaaaataccaattttgttgggaaaagggtggtcgggaaagaggtttgatccaaaaggttggaagttggggaaataattcaaaaagaaaactccaaataaacaacagagttggctggtcagttagccaaaggacaccggaggattcctgaaggtctgcatgtggtgagcacaaacttggtagggaaaaggcaggaatctgggtggggagaaggtactagaattcacaaggaagactcgtaaaatggaaactacggttgctgaaacacgttgtctactctattaattttctgccaaacatttcatgtgcttttagttcttcattgagcatgacatacttcaaatactcaaacctatttccttcttgtaggaatagctaggcatttcctcccacggtccaaggtgagactgaagataagtagaatctccacacttatttgtttactttggtccagactatagagtcaggttaaaagccatctggggaaatagccagtagccaatgcttattagcgtactacttgggtaggtgggaggatgcaagagctgtcaaacagcagccatcctgatgagaaagtgaagaaagccagaagcagcgtctcttctgtggcagtcacacagggtcccttgatactcagcccccaacatgagattgcctcttaggagaattctagaggttaggctaggcttgagacattatagagaacaggttacagcaccccatttttactttattggtaactgagaaagtaagatatattcctagcctcccagtcttagtagtaagaggtacttttaaactgttaatttttatgagcaacacagtggtatggccggcccttcctcctccttcagggagttcatttgatgtagtttggttgattcccatgcatgtggaatagctatgacatcatcaaattaagtgtacactatgtgctaacaattatcggggtgtcaagagtgaaacattcaggtcctattggcagttctaataggtgaatctcatctcactgttttatgtgttcagtgaagtaaatcttcagtaagtctggagtagctggggaagccttcgccaagaggtgaggtctgagctgggccttgagcattgctgagatctgaatgggtggaaaacagaagagaggtcattccagtcaaaagcaagatgtactcaaaaaatagcaaggaaaaacagatcacctggatgagatagcatttggggaagggtaagactatagtatggttggatttattgaacaggcacagtgtcaggaatccaactggctactttatatacactacttggtgttttatcctgcaaagtaaccctaataaccagtagcatttgctgagagtgtatgtgggtagcaggcaatgtatgagatgccgggaatacagagaaggatgattcgatgtttgccctcaagacctcagaatgtaagtctaggatatagtaacaaaataagtttattctagtataataggaatatatacactttaccaaggaagcatagagagcagaaccatttgctttgcctgctagatttcaaaatgacttctcagagatggtgagttctgagctgggtggtgaaggatgtgtaggagtttgtcagataaggagatgaaacaggcattccaggaaaagggaatagcaagttcagagacttggtatagtcctaaattatgtttgtcttcatttcagctagtgctatttcattgttgctggagataacacacacttggattccgttacgtattttcaccttgccaacttgctttgtttgcagaccataatttctgagtttatctctacagcaggttttcagccaaattgctctactaaaataaccctaaaaatctatcacctctgttttctgctgctgtcactggctgtttgtgtccttacttttcagtcaacctcaatggagactggaaagagaaatacaaattgccccagaaagagaacacaggcccctctcttcagcaacagggtgtgagtggatggggaccattatcacattatctacacagacaccgttttaatccacattgccaaggaggagaggaaaatgcatggccttcacagaacatcattaggagggtgggccattgtgcagcatctattgttaatgtcaatacctacaaacatgtccagactcttccattctttagcatactcattctctgagtggtattttatgtgtattattctctgagaggtaagcacggacaagtataattccatttttatgtaagggaaagctgagtaaagaagatgcttaaagaataggtggatagaaaaatgaaatgacttcagctcataagcattttgagtacctattatgttttagtcattatggtagaaacatggcaaatggatataaacaaaaaacatataattccatgcctctgttcagattgttgtctgcccctgagattcctctttttcccactccccttgactaactcaactagccctgctttttgtttgcctgtttgttctatttattttttggaggacagggtctcactctgtcacccaggctagagtgtagtgatgcaatcacaacccactgcagcctcaccctcctgggttcaagtgatcctcctgcctcagcctcccaagtagctgggactacaggcatgcaccatcacacctggataaaaattattttttgtgtaaagatgaggtctcactatgttgcccaggttggtctcaaacttctgggctcaagcagtcctcctggcttggcctcctaaagttctgggattataggcaccagccactgcacccagtcaactagccatgtcttttggtccaacccaatgttgcacctttgcataacaaaggcaattaaagaccacttcttccctcctgccccctgcaaaaacctaatagttctcaaacacattggttcatggaactcattatatatgaaaacccatcaacatccacacaattagcaaacttaaccctctgcagggttgacattgagttggaccttaagatatattcaaggctagttggctgggcttggcttgactcccccttagctctctctataaaagcaatgattactgtattatattggttttcaaagaattctgtcccacattctgttctacttattaccttctttgcttgactgtgatagattgaggccatctttctgtctgtccctgtattaatacattcaggctgctgtagcacaataccttagcgtgagcaaaggaagttaaagaccacctcctccccctgccccctgcaaaaacctagtagttctcagactcattggttcatagaactcattatatatgaaaacccatcaacatccatgtaattagcaaacttaacacacttgaaaatgctacctttcaagtcagtattcatattaggcagactttggagatgttgtggattctgcttcataccaccacaataacgtgattattgccataaagtgagtcacacaaattttttcgtttcccagtgcatataaaatttacgttgacattctactgtagtctattaaatgtgcaatagcattatatgtaaaagtaatgtacaaaccttaattataaatatttattgctaaaataatgctaaaaaattatcagagccttcagagagtcataaccttttggctgatggagggtcttgtcttgatgttgatagctactgacagggtggcagttgctggaggttggggtggctgtggaaatttcataaaataagacaataataaagtttggtgcatcaactgactcttcctttcatgaaagttttctctgtagcatgtaatgctgtttgatagcattttctaaatttatttcaaaattggagtccatcctctcaaacccagctgctcccttatcaactaagtttatgaaatattctacatcctttgttgtcatttcaacagtgttcacgacatgtttaccaaaagtagattccattttaagaaaccacttttcctcatccataagcagaaactcctcatccattcaaggtttctcatgagattgcagcaattccatcatatcttcaggctctacttctagttaccttgttctttccatcacatctgcaattccttcccccactgaagccttgaacccctgaaactcatccgtgagggttggaatcaacttttttcaaagtcttagtaatgttgatattttgacctcccatgaatcattgatgttcttcatggcatctagaatggtgaatcctttctagaagaatatttcaatgtacttcgtccagatccattagaagaatcagtgtctatggcacctatagccttatgaaaatatttcttgcatgataagacatgaaagtcaaaattattccttgatccatgaactgcagaatggatgctatgttatcagatatgaaagcaatcataatcttcctgtatatctctttcagagctcttgggtgattaggtacattgtcaatgatcagtaaaattttgataggatgttcttttctctctctctttttttttttttttctgagcagtagctctcaacagtaggcttaaataaaccatgatgtaaacagatgtgttgtcatccagactttattgttcctttgatagaacacaggcagagtaaatttatcacaattcttaagggagccctaggattttgggaatggcaaatgagcattgacttcaacttaatcaccaactgcagtagcctaaaacaagagagtcagcccaagactacaccttcgtccagcagaagactgttttgtctgcattgaaaatctagtgcagccatctttatcaatgatcttagctagaacttctgaatagcttgctgcagcttctccattagcatgtgctacttcaccttgcacttttatgtatggaggtgacttctttccttaaacctcatgaacaaacttctgctaagcttcctacttttttttcctacagcttcctcactcttcttagccttcatagacttgaagagagctagggccttgttctgggttaggctttggcttaaggaaagattgaggctggttggatattctgtccagacaactaaaactttctcatgtcagcaatcaggctgttttgctttcttatcatttgagtcttcactagagtaggactttcacttttctttaagaactttttctttgcatccactacttggctcagtgcttggcttagcttttagtctatcctggcttttgatatgtcttcctcaccaagcttactcacttctagctttttgtttaaagtgagagacatgagactcttcctttccctgaatacttacaggccattgtagggtcattattgacctacattcaatattgttgtgtctcagagaatagggagacccaaggaaaggggaagagattagcgagtggctggtcagtggagcagtcagaaaacacacatttatcaatccagtttgggcaaggtgtgtggcaccccaaaacagttacaatagtaacctcaaagatcactgatcacaggtcaccataacagatataataataatgaaaacatttgaaatattgtgagaattaccaagatgtgacacagagatgtgaagtgagcccatgctgttgaaaaaaaatagtgtggatagatttagatttgcctaacttaaggttgctacaaactttcaatttgtaaaaagcataatatctacaaagtgcaataaagaaaagtgcaataaaatgatgtttgcttgtagttttaaagttttgtatgaaaacagtagttggataaattgtttgcctaagcctcttttgtagtcagagggctattgtatgtacttggaaaaagtgtacatgctagggacttccagggcagcttgcatccctgaggacgggactaaaaataacagagtcccctgctttgtgggacctaaagcttgtacaatttgtgtgtgtgtgtgtgtaacgtcttgagtaaaaagaattcaaaatataaaaatgatttcatttaaaatgaaaaaagataatgaaaaattacagattttaagaagttggtaaatatcaccgaaatggataaattaatttactatttgcaactaactgcttgacattcttctataacacttttttctataaaattaataatgttcgctatgaatgccttttcatgtgaaaattctgtaatattcctttctacagataggatagaaaggtaattcagtctttcctctggcctggttcgtcaaactttctaaaaaattatggatagtttttagagtttatattggtaaatttaagtgaatttttaaaaaatgttataacttctggcaaacctctatcaaagtacaaattctggtcctgggtgaccagagaggacccctaggtaagacagcactgggggtgggaggagcatttctggaagccattttgacacctggacagtagcaataacttaattctacaaggacaagattgtaagcttttttttttttttttttttttttgagatggagtctctctctgttgcccaggctggagtgcaatggcacaatctcggctcactgcaacctccgcctcttgggttgaagccattcccctccctcagcctcccaaatagctagtactacaggcatgcacctccacgcctgggattacaagcatgtgccaccaggcctggctaatttttttgtatttttagtagagacagggtttcaccatgttggccaggctggtcttgaacccctgacctcaagtgatctgcctgccttgccctcccaaagtgctgggattacaggcataagccatcacacctggccgattgtgagctacttaaagataccccaccaaagaacttaaagtgttccatctcagcaccctggccctgtgttgtcaagctgctcccccttccatcatactgtgcactgtatggtgcctctttatgaaccagacgctgcttgtgcaacagaggctgatcccactgcagagactgtatttgtcttctctttattttactggaagtctttgccaccatccggctggtaattgctccacaccacttctgaatcgattgcttttagagttgttgagcttttattactactactcattggggagagaagagagaaagaagcaggttggcctgggctctgcaagagacggatgttgtcaaattgtctttctccagctgttgaatacaactcataatgctattcaataaaaccagaaagaaaatgagagtacaagggaaagaagagatgtcagaaagagagaacaagagaacatacgagtctgccttctcttggaatagacagcaaagccatattgtgatgttgactatatcatgcagtaatggtgaacaaatgtagcaagaagtaaaagacagagctatttaaatatatctgtgggcaattgcacaaatctgccacttttgtaggtatactgatgtttcctcattcctggagctgagaaaaagggtctatgttttgctttattttatttctttcatttagtttggtaggctatgtaatttgattcaagtatgatagaatttctccttagttatacacattactgttattttgctagtaagtggctttgtatccacaatcaggacactcttatgaactgtttacatctgctattgactgatctcgttgcgtttcctcatgctttcatcaaaaggtagcagttggcagggccattcactggagaatgaggaacacgcataattagatttagtgaagaacaccctcattccaattggaatctgtctttaagaaaagaaaagaaaaaaagctccaggttaaggagcttcgaaagactgaatactgatgtaacttttgttcatgctaattactcacaacccagataatacttcgtttaatgattttatcccatttgttatcccctataacattcatctgcataaattagtttcttgtcaacctttcagaaagggtttaatgacagttcatggtgtttacttattttctaaaagtagtctaagtgagtcattataaattgaacattcaagttaaatttgtctgaaacatatataagtatcatataaatttcagattttacacagggttctcctctactaagcaggtggaatataccccccatttcagaatgccagtttaaattacttgcctggggtaaaataccaaatcagagttggacataaaacccaggtatccttattctcattctactattctaataaccagatccaatgctataatgctgcaaattataggccctatttttcgagtaggatgcatgtgaatgtcatttgtctcttaaatgcatgaatagtgtcttcccttgtggtcgctctactgcttccagcctgtcatgtcaagcagcattgcctttattattgaaatgaagacgatacttagatcattgatctcaatggcatttggcaccataagaactaccagtctgttgtatcatataaaatgatactgcctggtatgcaaatcagccagtgtgtcaacaaaaatgctggcatcagatagaatgtccaaattgctatcactctgccagttttacacctacatccctattagttcctgtctaattaccaatgataaaagtactttgaagtcccactgatttccatgtaaatatcatacaaatttggatttgctttaacattataattccatcagcttagaagttaaaatttagaaaagctgtagttcattagtttaagtcacttcaaaacttaccttgcttagttttcagatagactcccatcctatacttctaggactgtacaaataaaaaaatgaattaaaagacatttcttgatgggtttaatgttttctactaattattttgacagacagtcataatctgttctgagttcttcttttctccttccatttcaattcttcataaaacatggaaaaaactttggagactgaataagatctatggtaatccacaatagatgaggccctgaacacaacatagggaaaacatataacccacccccaataagctcaacttactgtaaactcttgaggagtaattagggacttcagcagtctctctgaaaaagccaacgcattgtaaaacccttttagtttttacatgaatattaattctttgaaagtagatgaaagactttctttaatgctaaattcttatccatagagaataatattagagcgaggatctagtgtattattcccatttcatgaataggaaacggagaagtagagaattttagggaccataaaagtgacccaagtgccatgtgtcaaagctaatatacttaactcaagcctattccagtgggttctcacccttcacttgtgccctaaggcctggcagcttatttcaggagggacacccgttgttggtgtaaagagcaagatcttttatgggtatcagttttaaggggcttatgggaataatcaatatgctatggaagtaatgaagatatttaacgtcctgaaaattctagtctaagctttgagaatgtgaccataaaattgacagggattaactttaatatttgactagttaacggtaggattttttccgttacagtgcactgtgtcaaaatttggtctcgttaaataaattcctattctatcagggatgagcttcccacaaataatgttaaaaaaaaaaaaaaaaggagaaagcatgataaaccttttttcctgtttctcttcttctaaccacagggtgcactatggcagttgcagggcttggtaattgaattcagttctgcaacctgaatacatttctactgtaagtggatctccctcctctaccagagaaagaaaatggcctcaaatgattctgactggaacacagcagccacctctcttgtaaatagctgggtcttattgacttatcttggtagggagccaaaattgctgcccagatgagtccaagcagtagccagaagagaaccagctacttatggggtctctgtctttgtgaaataagtattaagagggtccatcttaaagaaggaagagaagtatggtcaggtgagtcaggcaatgatgcttagtgaagtacaacctcagagttacggtttttaataatacgcaaaattacatgtgtaagtgtattgatatgttttataatacagcatgcccagaatctcaaaaagattaaaaaaaaaaaaagatgttcctaggttctaagtatttttctttgcatagtggtttgagggcgagtcaagtttataggtgtgctgacctttaagagagttaggaataaaagagggcattgagagaaagtggtttgggtcgcagacaccatccctcaaatagctgacaatgaaggtctataataataattggcattatctcaatttgccaggtatctttagtagaatgtgctttatctaatacccaaggtagggtttcaacaatgttgagaatctatttatgaaaaggccaagatgataatgttagctaagtgctaaatataataaaaagtagtcatgaccaccattctagacaagcttcattgtcccgcacactttatctggacctgtggtttctggatggttaagcggcttgtactcacaaagacaaattgtgcattcttggaatacattcttggaggtctgagagttttctgtgagtggtgctgaaagtgtatatttcatctcaatgacaatctcaaaaaattataatgcaagcatattctgaatgatcttgttgaccacctaataaccaggtatttttatagaattttaatgcttgtgttgagttgtgttcatggggaacaaacctgtcataccttatttggtaaggactattgagaaaagagcagagccaggttgagaacataaggaatgcatttatgtcaaggaaaaaataaaatgatgccagagtctgattttaaaaacaaagctatctcacgatttcaaatggagaaaacagggagggagaataaaatcacagcaagcttaattaggtgtgagcatcatgacctcaggagaacctgggccagagaagtcaggagtattaatgtttaccatggaactggtaatttcatttaaaccaagcagcatcagctgtcacattaaattaatattattgaaattttatagcatttatatttatttgtatttaatttataaatgggtgttggttgtgtaagtgctataagtataaatggattgtagctagttttatgtttgtgtatatatatgtgtgtgtatatatacatatatgtgtgtgtatatatacatatacacatgtgtgtgtgtatacatatacgcacacatgtgtatatacatatacacacacatgtgtgtgtatatatatatacatatgtgtgcgtatatgtatacacacacacatatgtatatatatgtaatgctaacaaaaaataatttgaatgattgccaggggtccccaagaatgagctttttcttttaaaattggcctgtactttctttgagaagccttgccacgggtagaggagctattcagtgcctattgagtcaaaatttggccttaatataaatggggaggttttcccttgccatgtttggtgcctgctaggtatagtcacttgctctaatttcagtagggtggtggaaattaccaataggcagaaaaagacagctttgctgacacctatttggttgaattttacaaaatggaaggatgaataatacctcaaaggcaatctggtagattctttgagggaaagagatgtgtctatttacagggaataaagctaagcacattgactgttcttaggttaatggaaaagaataaggctagtgtaggagccagcaaattatgtttcctccataattagagtcttataaaaatatcagcgtgaattacttgctaaatacaaattacaattgttaatgtttgttaagaaaaataattcaatttagagcaagaatgaaagaaatacaggcacccaagaacaggcacagaatacaatcactttaaccaaagcttagcatggattattttcccccacttcagcttcaagtttattctaatctttttctggggggcaggagacagtcggaggggaatgcatctgtatgtcccagctgtgtggcttctgagcctgacacccctgtgctctaacaagacccagggaagaaatccttagcaggctcttacccttatcagaacaaagctatttagttgccaccttaactccagtaattaactcagtggagcaaatttccttatttcatgtaagatgtgagccaaaactctccttgctgcacttcttctatctctgggataaagccaaacagagaagaaactcaaggaccatagaatctttccttgcttttagttttcctttgaggccctacctcccaactccctcctcacctctctccttgaccactgagtagtaccactactcagttaatactgaattttcttcttttccaagccctgcagtttactctagaatttctactgacaaagccaaatcttgctgtgatttttgcccccatggagaagcatgtattataggaacaactaaccctttataacttaggaggccctggggcttcattgcattacagagtcatacaaccataaatgcccagacatacatcaccagggttaaatcattttcagtatgaaatgatgtaatccaatttgaacactgcctcaaacccagtgcccttcatgtggtaagtattcaatacatacctaatattttaactttatttatttttacctcctccgatacaaaaaaatgtaaataaccctcaatgatctgtaaaaaatcacttagttggaacactttgttcatcctctagcaatgtctgataagttagttatcattacatcatgaatcatgatactcctcatcaggcagtaaaaatacagtaatttcgtttaattgaagggaaatacatgtttaccttggtaaaacttatatattatctttaaataaataaagggttatcttgttcaaatagcttaaacccataatcaaatgttgcttatagaggtcctgctttaaggatctcataatgatttgcatatcattagcttgtcagaataccatcctaaaccttgctgatatctgctctctttgcagttcattctttgttgcatccaagtattacagtaagttgttctctggcaatttgtttatactaatgatttgacagttattttttgacccttgaatgacataattatgttaaatacagtttaggctagcttgtgttcaaattgacatgaatttttaaattagtaatgttggtatctagtatatgacagaaatgaaaaataacgtattttgtatttatgcaagaaattatctgtaccgatcaaaactgacctccggacacaagaccagactggacttgcatatgttaatgggaaacaaaatggggaaggggctcctaattacttaagtttattaagaatcccaggatacctcttagaatggtagaggtgatgttagcccttatgtcctggacatgatccagtttaggtaattgctaattacaatctgtctacttaattcccacggcccttgcttctgaatgttattttcttcacttagcaatatttaactattatttgctcttggtgtgtgactgttggaacatctgctgattcctccttctacgttcggcatgatttgcttttcatttggttatttgataattattattttcatattatttttgttctaaatatgtctatagatagaaaacagaagccctgtaaaagttttagatattttttaactgcgtgggctggactatgctttgtcaatcgagcatacagactttctggatgtaagtttgggaacagtgggcataccactggcccatgaaacactcactataagatagtgtcaactcagaggtgaatcacagatagaccagggttttcagtgtcttcaaaactagggctgaaatcacagcacttaggggcttataagtagatccctctaaggatctatcctattctggagccattccaaaacaagagtacctctgttttgggtgctagagcatgctttatttcaatcacaattcaatggaactgaagaacagaattagaaagtgatgagtcaaaaattcttattcaccgcaaatacagggctagataaactccaggtattccacacagtttccatccctctgaaggaagcgagattactcttgtgtccgctcagctatgagcaccttgatttgggatatattgcttggagttcagatggagaagacatccaggttttatctataaactaccctccatatctctaaaagttacttagaggaaatcactgagttgaaacttcattcattccctagcattgtcagatgaactgaagcatctttttcaatagtcaatatatcctgagccttcttagtgaacacagtgcttagaactttcaatgaattcacctctctaagattatggactacatattccaaatgtgtagattttgacctaaattttacccattctacagaaaaccaacaaactccacctcagagagatgttctcactatatctacccaccagggtaccagtctaaaaggccccaatattttctcctgtgttttctgaataattgtgtttgagctagagccgggagactcctcctgtggcttttattaatggaccaaagtttggttcctgtgaggactgcaatgtgtgattcaaatgcccagtccatgattcagctagtgaggggagtaacccattttatcagttgtgctgtcttccactgctgttctctatattccatcagaggaaacaaatggcttctattgtgcataagaatgccatttagtcccaagcaccatttgaaatggaaatgaggagtaacagtaacagaagaacattggctaataattgtgctctgaatagccatttggccatgtgggcagggtaaaggtaattgtgtcctagagtaatacatcttctgagcattccctgagactataattgctatgttgatgggatgcatttttaaacatgtgattgcggctcttagacttaaaaaaaaatggctattttcagaatgatctgactttaagatgtcaggcaagattttgaagtcagaataacaacacacaaacacagatctaagatgtattattgtgtagctacttgtctaactgcatttttttttcttaagtctcaccctgtcttggtgatacacagattaatactaacctcctaccaaacaatccctgttgccactctactgaaaatacattcttgccttccacaagcagaaggctgagtgtctttgtggcttaggagagaacaaaaacacatctatgtattcattgccttgttcacttgcacaaacggagaaaactctttgaaaacatcttcctttctcctgagtgaaagaatgagcaggcgctgcctcccctgatttactgcacccatcctaatcagggtagatgattctgatcttgcattaaacaattactatgcaggctctgggcttaagttttgacttaagtttagaaattgagtagttcccacaatgccctccatttctaaatgtatgagaagaggatcaacaaagaaaaaaattaatgggcttttgaatgagcaacgtgtgtgtgtgtgtgtgtgtgtgtgtgtgagagagagagagagagagacagagagacagagagaggcatgatcttggctccctgcaacctccgtctcccgggttcaagtgattctcatgcctcagcctcctgagtagctgggattacaggtgcccgccaccacacctggctaatttttgtattttttgtagagaccgggttttgccatgttggccaggatggtcttgaactcttgagctcaagtgatccgcccacctcagcatcccaaagtgttgggcttacaggcgtgagccactgtgcctggccaacagaacatattttaatgtctgaaaaaaaagaagaatctactttaaacatcaccagaagggatacacccttcggtgtccccaggccttgctggcttgctgtgggtataaagcattaattcttgtcatttgctggttatagtcctccaccaaaactcttcagttcttggcctctaattcaagctttcttccaagtttctctccactctcactgtgtcatttctaggaggcctcagagttttccacgctagaacacagtcggtactctcatgtgtgttttcattttagcctctttgttgatgtctgctgcctgtcaatccacctgggtttgtaaagtccctgaagcaattcctgccatgagaatgttccttcatccagaatgctgccttctatgctccccaaactcaaagaccttcagggaccagtaaactcaactgcccaaagccaagcacagctgtccacagaattggggcagagattcttctccataggactctggcctggtgcataggtttggctgaggaaaagacatgcttttctccttccccttttcacttctatcccttttcaccaggactcttgaagaatattctcacaggcctcgtttcccctcaggtcagaaaatatgtgcggaacagaccctgagatgctgactgtgcaaggctgttcagacccagtcaggtcaggccctgaatccttgtgatatggaatgagatatgataaattggaaattgtctttaataaattgccattcgtgataattctagtgataattaatctgctgaggctgctataaaatatcatagactgagaggcttaaccaatgtatttccacatagttttggaggctggaagtccaggatcaagaacaaggtgctagccaattggctttctgtgagggatcacttcctggcttgcagtcagctgccttcttgctgtattctcatatcacctttcctaggcagatgcatgcagagagggcaagtgagctgagcaagctcactggagtcttttcttgtaagaacactaatcctattggatcagggccttcacttttgtgacctcatttatcctcaattccttagaggccccatctccaaattcagccatattaggggttagggcttcaacagatgatttttggggcaagtattcagtctatgacaatcctcatttaaactcatcagggaccattgataaaatgctattcattcttccctatgctggtgtggaaatttgccacccaatggatgcctgcaatatatgccagagactttaggtacgctgtggcatggcttagtgactatgagaagactgacatattagcttggactagcttttgttaagcaaatggactattttacaatccaagaaaatgaacaaaattccgttttacttactcaagataaaaatgcattgatactgcaagacatatcctcactgaaagatagggtcacttaaaatatcccatttaaatgcaaaggacactagaaagtatagcaagacaaggtaaagaaaataacaaccttgctaacatatgactaaaataggaactggcagctgggggtgatgagagaaatgaaggcagtcagctacacactgactgccggggagcatcctgcacctcagataagggagcttccgcaatgaatgcctgggcctttggctttgtttcaagtcttttgatctagcggagtccataggatcatttttcccgtgggccagacctctggagaagcaattggcattgttagtttgcactgttagttctgaagctagtttggtaacaaaaagttattgtagtaagtgcacttgtgtgtgtatgtgaggggtgtggatagatgatcatgttcaagtctgtagtagaaaatttctaattattgagtctagagaactaagaatacttataggaggtaattaatccttacccgacatgtggaaaatgtcttataacccttctgtttaatttaacaaaaatatagtctactgttcagatggttaccactcggagcaactcaaactatttccctacagattttcctgtagagaatgaatgagaaatttttttgtttgtttaaggcctgaaattttactaccaaagtcaaattttgagtattgattgttgagtcctgaggatggttatattatcatgacaaatcttgcttattgtttttaattagacaaaattttcaaataactgtgagttattacatatctcttttattatagtgttctatagattgtattttgtttcattacccacactacacacacaaaccacatatacacatgcacaacacacacacattctttctatacttcatgtgaatgctttgagacaatcctatttaacattgacaatgaacaggacagctggtctctcaataaaatctaagataccacagtagtatctgcaaataatatataaattagaaatatttggaatgtttagtttatttgctaaagctcttcagaactataaattacaatattaatgaacttatttttaattcccatcactttcatttttatagaatccagaaataatgcatgtaacttgccattcctccccattagtacacttgagtccaaaggagaggttcacagcatcgtgctcttttgtgatgtggtttagaagaaaaccagctcaggacaagtggactctgaaaatagcagactttcctttactcatcttttgagttttcagagaagagtagagattcagttcattggatattttctttgtactaggctccatgctagaaattggagaaaataataaatgagaacctatctttaattaccattctagaaagaagacatgtacattaaggataatatgtaatggatgtcataatataaatatgtacaaagacaaggtgtagcatagaaggcagatgaattgttatgttgattggagtgtggtttctgttaagggatgacattaatgaggtatcgcctttgcaacttcaagaatgaatagaagttaatcagacaagaaaagaaccatttcacaaggaacaatatgtacacataattcaagacagccagaatgtgaagtaagaggagactcaagttttgtcagcatattatataagtaagggtgagttttggctttgagagttgctttgttgtgtttttccagatagatgtttttcagatatcttctcccctgtgagaaatttctgcaggtttgattgatcctttcagatgctttttaaatatatattagtttcatcactttaccacattgagagtccatgtatctttgactcaaatgcctaggaacagaagatgtgaggaaagggagagagagagattctgtcatttaacaattattattcaagtacctaaaccaaatcgaaatgcctaaaggaatgcagtgggtgatgtaaaagaaggtgtagggcaggtgtaacaacacagaatggtagagaggtgggaggtggggggacgggagagtacgcagctcttctaaggtgggcagctgccttatagcttcagccagttgtcacacagcactggttttgtcagttttcagttctttgaaaaaattggaaatgtgaaattttatatggaactgtcaatttgtggaagttagaaaccactcgcaggccagcactgggaaggccatatccagcctgacttgctctgttttatacaccatgcactctcagtggttgcctcaagggctttagaaagaaggtcaaccctttgccttgtggcttttgtgcattgctttcttaagaggaacataaggaaactctactgttctcagctgctgttgtggttacttggccatttgtaagacttatatataataatgaagttgtcttggagggctgccatgtccgtgatgtagttgcttatctaattttgtaatcttttatcaattccctctacagcttgaaggccaggctgagggtatggtacagaatactaagtggtttcaaatcaagtccaatctctgttgcaatttttattgtgataacaagatatattattaataacaataaaagacaataataatgtattattatattgtaagcttaccatgaagtgtatgggcaacccaaaaagatattcagccatcattaaaatcttttctaatcacagccacacatttcatattatattaaggaaaaacataaaagcaatcttgatgttaagtagaattagtaaagacctaaaggagtataaccgaataaacacaaagtagaataagtaggccagaatatgattgtattctatcaacaatgttatatttgcttagaaatctcttatatttcttcctccaaatatgcgtgcatgcacccacacacacacacacacacatacatatatacatatatgtatatctgcaattgtctaaaggtagatggtatagcataaaggttaagagtgtaaatttggggttcatactactagagtttcacaactgcctatgtagccttccaaaaatatttagcatcctgagctgcagttttctcatctataaacaaggattaataatagtatttatctttgtactattagatatgattgaataagatatttcatgtaaatcatctagcgtactgccagatatattttatagtcattattaatgcaaatcattattgtatcattattattactggagttttaactctctggctgttggcaggaggcctcagttcttctacccatgggcctctccacagagctgcttgagtatcctcagacgtggtggctggctttacccagggtgagtggactggggggtttggggaacaaactaggtagaagaacacctctaccatgtctattctttagaagcgagtcacgatgtttggcccacaataaagaagaatggaaatatttgctaaagattttgcagatgtattttaaagccacaacaaggcaaagggttattattcttaatttgcagaagtaattgagactcaatgagattagataacatacccaagaaaacacagtaaattgcataacttatttactggagctcctccccaaacccctaaactatgtgacattcttgctttaaaaaaaaatggattatacagcacgtgtcaccactgcattctcttttttatgttgttcatgtgtgtctgtgaaatgtgccttctaataaaaatttgaggatcttatacttttccagaatcattttgttgaagtcatgttttggagtacatttgtatgcaatccgtctgataagggaagtatatttctcactggaattagtataggcggaaaacaccatcaatcatagtcatcacaaagcaattaagtacctaattgttcatggctctgagtttgctactgaaacagaaaacttcttaggcttgctaagaaaacttcttaggcttctaagccctcctggggcttggaatccaagaattcagtagaagacggaagcgtggtaaggagaacaagaactgaagacataaacaaatttatttgaaatatggttgcagtggagcagggagagtgaattcaggggaaagaaaaataaaatgaaataagatgctgaggttcaagaaaggataaaaggtaaagtggctgaatttaaatgacctgggtttcagtttttaacaaaacataaaaataactgaagaaaggctctatattttatttaacaataacaacaacaaaaatcaaagtgcttgtttatcattgggactcaacttttgcagagtttttgccttaatttttttctctctaaagcagaatttcccatcactttagattcctttccgtgtcaatgatggcttttaatcccaatttccatcattacccctcagtgaaatgattgcttccatgtttgagtatatatacatatgtctgagacttaggtcaattattttcatgcagaaatcggggagggtgctcctgtttttcatatgcatttgtaaatattttcaatcaatcatgcatttataatccaattgggaagatatgattcagacacaatagcccgtctgctgcaagagtctgttataaaattgatcagttggccaagttatgctatttttttaagttactttgctttctttcagggaagaagaaagacaaaaaagtccagaaaccagcagcagcaggtgctgccaaaatggtattcttcttatctgtgctgatttcaaggggtgtgcaaaagaatgtgtagttgcttttctctctggctgttgggatggcgtctgtctctctggcattatccacttatttgatctagctaagtataggagcagaaataaattaaaaatgctttttcccagaagccccaaggatgttattcacacattctcccttctactgatctctgccagtggtgtgtaaatatatatttagggggaagtggctgaagtcaaaagctctgttggatattctttccctttcagttacttaccttcttatgcacaaatagaaagagagaaatcagaatagcagagaaattaacagacatgacagcacaacaccttctttcccatgtgctgatttgaagaggctcatgtatttatgtcacaaatgtcaaaattcaagtttctaagcaaaagaaaaaaggaaaaactgctaaatgttaagtgatttgcttatttgaagagttgtattacaaagcaatggaatgggagagctctcccagcccaggaaagacaaatgggaagacgggtctattttcattttggcattggacagaaggcagccttctggcctgctgtcacttcctatctgttcagtcttcgttttgcttccccgctgaccatggatcggattctgactcatatcagagactccctcttctgatcctatttatttatctgaggattttttcttttctttttccatagactcctagaatccagaggaaactcagtggcatctctcatattatcctaagctttctcagaaatgtgacatcaatattttaaaattttcagtagttatcaatatttcttaaatctagcagtaaggatggtctttgaaatatcttttctaaattccttctgttataataaaagtcagtgctcttttatatggtttggctgtatccccacccaaatcttgccttgaattgtaatgactcccacgtcaagatggggccaggtggaggtaataggatcatgggggcagtttcccccatactgttctcatggtagtgaataagtctcatgagatctgatggttttataaatgggggttcccctgcacgagctatcttgcctgctgccatgactttgctcctcattcaccttccatcatgatagtgaggcctcccaagccttgtggaactgtgagtccattaaacctgtttttctttatcaattacccggtctcagatatgtctttattagcaccatgagaacagacaaatacactgtttatcatattcttgacagcaataaaacaattgcttactgtcagctcttaacaatctttagtataattaagatagtctatttggattctttttcagagccttctatttttcagtcttttgaatgtactcttattgctaaatttggaatatttttagttttgctgcatcattttttgaatttacctttctcccctcttttgcctattcattattcaaaaccagatcaaacactctttctgtgaagtcagtaacttactccttcagaaatgtaggtacattgaaattggtaaacattatcacactttgtacatacttttacagtgactatgtatatgtgtgtgtttgcaaaactttctgcctcattggacaataaactcctcaagtgcagagatcttgtgttatttatctatgtgtcttcagatactaaatgtggcacatagtagagctccatacatgtgtattgagtaataaattaatgaataaatatgatgctggtggcaggtaaattcttggtgtttactttgaggtccggatcaatacaggatcaggatagtgcttctcttacatctgtttgcacagcagaactgtactgcactgaccagatgtctcaaagtaatgtccatcttgcctggaagtgtctttccttacttggggtcttttaccttcagaaatccaggtgcattcacaatctgcactgttattataccaactctaggtgaaggatgcatgatccaaaggtccagagtttgaaagcttgcagtctgcaaaactgccctcacttctgatttgaattgcaagttcaggggtttctccaaatcactttcagatttgataatttgctcataggacttacaggactaactgaaagctgttggactcatcattgtgatttattgtaaggacaggatacagattaaactcatccaaggaaagggacacatggggcaaagtgagagagctccagatgtgtagcttccagttgccctctcccatggggtcaaataactcctccaggcaacagtgtgcgacaataggcacgatgttgctgacaacagagctctcctaagctttggtgtctgcggtttttggaggttgggtgggtgcttcagcacatacacatgattgcccatatatatatagctaatctcggtctccagcccctcaggagatagacctgagaccatgcgccccaagtcccacaacctaagccgcatcgttggtgtgactcacaacccccaccataagtcacattgtcagatattctggcatggcagcacccacactaaacaaagatgtggctcctactaggcatgctcctcctagggctaaaagatttcttcctagaagccaagagcaacagccagaccattccctgggcaagattaaattccttactgaaccacattttagttcttccacacaggtctcaccaaacctataatttccaagtgagagaacaggaagcctcatcttgctttcacagcttgagacaaggcaaaaggaaacgctgttttgaactttgtagtcagggtgggtgtgtttacaagggatacaatcccctcaagtcaatttaaatcaagaatctatatgtacagtggcatacccagggtatgtggctgtaagtaaatcgtgttttaactctctccctctactttcttcctctcaatgacaaaattattttcagtaataattatttaataatatagtaattctcaccatattttaaaattgctcttcagttttaaaacaatttacaagttagaagcatacatttcaattttacagctattattcaaattcagtagaaatatttcacatatgacctgaaatttgaacttaccaagcaaaagtattatataacacagacttctttttttctactttactgagtgagtggacacagatgaaaaattctaagttagaaattctaagtggtcctaaggaatgaccaaattgaataactcaagttttctttcttttgtcattacaatcagtgtgctatcactttttattttaaatgttggtttaagcaaatgtgtacgtatgtgtgagatatatatatatttcatatatatatatatatataatatatatataatttcagcattaaggagacattgtgcccacataaagtgataatgagactggaacattacaaacttactccttcaacgaatgcatgtagccaatctatgtgtgatgggactgataatataaccaggagctctccaaattatcattcatgtagaatacaatggtttttaaataatcggtaatagaagttattaatttgaggcttacatatgaatctgaaatgcaacaatgtctgtagaaattgtttagaattttgacaagatttgtttgtggatggagtttctttttaaaagattgatatataatattttacatatcagtggggtccatgtgatattttgttgcatgcataacgtgtaatgatgggtatttgggatatccatcaccttgagtatttatcacttctatgtgtaggtaacatttcaagttctctcttctagctactttgaaatatactttgttgctaactatagtcaccctactctgctatcaaacattagaacttaaaccttcttctaactgtatgtttgtaaccatttgccacatctctttatcccctcatcccacccacacacccattccagcctctggtatctatcattctactctctaccttcttcatgagataaacatttttagctctcatatgtgagtgagaacgtgtgaaatgtgtcatctgggtcttgcctatttcatttaacgtaatgacttctagtttcatccatgttgctgcaaacacatgattttatccttttttatggccaaatagtattcatatatatatcacatattttccttatccttgcatctattgatggacatttaggttggttctataactttgctgctgttgtgactagtgctgcagtaaacatgggagtccaaatgtccctttgatatattgatttcttttcctttggataaaaattcaatagtgggattgctggtggatggagtattttatcactgacattgtttagaattgtgaagggaaagcagaattaaattttctgtctctttaaactcagtcatcttttctctatagcacaaaagattatgttttttttttttttttcataactcagcatctttgtgagctatgaaacttgccctgatagccttttcttgcctagggtaggatatattctgaggaagggctgggactgcccatgcattcctgcagagcattcacgggtgctatttacagtcctaattaaatggaggattattagaaacgggaaggcagctataaatagcatggtccattttatctgtttctttggtgtgtaggaagagcattgctaagattctcccttgaagttcagttaactcagaatgtgttctgcttttgttattctgctttggcttaaaaaaaagtctcctgatgctgttcaaagtggggaaaagaaaacaaaaacaaacaggagtcactctcagtcattttagcatatggacagaaggaacacagaatgaaatagagttggggaggggtgtgcacggtataagaaaaaaaaatgtgggcctaatcctttccgataacttttttttctgaaaacaactattaataaatcttatttccaagtctgtagaatattggttctcttcatccaactgtaatgtgatcagtctgttcagggagcagaggagtgggtatgggagccttccctctccgtggtcctgttagggcaccttttccagggagtggggactctgctggcttctctttcagcacactggacggtgcagaaatcagctcaactctagaggcagtgctgggattggaatggaacttgacctggatcaaatcaccgagcctttgcaaattcctgattttccaagttaggacatatctttagacccagagcccttaatcttggctcttgggataagcttccttactgcttctctcaacactcatctccacctccagcctctgctctacaagctgccactcatctaccttacatctctgatccatccccagtattcaacagccttcagcatttcttggttacctgttttaaatttcccaagttcttaacctgtgtttataacaactcatgaacttccaaccaacacatcaactccagctccctccagtactccttctttcaaaagggttctagtcaaaggggtttgcaggcattgcttaagctcatggggtgttttcgtcaatgccccattggatttgttcatgtctttgtttctttgatatatcatccttcttctcctacttatcttaattgatctcaaagctcaagtcaaattatatttctcccagttggtaattattttccccttactttaaattctgaaaacgctaatgactgagcttttcatttagtactaactggatggttagttttctttgtgtatgtgatcgtttacgtggtcgttttgtttctcaccaacacattgtaaactcttttagaattgttatctaatagaaatataagtaacataaacctgtattatatttttggagcatctgaaagatttctctcaaatggtctcatctgatccccaaagcacccctctcaggaagtaatttttttatttttatttttggggaacagggttttactctgttactcaggctacaatgtggtggcacaatcacagctcaatcagccttggcctcccaggctcgtgattcacctgcctcagccttcccagtagctaggactataggcacctgccaccacgatgcccagctgtttttgtttgtttgtttgtttgttttttaagtagagacaaagtcttgctatgttgcacagactggtctcaaattcctgagttcaagcagtcctcccttgtcttggcctcccaaagtgctgggattacaggcatgagcaaccatgcccagctgaggaggtataatattatccatagtttcacatgtaaggtaataggagctcacaagggttaaataatttgcatcaaatcactcagctggtaacttttagatccagatttaaaaattctcaacttctgactatatcctatgttttttgtttggttttgtttatagcttgcagttgcttttataattattatttttttgagacggagtcttgctctgtcactaggctggaatgcagtggtgtgatctcagctcactgcaatctctgcctcctgggttgaagtgattctcctacctcagcctcccgagtagctgggactacaggcatgtgccaccacgcccagcaattttttttttttctagtagagatggggtttcaccatgttggccaggatggtcttgatctcttgatctcgtgatctgcccgcctcagcctcccaaagtgctgggattacatgcatgagtccccactggatttgatctttacaaattaatattagcacttgttaactaaaggaatgaagaaataagtgaaagaatgaaggaataaatacataacaacattatgtataacacagatgagtgtaatgattcagcaaaacttcattataatctcttcagggcacctcctggaaacctgagaaataaaactgttttattactggtacttgcctttctcgaaaactgatagtaaacgtcctgacaagttagtcttaggtatctttccttcagttcaatagcaaatgctgtttaaaagcaaatacacagcatttatagaatgtttttgcctcttcattatattttactacataaaaatctaaaacacacaaaaaagtaaaacacaaaaacagtctaaagtgtgacactgatttcagtacaatacatctagagggaataatttttctctaaattcccaggtggctaaaaagagggctctgtggatagatgtggaaagcgtgagacagatgcttctctgagcctcgggtttctcatcttaaaatagagataattacagtacctacctcacaaggttgtggggatttgttgggaggatctaagtaaagcccttaagacactgcctgggtataaagcagctatgtagcttctagtgtcttaacattgctaagaaaagaaacacacttgccccctttttgcagaagtaagctcctttagtgattttcatctcattttcttctatactttttttttatatttgttgtgagcacgatcttctcttttttaataaattcatatttttcaattatttttattattaaggtaagaagtgtgcttttgttggtggaggaagaaggaagcccctacatgcatagcaacgtccatgggaatgaatcactgttcccttcttttctatgaacttaagattatactcaagccactccagaaaatgaccatgcagtcactgtaagcaattcctctaaaattattaaaaactgtttatgtttggagaaaggcagcccctcttgcagtgataatgactgctatatgagaggattaagctgattacatctttggaatactgagattgtgcaaaatagagggaacgatgaactctccacataagctaaggaattcagcaaaaggatgaatcaacaggagagagagaatatgaagcctctatttggaaactgaacacgtagcctcccagataaaagtgagaaagattttgagtaatatctgaagtcatgtagctgagaagttccatctacacttgagaataaaaacaaacaaacatactctaggcgatgtctatgccagttccatgaagtcatcatagacttgcaatcaattgcttgggaaaatagattttaaagttgaatttctggctattactaggataattttttctcctggacattttatgtatttatgtatctactttggtcagggtgacaaatggtatgtggtatgcagagcttaactactactcctagcccccaggccccataatcttttagtggattcagccaagcagaaatgtatgttgaataaaaccatgtccagggggtgagcagaaagaaatgcatttgaggaaaggatattatgtcaatcccaaactcgatgaaatgttctaagagtatcccagagattggttctatgaatctagtgaaacacagaataccctactcttcacagatgggtgtttatttgcatgagtccataggcatgtgagcttttgttccttagctggaggattagagggaagaaatgacataggtgattagggatgggggagagctgggatgaatatggagaaaggttagagaatgcaggcggaagttgatggcagcaatttgacttagaaccttatgggacttgggacacacgcactgtaaccttgagacctagataacagtgttttatacagattcggagaatagattatttctcccacaacccagctactgctatgggtacagctttagtgctctgcgggctcagctgaccacctgaaggtgactggctggcttggagtgacaatagaagagcctatagcacttgtaagagcagggtcctcactgagattgtgcacagcagagggagccatgaactccctgcatgagctaaggaattcagcaaaagcatgaatcagcaggagagagagaatatgaagcctctattcgattaatgaacatgtggcctcccaaacaaaagtgggaaagattttgagtcatagctgaagtcatcatgtagctgggatattctataaacatttgagaataaaaacaagcacagcaaccaatgtcctttctgttctaattaggactaacttttgagtgctagagactagagggcaggcatagccctctatggagatgggccgttcaagttttaataaatgtgttgcatttgtcatcttagtatggcatgacaaatgatctattttatattaggagctgcccaaagatgttgggttaattttagtcaaagtgattttatgcccacaacatctggatgagtttggtcaaaggaaagaagtttagtagactcataaccagaaagatctttgtcttcacctggcctgccagacttctgagggagtaatcatgcccaatatagtaactggaaggacatgccacttgtttggaaggatagaggcatagcctgagaagataaaggtgaaatctctgaaaactttgataaagaggctgggcacggtggctcatacctgtaaacccagcactttgggaggccagggcaggcagatcactaggtcaagagattgagaccatcctggccaacatggtgaaaccccatctctactaaaaatacaaaaattagctgggtgtggtggtgtgtgcctgtagtcccagctactcaggacgctgaggcaggagaatcgcctgaacccgggaggcggaggttgcagtgagcggagattgtgccactgcactccagcctggcgacagagcgagactccatcttaaaaaaaaaacaaaaaaaaaaaaaaccaactttgataaataaaatataactctaactctagatagggaccgaatgggggtataatgtttgtttaagtttttgggagacacttgataacacaacctggatatggtggagagcattcacattccttttcagtagtagcctcttaacgatgaggtatggatgaacagcaaattgctgctgacttattaattaccatgcccacaccactgatttccctatgtcttacctgtgcacacacattggctttacagcatacgaacgccaagtttgtggcgtagcatatggtgctccctcaaataagcacaactgtctgcctctctgcttatctaatcatagcaacagaaaaattgacttttcagttttcttttccccaggccctgggagatgcatatgccaaatacttggcattctttgtaacagagtcaatcataattaggattccaaattaaagtacactgccagccagggcatgtggtattttatattatttgtttgaacaaatgtattataacttgaaaatggcaaagtaaaagaattaagtaaagctcacactttttatatgtaatcatcttgcggagttttattttatcagaatgttagatgaaatcagaaagcaaagaatgtaaaatagaaaaatgtatctgaaactttattcttttaagtaacaggtttggttttttgtttttgttttctttattttcattttgtttggtttttgaaatgctcattgtagaatgttgaatatggtcagatgttgggtgtgaagtttattagaaattaaccctgaaaaagtatggtatagtcattcagttgccttttccagtggagtctgatttggcctggcgggtgtagtgaaacattaactacacccgcctcagccacccaaagtgctgggatcacaggcgtgagccaccgcgccaggccctaaagcacatcttgattgtaggttgagggtgcagtgccaacaaattctactttcatggctcttgaaattctgtgaacatttaagagccactttgacacagccatttcttgttttttgagagagggtattattgaaattctttttaatccaagatttttgtgacaatttcattcattcctactttctttacaccagtagtagctattcatattcattcttctattttctttgcatgattaactggcatatactagttcttcacattattagcctaataatagtagttacaggctataataggctattaattcattatcatctcctgactcaagtgaatctgctggtaactgagagctcctactcttgtcaatggctttgatcccactgatgaccattttagtgctattcccttctcaccatggttgagccttttctacatattcctctcagaatggttgtgccagactttcacggggagccatttttaaagctatcctcactacagaatatggcagcatttcgttggcagtaaaatcagttaaactgcatatagaatgctttagtttcttctgaataaaatgtgttacacaaactgaagtcactgctctttttaaaaaccaaagcagaataaaccgttttgtaagataattttgccactataaatatagtttcctttggcttcttcttggaaagattttatttcagcttgcactgtgagatctttgtcgttttcaccacacatttccgtcaaggaagcccttggatgactgccatgatttgcctctgctggacgcttccttcaagggctgtcaacacctctcttaattgtctggcttaaacatcaggcgagcaatgtgttaaagttagatggcaaatatacttaagacaaatatgtaaatttttactctttcaaatatgcattcaactggtgtgtatagatttcagaacaaaagccagagagagagcaagaaagagggaggagagagaaatctatatgtataaatagaaaagccaaggtagaaatgctgtgtgtgtaaatacccaatttctggattaagacgtatcacaaatacatatgatcaatacttatgtacatgcaagtgtactgcctttccaaacaccagcaaatcttggtgagcagaaatcagtagactgtccatagtgggatctagaatttgaatggaaacggtcttcaattttaaatattcatctgttttcatttgtagatatgacactcactttaagaggtgatctgagttcaaattccctaaattatatttgcatttgacttattacacatattgttagttgtcccttgaattccagtttctctttgagtaagttcttagaagatatatgtagctaggtgacttatagtcacctcttagtcattctcaaatatgattataggctatttcagattcatttcaggaaaatgtcatgtgtcaaggtgtcaattctgagcaatttttacattttgccaattctattatagaagtggctctcacccataagtagcttgaaggagtcagtatgtaatgtgccagtctcattttcactttatgtgggcacaatgtctctctaatgctgaactgttatataacctgtggtctatctgactaccatagcttcgtagatcaaaatattgttatggtcatataaatgactataatgtgggtgttttagaattgcacttttgtttatgcataactggtcccaactcaaatctgcttcatcattttttagtcaaaggatagtttttcatgtcagtagtacctcaaactccgcttgtgaacttaacacccagctatatcctgttagtttttaatcaggagggaaaaaaaggctgctatttgaactaaactgacagcttttgttgatgagctgttaggcagattaaattctgtcttgctcttcaattgttcttgaggctctgtgggacttacagtaatagaattttatttgtgtcagtaaagttgacagccctgattcagaagaccacagggagctgagatgttgattaaggagcatcatattgaccatggcttaagtgggtaacaaatgaactgagagagaagactctggatctacttttgcctgtccatgaactcgtccaaagcaaatatgctttgagttttcatgtctgttttttaatttttgtggatacacagtaggtgtaaatatttgtggggtacatgagatgttttggtataggcaagcaatgcatactaatcacatcatggaagatagatagggtatccatcccctcaagcatttattctttgtgctaacaaacaatccaattatacccttttagttatttaaaaattctattgaggctggacacagtgacttatgcttgtaatctcagcactttgggagggcaaggcaggaggatcccttgagcccaggaattcgagactagcctgggcaacatggcgaaacccaatctctacaaaaaatataaaaattagccaggcatgctgacatgtgcctgcagtcctagctattcgggaggctgacgtaggaggattgcttgagcctgggaggttgaggctacagtgagctgtgatcatgcccctgcaccccagcctgggtgacagagcaaaactctgtctcgaaacaagcaaacaaaaaattgttaaatcattattgactagagccacccattgtgctatcagatactagcccttattcatttactctatttttttttgtactgagattttaatttctgtacttagtaatagctttcaaaattgtcatgttatcccaggaaattgttatttttatccaaggcttattccatttttttttccagttgtttggggcccacaatattgtttcttttagaaataaagttagaaatattcagaataatgaacacttaagagagaataaggagtagaatacctaaaaaaaaaaaaaaaaaaaggaatcaaataaggaagagatagatagtaaaagagaagtggatgtaagcaatttagaatatattttatcaaaaattgctttttaagtggcattttctcttgctgcagaagacattattgaacaaaaaaaaagcccaatgcaattcaatttaaatttatcactctattattttaatatatttactcagggttaacaactcattaaacaccaaattgctcactcttaatgagtctctgacgctaaaattgagctgacttaaattttactgtaaaatatcagcaccattgcataaaactgtaataaaaattaactaaaagctattgaatgactgtggagtggaaaacagatttgtgacacaaaacagaaaatgtagcacacgatatgtggctggcagaaacatgagtaatagcttttattcaccaaaacatgataagcccatttttcttttgctgtattggagtctgtgaaacatgaagtcatgttttctttttttcccccattactttgtacaacgagggccagtggtggaatgatacagtttggctgtgtccccactgaaatctcatcttgaattgtaactcccacaattcccacatgtcgtgggaggaacccagtgggaggtaattgaattatgtgggcaggtctttcccatgctgttctcataatattgaataagtctcagaaagtctgatggttttaaaaatgtgagtttccctgcacaagctctctctctttgcctgctgccatccatgtaaaatgtgctgctccaccttgccttccaccatgattgtgaggcctccccagcgatgtggaactgtaagtccattaaacctttctttcttttgttaaaaaaaaaaaaaaaaaaaaaagattatgatagtgctagtcaatactgagttgactgtcaaaaataagcacactttacattagccagttacttctgggacactgttgaagagtatgtcacatgtacccacaaattagtcaaacatctttaggcatcacatgatatctaaattagtctttttctccttctccatcccctggttgtccatgaaatattggcctcaaatcagcttgcctatggccaccatggaaaccatccatcatgaacagcacctatgcccctggtacaggagtgcatttctccccaagcctacagtcttctgtgtgtcacagcaatgctgagtttcccacagaggtggcgttgatggactctttctcaactctttgctatggagtatcacctgggctaagaagttctgcttttgcatcaaatttcaatttttttctttttattggatttgaattgttctggcacttttgccactatgctgtctctcaagccctaccatcccctccatctttctaaggtctctcagaaccttagctccaacaaaacccccttctttttctctcattataacacaaatttcctgtgaatatcaatgaagcaaacagatacagtgggagctcgtgaaagacaaaggacaccgagctagtattttcattaacaacatgggctcttgtactgtcaaccaacaagagctttgttataaatttattcacaatggcaatggctttgggcaacatttagatggaaagtatttatgaaaaatatactatttatgtttctggataggaaacatactattcatgtaacaaaatatgacatttaaaggaactcactttttcttttttgttgacagtcaccgtgtcatcaaggaaatcaacatttagaaattatgattgtcactagctcactctgagccatggctctacattttatccttgtcaataagcaatccagtgttaggattttaaaaattgtttaaaatatccgtacaaagagttattttctatcttggtccacaaatttgtcaatattttccacagcatcacaattgtcagaaaacacagtgaagcttaagttaaaacaaatctgcaaagaaaaagtcaaaaagaaaactcttccacagattttcagagagatgatttattagtccaaatttgagcattgaaactagcctatattctaagtttaagaaaactgtaattttcatgtttctttcagttcaatacaatttatatattgaatacaaaagagattttcacttattgatatggctttctaggtgtttaaattctaactcaatattttaaggattcagtaatagtagggtttccatttctacatggtaggcattctctagtttacttttcctcttctttctgtagaaattaactatttttgcttcacagtcatttcatgatagacccgatttcttacactgaaattcattttaatgtttggattgagcaatggtttgctttggtcttaacttttatttattgaggtataacttacatacaatgaaaatctcaaatcttacatctactgttcaatgagttttgacaaatgcataccattgtggactccatccacatccctataacaaagcagggaactttttcaccttttcagtaccctgtaaaagttacctcatgcccaattctccccttcctctaagcaaccactgatctgatttctatcaccatagtttactttttcatgttctagaattttataaaaatgaaatgatatattgtatccttttcttgtctggcttctttcactcagcatactgtttctgagactcagcggattgctttttaataatataattacaactgagtctcaaagatttgaaaaagtcagaatttcttataaaattggacattgtggtttgctacctgctgaatgatgaagacgaataatgtacttcagtgccctgagatagtttttgtctactgtaataaaatatttccagtcttctctgtttttgcattcttcaattattaccttgaagttttaatgttttttaaaataatgaattggcctaattgtagcctcagcacaactactaagttacacattcaataaaaagactttttctttgtaatgttatatgttaatggtcagcctcctagatactgatgaagcccatcaatttctactgatagttaagatcaattaaccaattagttacccattttcatttttcctgtatattctttgtagatcacttactaaaatgattttctaagaccttcactttcttaagtaaagaaaaacaatttgactgagacttggccatttagctaaaatctaaaagacctatttaatttaaagtataagtcaagcagagatcttatcttctgtccataaataataagaatgattgtttttcgctaagtggaaaaagtgagatgaggcaagaagttgaagaatgcctagccaggtagcatatgaagcctacaagtttccagctgtgggtctgatgaaaaataatgagacatctgatggaacttaggatcttatttgaaaaataagccatcaagtactttaactttctggtatttcaaaagtaaaaacatatactaatcacttgtttttatttcacttatttgacactacacatctgtcttagtacaaactcatgtttatgcaatgagatttattagactgatagttcatatcttagccccttttcatagagaatcattgaaaaaaaaactgttcactgtgagaaaactctctcccctcactactgatcgcttatagtaccaattcagtatatgagaagacactatttttacaattattcacatccttaagaaaataaaactctataatttaaacaatgggagtataaaggtattttagaacgtatttgtatatgttaaaacaacagcatattaaaaatttaccttgagaaggccgggtgtggtggctcacacctgtaatcccagcactttgggaggccgaggcgtgcggatcaccaggtcaggagatcgagaccatcctggctaacacggtgaagccctgtctctactaaaaatacaaaaaaattagccgggcgtggtggcgggcgcctgtagtcccaggtactcgggaggctgaggcgggagaatggcgtgaacccgggaggcagagcttgcagtgagccaagatggcgccactgcactccagcctgcactacggagcgagactccgtctcaaaaaaaaaaaaaaaaaaaaaattaccttgagaaaaacaagcaaacacatgaacctaaaaaggcaacagcagatatagtgttgattgatccactgccactccagaattatttatggtagcaaaaataataattttcaatttgatggattcttatttaagcagactcattatactttttggaaaataaaatattaacattcaatataatatgactacctcagtcactttagctccacaggtgattgggatagcgctgctggcctgaataataaaatggtaataacctcagttagaacaaataattgttttactagttcagatacacttaacattataatagatgccctcataaggtgctatgtataaatcctttttttgaaaaaaagcttgaatcatcatgtaaatgttttagggcaactcattgcttagagaaatcctttgaagttttcttttataatgcaaaaactcctactgccttatctgttttgtaaattaggttgtattcgtaccagttttgttgaaaagtgaaacatccttctaagcatgaaagttttagaaataatgtctaagtatatctaaagtagctattataggacataaatgcattgatattttagtggatctcagtctagaggtgagaagagggctaatcataataattgggactgagtgtgttagaattacacatctttcccctgctctgataaaaaatatcctgccatagagagtcactgatactaatcagagcatgtcatatctttcagatatttggggacagagaaaaaaaggtgatgaattacagtactagagatactatagcctttaaaataaatattatatacttttggttctacatacttttaaatgaagatggtccatgaagtaagttatgatcaaaactaatgcaagggcttacagcctaagaagaaagtccagaatttagagaatggtgacctgtcttttcttggcaactaatattatgaacatcaatttctcatcactttgtggcttcaagaaattctcccatcatagagatgaatcacctttcttccaggtcttcaaaaaaaaatatatatatataaaggtctgtgggagataagcttagaaacagtggctgaaaaggagaaaaattcagatttcagtcctcgggggtttgcataacaaatgatgaagtatagttttatagctcatctaagtaccttggtgcttcttttgggtacaagtccctgtttattagacaggcatggtgacttctagatacattcttccaagacatcaagataattttacttcttagttttttcacatgttaggcaattccaagattaatcgtgtataaacttgtttgacacttgaatcaatttttggttttacataaacggcattatttcatgcatacctcagctgaaaattggcagttatgtattagtgcttgattttctagaccagtattaaaattaccttccaaaaatgtttcagttgcagaaagtattggtggccaacaggtcttccatgagtcgggacacattagccagtgtcaccctttctctagccagtcagttctatgagaatggtattggaagaacagacaacctacctgcagcacttgccctgtcctgttcatattgtggacaatcatcaaaagataaaagggcatatgaaagatttatggtaaatgtcttccattttctctgccttgagtacactggagttagctttcattttcatagttgcttactatgaatgtcttagatgtagcatgagaaaatcttatattttctttttgtctagaactctgctgttcaatatagtagtcactagctattacataattaaaatatggctagtatgaataagcagataattttaattcttatttcagtataatttccatttaaatttaaaaactcaagcagtgtaaaatagttttcatcaaacacaatttttgttctaataaaactatatttcacctaaagcactgaaaatttagcattgagtttcagtgtgctgttaagtataaaaatatactagattgtaaaaacttcatatcacgatataaattatctccaacaatttttatatacattagatgttgaaataatattttgattatattgggctacacaaaatacattattacaattaatttaacatttctttgtacagtttttaaatgtgaatccttggaaattcgtaattgcatatgtggttcacattatgtttctcttggacagtgctgagctagtacattctgaaatatgtagcaattatttctctatggcttcataaagaaaatgtcaatccaaggctgaggatttatttatgaaaatctaaagacagccggttttcctgatggttcatgccgtgggggaacgggtctctttcccaatatataagaggacaaatcttgggatgggttttttttttttttggtcttttatgacattctttaatgatttctcctgtgcttgccattctgccttgtacgtaatacaccctttctagcaatgggtttaaaggtttttccttcctctcctttttgagctgtaaaatatgcattatggggagaggtgagctgatagttgagaaaggtcattaagggttcagcctggcttagtcggaaagatgtgaattcaaattgttattctcccagatatatactaacatgaccttggggaaattgcttaacttttctaaattttagtttgcttcatctgaaaaaggtacctaatagggaagttttagatattaaaatcaatgaaatttaaaagaatcaagaaatatgataatgcctagtatataacaggccctcaaatgtgttctgaaccaagagatccctgtaagagttaaagaaacaggaaagaaacacgaaaagcggctcaacagtcaaagacaggttaattttgcagaataaacctgagaggggcttctggccaatttttggacaggagcactctctcttacagactaagagtatttattggttttagggcgagagagctttatcacaggcttggaatgtttctgtgtgggggagaaatttatggtggggttggaatgtctctgtttggaagggaagttatcctggggctgacctgtctctggtcggggaggggtttatcttatggttggaatgtttctggactgggatgttatttgtggtttatggtcatgctgacgttagccattaagctgatgccctttggatttaggcagtttttgatcaaggggaactttagaatggtggtgcttgtccaagatagccatgctcccgctgtgtcaatccccaagttttaaatgtgtatctttacttagtgacttatggagtcgtaactattaggacacatacagcagtaagtctaaggcatataccagcttatcagatggatcccctacctggcaaagggaagatcctctttctctactaccttagtccttctttttatactctgtgcagcttttcagttcttccacttgcattaaaattagattacctcttagattagatcaaaagattgtccctggttgtgagaagaaagaatactttaatctagcactaatcccttaatacaccattatatttgggtacattttttttcctagcagaaaaattatttttcagccttctcagaagtactaaaagtcctttgccaacatcagcccagtgcaagttaacctgttatgagatttgttttgtgctttggaaatgcttgtcagacaagctttcaacattgagatgtgtgatttaaattagtttgcataagaaaatgtaatgccagggacaaatttctctctttatcccttcttatactacaaaacagacaaagagggttaggtggttgctttttagtatgcgagtaatcacttgggattcacagaaatattagatgcagtgttattagtgaaaccttagttccctttatagatatgtcttatgtcccatttgtaatattattattgttgttaccatacgcaaactttatttcttagtttggatgcttggtctcaaccagacccattacctccttatcttcctatctcttagggtcacttcatgcttagaggcaacttgttgaaagtggaggtcagcgtgatcctttttcttagaagacatagccctttcatggaacttacgtagctgattcatagcctgagtcagtctcttggatctgtgaaaaaaaggaaaaatgaaccagacatggtgtttgcagtcagtcttctttgaatataaaatatataggcagaggaaaaaattaaaccaggcagattaacctcaaggcataaagacaaatgctaaaatgtactctaacgtgaagggttaagcattccaagatgcccgttggaaggttctttatccaacacttctctacccattccaaccccagtgtaaacattaaataattcttttaaaatttgaatactcaaacaagaaagtaaagcatggaagataatttttaaatcattatgtagtgattagaggaagaggaataaagggtaatgtgagattttagaaataggtgctttgaatagataaagagatattgcaaggatagatgaactcactatcgtctttgcagtatagtatcgttggtgcagaggatttgggatagaaatccagtctgggggccgagatgtgatcattatgtgcaatatcatcttcaaaaagtcaggtcatggttatcagtttgctacaaagaacatcttagtctcatttcctgtccaaggcaggaattttcccctgaacattcctgacagaagataacctgttttgtgctctaatcacccagtcttctaccagaggttgaagtgacattttggctccattttctcgtattttatgcaagaagctgggaattccagcatcttactctgctcatcagggatcctgagggagctggtaatatgcagaaaggatgtcaaagggccatgttactaatagctgtggaagctccgctatccacaaagcagagattatgaaacagtctatactttggctagaagcctaagcagaatctcttctacttccctcaaaatctatttcttagcaccagcaagactgggtctgtccagtgggttgtgggtttggggagaagcagaggaaagattgacatcatgtggaatctggaagagacagaacacatctcttggtgcttttgaaggtacagtgactccatctagtagtaaaaggtgttcaaatgaatggcttcaaatttgaccagattatcaaatgctgcttccctgataaacagctcagacatgggttagaagaggtggccctgggatgggaagcagtgcagactctcatgtatgaatagctccaattctcaaaaaattcttttagttaactgctgtctgtcttcttctacattgcactcaagcttaactctgcacttttaaaatcaacatataaattataactttctctcctatgataacttttcaaatgttttttgacatctattcagtaccgagctcccttttgaaaactgggccatcatttcccaacctccaatttctgactgtatttccataatttatttaaagactcctaacaatggagccacaatcataactacaggtcccctttatatctcaggatgacattcatttggttctaatccttgaactcatttgaagattctaattgctcttgtattctctcctcttctatctggaacttatctccctgataagcatctgtgttgtgattcttctagagtggagattatttctcttgtaaggaaaaaaattaaaactaccttgttctactttctctgttgcatcacaccttctctcttaagtaatagtcctaaaccttctctgttcttctccagacagatcataaatgttacaccccaacctaaaacaaaacaaaacaaaaccttccttcatgaattattattggccttgtatgcaagactgagttgatcccagtctcaatttacctgataccatctatttcaacaataacaataataacaacaataatgaatatttatttagagctttctctgttccaagcactgttctgaccactttatgtatatttacttggttgactctaacaataattactgaggtgggccaggcacagtggctcatgcctgtaatcccagcactttgggaggctgaggcgggcagatcacctgaggtcaggagttcaagaccggcctggccaacatggcgaaaccctgtctctaccaaaaatacaaaaattagccgggtgtggtggtacacgcctgtaatcccagctgtccagaaggctgaggcaggggaatctcttgaacccaggaggcggaggttgcagtgagctgagattgcatcactgcactccagcctaggcaacagagtgagaatctgtctcaaaaaattaaataaataagtaaataaaaataaataattactgaggtggctattactaatttctctattttggtgatttggaaactgaacttagaagttaaagggcttgagcaaatacattggactaaaaggtggaggagctgaggtttgaagtttcaatgcaggcatctggctccagggttcatggtcttttaccatgatgccatgctgctatgtctacttataggagtatgcacgcttttatgttctttcctgtttttgtgagccttattctagcttttatatatttttaaactctgagctccttagagagtttccaatggccagtcaaatttatttaggtcctctgaatagtctctgaatggaagaaagtgtttttcatccctaaagcccacatgtatacttcagatgcacaaggttcaaggtcagggcctgaaggagaaagtatcacagcacaagtaacaatgttaaacttcaaaggaagataaaacctcaaaataagatattaaggtcaaatactagaatctgcagggacactgtcctggttaagaggcaatagaaaggaagtagcataaggtgattcagcaggggagagatgtgagaccaacagcgttagatcagtggggctgtaagagagactctccaaattcatttatggaggagaatgccagaagagtggggagagagtgagctagagattcccaagtcccctggcaacgcgaaataccaggggtactagcacccaggtctttgcttctaatgccattctctaatgaaagggacaaggcatccttggaaaaatggctaattctagcacagagcagggaatagacaagatgagcccggagaatctggtagtgacagaaaggaagaaaatgcagaaagaaaaaggaaggaagacaagggaagggaagggatggtatgaaaggaaggaagaaagggaaggaaggaaggaagtccaatgaatgggattggggtctatttctatctgtgttcttaacaatcttcttcatcagggattagattcttgtttttttctttgttgccttttttttttttttttttttttgagatggagtctcactctgtcaccacgctggagtgcagtggcgcaatcttggctcactgcaacctccgactccgtggttcaagcgattctcctgcctcagcctcctgaaagctgagatcacaggtacacgccaccacgcccaactaatttttgtatttttagtagagacggggtttcaccatgttggccagaatggtctccatctcctggcctcgtgatctgcctacctaggcttcccaaagtgctgggattacaggcaggagccaccgtgcccagcctgttgccttgtttctgatgggagtccaagaatctccaagctatctatatgagaaagacaaaactactctttctatcctgtactgtaatcctacctgacaaatatatccttcatgctccttgtcattttgagcaaatagcctgagcttacctcactttcatttgaacttcctccctctttattgccaaggtactacgttcctttatctctgtgcctgaacaagccccccttgctataatcttcatgctgacccctcattctctagagtatatgctgttttctgcagcagactacacggccagtgcccttgcttggagcagatctagacatcatatcgccacggtcttcattctgaagtaaccttagaagtcactttcagttcataacattaaagcacaggttacaactcatatgactacatgggccatataaaataaatgagtcaatgtgccgaagatcaggaaagtgatagctcaggcaagactgacactaattcttggcctctctgtctaagagacagaagagagtgctagagactatggcacccaggagaacccagaccgaagagggcagccactgctcagctgctgccagtcatcacagcacaggagcaatggaccaatattatgaatttatcttcttttgaaagacaatccagaagtcgagacttttataaaaagtctgaattcattacctgtattaaattttctttgatttaaaacactgatcaggctaaatacaacatacctgtaagatattacatacctactgcaagaaccctgcctctgcatataaaggagaaagataagcacagttgattctcttcacaagccctgtgtcatgcaaacaggattaatagcccagttctaggctaacaatttcatagcaaccatgtggttattatgtgttgtatatatgaaattatgccataatgagctgtctcctaacaagattgtgcaggctataaagctgttttatagctccaagagagttgctcctgagttcattgacagtgcttattgtttctttccatctcagttacttttgaattaaaaagtgctcaccctactctttcttctcggctacaagttttgccatagtgcacagtgtttcttcatcttactttctttaaagaacctttcccatctcttcagttatttctacctgttccaacctccctcctgatagcaccccagtagtgggatggaatgtgctggaggggtttggccagttcttgggggagtttcacagtcacctgtctacagtttcagtgagatgggaatttatcaagctgaaattagcaaaagacaaaactgacattgtttaaacacatacttaacaaaagatctaaccagttcctcctagaactagaagatatttgaaaattagagaggagcttttttttttttcctatcgctttctttaaaacacacttttccatagataatcttatctttttggcatcaacaattatttataattctggaatgatttccaaatctaacttgtaaccatatttccaactacctgccaagtgtctgtgctggaattacctaatggcatttgatcgtggctcaaatgtgctcactcaactttattccgtgggctgctcacctcccctgtgtggagcctgggagcctctgaaggcaaatcttgactcatctctcacctctcaactgatcaaccagtagccacacctgacttaaatgccatctggaatccagttctctttcagctcttccatttcttacaggaacttttacagtaacttctgaactgttactcttgcctctgaactgcctcctttccaatttattattcacaagttccctggagttattttctttaaaacaaaatgacagctttgtttcgttaaaagactgtcaggttactccattccattggccagagggaaagggacaaagcaagtacgtgcccacacaatctctttactgtggtatttggtagctaatacatctttcaagcctcatctacttcatcgcctcctgcaccccaagctggaattacatgtgtcttattgccctgtccctgcatatcttctggccttatagacctctgtgcctttatctatgtcgttccttctacctcaacaggtttctgtcctaccatggattgtctaatgccttctgcacatgttctttatcctaggaagcaaaatatttattccttttcctgcattctttaatacctagtttatgcatgtctcattgcacttattctaatcggagcttgttcttgtcattttttttcatatttttttccttttgtgggggagtttaggacccaagtctttgtcctcttttggtttaactagtaccttgcacagaaaaggtagtcaataaatgtttgaaaaaaaaaatcccagtttgataattagttgaaaatttcttcagttaatgaaaacttggtacaaccaaaggaaaatgaattatcagagtttactatgctccatgagattcttttcatacaagtatgctgcagaggaatggaagagtgggaatataaataaatatgaaaaattcttagaacaatcttcttattatttgagacagagtccagctctgtcacccaggctggaatgcagtggcatgctgttggctcactgcaaactccacctcccaggttcaagcgattctcctgcctcagcctcccgagtggctggaattacaggtccccaccaccacgcccagataaatttttttttgtatttttagtagagacggggtttcactgtgttggccaggctggtcttaaactcctgacttcatgatctgcccgcctcggcctcccaaggtgctgggattacaagtgtgagccaccgcgccctgccagaacaatcctattttctaattggggtttttctttgttttttgtttctttgtttgtttgtttgagatggagtttcactctgtcaccgaggctggagtgcagtggtgtgatctcagctcactacaaactctgcctcctgggttcaagcaattctcatgccttagcctcccgagtagctggggctacaggcgcctgccaccatgcccagctaatttttgtatttttagtagggacgaggtttcaccatgttggccaggctggtcttgaactcctgacctcaggtgatccacccgccttggcctccaaaagcggtaggattacaggcatgagccactgctcccggactttttttttttttaatccttctactttactcatactctccaaagttaattcacacacaacctccccaataaaatggaagtgaggtttaaaatcagaccataatttaaccagctgaccaaatgccattttgtataagaagataaaaagctaccattgttgttatatctcagagcagaagctctttcttcattttattctttaaaaacatcattcagggttgggtgtggcggctcatgcctataatcccagcactttgggaggctgaggcgggcggatcacttgaggtcaggagtttgagaccagcctggccaacatggtgaaaatctgtctccactaaaaatataaaaattagctgggcatggtggtgggtacatgtaatcccagctactcaagaggctgaggcaggagaatcgcttgaacccaggaggtggaggctgcagtgagccgagatcaagccactacactctagcctgggcgacagagtgagactccatctcaaaaaaattttaaaaataataagtaaaaaataaaaacaccattcaatttatagttagcatgaagctacaccatcaatctttcctcgtgttcatgatcatggctcagcatttttctgaagtgtcattaataagccatgttagcaggaatgacctacacatatgcatgtcaggagggcttcaggccactgctgtctgtgtgtcaccttgacgtcagccttgataattgtccagggcctccaacttcacagcagtacctgggcctatgtcaggttgagttctatgatcacacactattttcatcagaaattttaataaaattatttttttctcagatgacttcccgcatactactaagtgatctgggagaaggagtcttagggtgtggatgggattctgccttgggcatattttgctctactgggccctggagtctttgcagatgctgtcaagatactgcacttttttttcttttttgagacagagtcttgctctgtcacccaggctggaatgcagtggcatgatgtcagctcactgcaacctccgcctcccaggttcaagcaattctcctgcctcagcctcccgagtagctgggactacaggtgtgcgccaccacgcccagctaatttttttgtatttttagtagagacagggtttcaccatgttggcccggctgctcttgaactcctgacctcaggtgatctgcctacctcggcctcccaaagtgctgggattataggcatgaaccactgcgcctggccgatactgcagttttgatggccatcactggtacaacaccctgcgtatgccaagactgtcatgccttgtcagctataataaaaagcaggagacaaatggccttttgttacctgaaatgatggatcagtatgtatgtgcaaggatgcacgctgtcaagttcttgtgggttaatcatgccaggctgatggaggggctccacgagttccaaagtagaaggagcttgaactccaggctgtggctttgaagcagttgttttctctggaattagctaatgaggctctctttgtttgaggattggaaagcctccaaaaacccactcaggagggaaattaacaaatgtctgttttgttacctccggataaatcttcatgatgaaatgtgcagccggtccacctcttcaatcttctctcttcttcttcctcagtggaagctcaattaccatgaaggccaaaataaataaataaataaacaacaaaccaaccaaataaataaataaagcagataaaccgtggttctttgcttaaaaaaagttgcagcaaagaaaagctttagagtaatttctagttagaagtggctgtgagattcactgtcttctggtgatatttgaaatatactatattcatgcaaatgtttctgattatttaaacacattatctgtatctataattatcagtagctgctggcattatgtgagcatgcaaaagtgggaacagcagcagtaacctgactcatttcaaccaggatggaccatctcagagggtcacagttactaatctctgcatgaactagattttataaggtattatgattctttcatagcttgtaacttttcattgatcatcaactttactgatttttgttaatactggaaattttaataaatgggttgtgcacaggtacttattgagcatctattacgtgccatagaatattctgattattaaggatgtcaaggtatataatccagagtcacggttttcaaggaactcagtcaataattacaagctaatacatgggtaccactgttctaggcacagcgtggcagaaaagaatagcgtggacacacattcaggggatttaactaggagaaaacagtaaggaaggggatcttagcagaggtagtatattaacagatgtatatgacaacttacactgctgtaagtcatcctgtttggctggcaagttttgctttagaaactgggtaaatattgttcatgaaacttctgtgtaagtttcacgtgaatgttttcctatgtgtatgtgtgcatgcttatttgcatttgtgtgcacttgtgggtatgtgtatttgtcctgtgtcacaataaaaggtatctatttctggactttgcagtcaaaaacattggaaaactgtctatgtaggtaatggacacaatagaatttagaaagcaacttttacaaacattgcagatttgtaattttctaatatcattgatatataaagctgagtataccagacacttgtaaagaaatgatcttttccaatgaaaacacaggtgttaaacagaacctttcttctggcctacaaatcactcttctaacacttggaaaaaattaaagaaatattcagcaatgtgtagaatttcaatcccagagagacaggaagagactgtatagctgcagatgcaatatgcttgttattttggcaaaagcgtaacataagaagccaccaactctcacagaggaagcagagaaattcagtatttgcttgtaacttagatatttctttctttgttttccccctaagaagaacatatcttttctggtgggaaaagggaatttagataattaaagcagagggaataaacattttcaggaccaaagagaaaatagccgtttgagccacatatttaaatgttaatctacaatttttttttttttttttgagacaggatttcactgtgttgcccaggctggagtgcagtggtgcagtcttggctcactgtaacctcccttctcccctcttgggctcaagccaacctcccaccttagcctcctgagtagctggaactacaggcatgtgccaccatgcccggctaattttttgtcaagacggggtctcactatgttgcccaggctggtctagaactcctagactgaagtgatccaccagcctcagtctcccaaaagtgctgggattacagatgtgagccaccaccgtgcctggccatcaaatgtttttcatagtggactagggctttatgatcccataaaaattatttccctcatggaaccactccatttatgtattataaagctgtcaacatctggttttattgataaatatccctggggtttttgagctttttcttttcaacatagtgcctgtgttttatcttgacctttgctttaaaattactgctagatgtaatgaggattctggaaagagcatggttcaagattttgtacaattgatataatgattctgaagcaaataatgggaaaggggagagtttcagaatttggtggccttagggtaagcttatgatttgttttatctttcctcatatctacctaatgctgtgaaattttgggattagatttggattggggacaaatgaggagtggaaatagtggagggagaaagggttaggaaagttacagaacttggcaaggctcttggaggtggtggattgatttctctggtgttgtgaagtgtcatcttctttcttcagttaaactgaagtacaggcaagcttctcctgctgcccctcagtttcactgtgtcaccatttttagtagggataagcagagacttgttgttggtaaggacaggaaggaaggtgatgctgatgaatttttgctggtgctaggttagctgccagccggcctggcaatggctgtggtccagccagcctggggcgcttctagtattctctgtcatggggcaatatgttaacgaattaaaatgccaaatagaaatgagacagaattccaaagacatgtaaactgaaaaacacctgtccccatttgttgattttttttttcctgcatatacttaaaaaaccccaaacctttatgtaagagtctcaggagtgcagtgaaaaaaaagtgtttattgacgagccatttccaatttaggccttaaacttcaagacccatttctaagacccatatgcttcaaaacgttctatataattcagctcaaaaggatcttcctctcctctagatctataatgtttattgactacatccctcaaagagcagtaatgcatcatggtgaaataaaaattgaactgcaaatccgaagacttgaattctagttcctgatcgtttttcatagtgtatttaatcacacagtttaacccctaggtctccttcactgtgactcattatggtgagttcgcgtgagaaagtgtccaccataggacactaaattcaaaagagtgaccagtaatgattgttgtcccaaggatgtccaaatgggaaaaccattatcagtctacactctaaaccagaagggacttattccaccaaaagaggttaagggctccttaccacagtcacaaaaccagaatatatattctttcagagaaaacccggatacagggcatgagattagaaccctagaatggcatatcaaaaacttctggagtctgttgagtagaagtttggagaataaacaaattgatagattgatatttgaatccccggcagagtaagaggaataataagattttgaatcaagaagaggaattctgccacatgcaactaggaagaaaaaagcaaattaactgtgataacactcattagggattatcattatatctttaatgaggaggtaataaagactgattatttactaggcatcccttattgatccctatttatcactacgtagagtaaaatgtacaatttttcctttcacttgtggatttcattaatttatacagtcatcacatattgattgtacatatactgtataccagacactttattagctttaagaataccaaaacgaatatgccagatatagtatctaacttcatggagtttgtagagagattttttgaactgaatttctcagcaaactaacacaagaacagaaaaccaaacaccatgtggtctcactcataagtgggagttgaacaatgagaaaacatggacacagagaggggaacatcacacactggggcctgtctgggggtaggaggttgggggagggatagcattaggagaaattcctaatgtagattacgggttgatgggtgcagcaaaccaccatggtacttgtatacctaggtaacaaacctgcacgttctgtacatgtatcccagaacttaaagtataaaaatgagaaaaaaagatgcacaaatagtgtcacatatagtataataatgatatggatatggcctaattcatagagtcaacattctgatactaagaggaaggaaaaatcaaaacaaaataaagaaaaaacaaagcagacagtagcctttaaccgtttccttttaaagaaacattgttatctgggttcattacttgttagaaagtaatgtgaagcacttaataaacttcaggtggtggtattaggtaattaacatgtgaaattcctcatatggttatttaaatttcatggtagtatttaacagttttcatgtttatggccttttcctgcaactaagttgtaaaatccttaagggaaaggatgaggaaaggaagacaagagagaaactagcatttgttgactggctactacgtgccagccacagcactagctactaaacctgtgtcactttatttaaatatgaaggtcagaaagcatttctcatgttcctggtatctcctgcactgcctagtataatatttcatacttacaggtgcttcatcaatatttgtgttggttgacttagcaatttaaactgcttctaaatagagttacgtgagtttttccccaaagactcatgcccttttttaggaggcaaactagccctttccatgtcaccttccttaagaagcagggcaaagaggtgacagtttttatactgaaatcagttgtttaattgttcacccatttatcaaagcctctgtagagttaaagacaagtacagtgcccatgtaccctttatgctgcaagttctggacagatagctgtcaatgcctgaaaatagtgtaaattcactgggtgaagagagcaacttgccagggggatgtgatgtagccccttctagagtatggggttttctacttgggcatagtcagctgctagtttgttggattgctgctgctggggaaagaccaggccacttcatgatggaatgcgtcaacttttggaaagtcaaattcaggatgcagtttcaactagtagtaactatatttttctatcttttaaaaagtgaaggagcaacagaccagtctagacacatggacgggctttagggctcagttgctaaagagatagaagtaaaatattatagaaaatgcttatagtacatgttaagtgagaaaggtaaggtaaaaatggtttatgacctataactgtgtgaaaactaaccaaagagacacgtatcatttaaaaagatttaatgttgtgcctgtaatcccagcactttgggaggccaaggcgggcggatcacaaggtcaggagatcaagaccatcctggctaacacggtgaaaccccgtctccactaaaaatacaaaaaattagccgggcatggttggggggtgcctgtagtcccagctacctgggagactgaggcaggagaatggcatgaacctgggaggcggagcttgcagtgagctgagatcatgccactgcactccagcctgggcgacagagcgagactccgtgtcaaaaatgaaagatttaatgttggtcaaattatacacaacgattcaacagtactggaagttgaggaggacgagcaagccagatagcaccaatgatcatgaataaattccttatctttcagaaagcattattgttcagtggtttcaagttttggatgtgcactcacattgcctgtatggaatcctggctccacaagtagttgtgtgagattgggaaagttgcacttgtttaatctgtaaaatggaaaatatctgaggattaaattaaaatatagctggatcatgcatagcataatacttggaatatactaagtcatgaataaatagtactgttgtcatttctttgacattaattattaaggcaattaggaaattttccatctagttaacatatagcaaatcaaactaagctgtgaaaaatatataatatgctatggtaataagacactgaactgtgatgctattattggggtctgtctaaatccacagaagcatcagaaattcacataaatcaatgctaatgtcaatgcctagtaaattatagtctcagaaacatgaagattctagatgttttccccttctttgcacactttgtttatatttcaccctattactattatcacctatatttatggtttttcaatcatttgtgagtgcttggaggaaattcattggttcagcagttgaaccagggtattgaatagtacatgaggactctcagactctgaagagctggtcgggtgtctctggctaacacatttccagtggataaagagctgctccagggacatctccttcctctgcagtacagtgatctttttgctggtgactagaaagtccaggggaaaggacagccagccaaagggtggcaaactgatggaaagtgggggcaagctttctgtaaccatgtaaaagaaactgccaattcccatgaaaatccattgtctctttttcttattaacaaatccccaacaagccaccatggctcaagcctgtaatcacagcattttaggaggctgaagcaagagaattgcttggggccgggagtttgagaccatcctgggcaacacagtgaggcatgcatctctacataaaaattttacaattagtctagtgtggtggcacatgcctgtagtcccagctactcaggaggctgaggtggatcgcttgagccaggagttcaaggctgcagtgaactaggatcaagccactgcactgcagcctaactgacagagcaaaatcctgtctctaaaataataataattttaaaataaaaataaaatgctaaaatgaaccaaatctccaattttatttgaaataacactgccttagttttttaagaaagaaaataaaacatttctcaccttttctaacagtcaagctggtatgttgctttaagtttggtgagtgtcaggtatgcaaaagtgttgagtggcagatacagaaagactgcttaaaggcatctgactcagttgcaaaggacatcctttgtccttcttgctgcctgtactatgaatgtagtggttggatcttcagaagcctatttaatcataaggtaatcttaaagatggaagttatgattaagaatgccagaacacaaagataaaaaatatagaagtctcagatgaaatttctgaatcagccttaaactataatgcttaaactgtttaaatgtgaagggataaaatttggggcatttatgccactattttatgttatcgttgttacagtgagtacaatttttaattggtatgtgtgtaagatttgctcagatctcaatcaatggttctaagaggaaaaagcttaattccaagctgcctctctcctgtctatgatatcccaagcatcacaaagtacacttccagctcctcagaccctgtccttgttttgcattgtttagccaaaccacttcttaacttcaagtagcaaatagataactcacattagcattaggttctcttattacaagtaattgacaagaattgtaccagtgattaggtgttgcccaaagatcttttaaaattccatgtgacccaaatactaccaaatcctaaaagatttaactaactggctcactaaccaatgcacacacatacttacttatttcacccagtatgtgttgactaccttttgcccaccaggagctaggcaggttcacagtgcctagctcccaggcacaaagataaatcagaaaccattctgtctaagtcaacctttcattttagcttagcaggaaacacactaaaccacggctgaaatatgccaggaagttggtagctggtgatgcctctaccacaccgcagtgcggttaatccagcattcgacttagtcgaaatcacttttttcttccaatactggcatttttatggatggatggatggatagatgaatatcagtatcaaaaggtccatgctttattttctaataacaattcatgtccaattatctgactgccagcacagttatctgctatggttgttagaaactttagaaagaagtaaatcctccaaaattgtcactcttaaaatctgagagaaaacagaatgaatagataagagatgcttcaaggcagttcagctctgtgatggttccgttgagatagaacacacatatacaaagtgtttgaagtaagaatttccttcgaggagaagcacaaagggaatagaagacccagcatttgttactggccttagataagcttactgttcacttatttatcaatgtaaaaacgcccagttagtttttagctcaaggaagagaggacatggccaaagatggccttcatgaacttttttttttcctgtgtgaagtatggaaactcattttcagtattggattttgactggattgtcttctacccagaagctggctctgcagaagttatgatcagatctttggaagtaacatttgatctaccgccgaatatagatccccttccttccctcttctactccctccttgcttttccttcttattacactgatttcatgcaaaattaattatcagtcctgtcacatcttgcactgctaacagtggtcagtattgaattatggggaacgtgaacagaattttcagcagcctaattgcttctcctgtgcccagcaaaatgttacgttaaatactcacagcaagtagactagactgtattctatttccataacaaactggcgggatttcattaccagaatccctagcatctactcacatgactctttcctaactgccctatcagactggtcttggataaagtaaattcctttccaaagctgcagctgcctagttaggtattgaaatattgtatccacttgcaggtcaaaaaggaaaaaataacaacaacagcaagtggtccatgagagtgaagtggaggtattaaaactaggctgggtcttctcttggaagatgacagactgagtcccacagtgcctcactccattcaaagcaattaggagtgtaggattgcagtgacaacggatctccagggctatcatagtgctttacctaaagataacaagagattagcccttagtgacagatgactaatatattctgtggacactgactgagagtttgggagtttctactgtccctctcaaggagcttagagaatatgtacacgggaagacaaaaattaaagaaataaatgtaatgcactgtataatgcataatgataaatgcatcttcaaggtacctaagtaatttagaagatattgcagtgggagaagagtactgagatattcaccaaattcctaccagaaaaaataacacttgagttggctgatgaaggttgactaggagttcattagacatagtagagaaagtcattttagaaaaaatgataataaccagctttgattgagagctcaattttgcttgtcctttttggaagtgtactgtatgtatgtattagtccattttcacattgctataaaaaactgtccaagactgggtaatttataaaggaaagaggtttaattgacccacagttctacatggctgggaaggcctcaggaaacttacaatcatggtggaaggggaaacaaacacatccttcttcacatggcagcaggagagggaagtgcagagtgaaggggggaaaagccccgtatagaaccatcagctctcatgagaactcattcactatcaaaagaactgcttggggaaccgtccccatgatccagtcacatcccactggttccctcctacaatacgtggggattatgggaactatagttcaagatgagatttgggtggggacacagccaaatcatatcaatgtattaaaacagttaatctttatagtgatagtgattctttgaggtattattcccatcttaagaatgaggaaactgaggcactgagaggttaactcacagctagtaagtaagagagcaagaattcatacccagcagtatgaagaagtgaaggatgagttgggaatacagaacttgatcattgagagtcatactagtcacaccaaggaagttagagttaatcaattgacaacggggagctcttgaaaagaactgacaaggtcagatttgcattttagaaatattgttgtggaaacagaaggattgattagaaggaagccagaactggagcctggaaagttggctacatggctttcacagtaatccaggaaggggatgatggaagagaggctgcagcatgggagcaacagctggagtgaagaagagaggatatgtgtgggaaatctttaaggggtacatttggcacaactaggtgatagacagaagtgatgggtggggagtagaattggtgaatctactcttctaactgcctttccctatctccagtctcaccaagtatcttgaattaggaagcaaggaaaaggggtcaattaagaaaaagggagagcaaggttaatggagaacaggctcaagaaggaagaatttaaaaatggaataaggcaagagaggataaagaaactacctatggagtgctatgcttgttacctgggtagcaaaataatctgtacaccaaatccccatgacatgtgatttacctgtataccaaacctgcacatgtatccctgaacctgaaataaaagtttaaaaaaatagaatgagttaagagatttggtaatcttgagaaatgtctgtaaagtgtccatgtattccatgggttcaatggggatctgccattgaaattcatagacctgaatatcagagaagggtagaagattagagaatttgctgtttggatagtcgaactccttctttcatagatgaggaaagtaaagtctagagaaattggagagacttgtgttatatcacttagtttgttacagagctgaattcataccacccatttccatgtgccctcaaatagtagccgacctcttccttcctgggagagaatccttaaccaccaagtcctgatctcataggcctgatagtcaatccttggaagggatactgtggtgcattgcttagatccgtcccacttaaccctgggacccacatactcactcaccaacctgctgggagtgctggtcactgacctgtctcaactaggttgactccaggaattgctctctgctaaaggattttttctgtttcagggatataccaaaatgaaaaaataaaaattttatataaagagcgtttgttgcctgggttgtatgcctgtagaatacattcagaggtagaattactgtttcaatagtattaataaatttttacccaatggcttttcaaaagtgtgcatccccaatggcttttcaaaagtgggcatcaatacacacttagaaatatgcagtaggatcaatttcaccaattatctcaccatctttttagaagctaattcattttgcattcttaaattccactaaatttcaagagagcagttaaagaataatacaaaactttgaagcactaaatgtatatatttaagatattatgtcttctgtagtcaatggcaaatatcaagaatagagaagatgcacaaaactgaccagtagcagaaacagagatccacattctaatctcacgtctttctactttggttaaaggcaataattcctatttcactcactgatgagtctttccctaacgagaatgtgactaaaaccagttgagtttgcgaaagggatgtagaaagagacaattaggtaaaggtgaaaaatgagactgacgaagtgacgttggtcaatctcctgtttactgagtgcaggttaggaaataacatcaactaggttttctggaatttgagaactgagtattataaaaacactgactccgttattattattattgtcatttttaattttggattcagagataggagctgaatagcagcaaaaaaaaaaaaaaacatgcttatgaagagctgcctagtgaaaatgacactcctttggcttaggaagagaaagaaaatgaaagccttacttctttcttctactgattgaagtttttactttctgctgtttacttgggtttttaatattgaagacttctttgtagtctctgatgagttttgaagattaattttgcagaagtaagataatattcctgtttaccagaaatatttctgaccataagactcattatttatttattatggatggtcattttatatatttttaatgcttatttaagactccggagtacatgtgcaggcttgttacatggatagattgtgtgccactgaaatttggtgtaagaatgatcccctcatcattcttagcatagtagtcaatagtcaggttttcaagcctcaacccttccctccccctctagtaatccccagtgtctattgttgacatatttatgttcatgagtactcatagtttagcttgcaattacaagtgagaatatgtggtatttggttttctgttcctacatcaattcacttagggtaattgcctccaggtgcatccatgttactgaaaagaacatgatttcattcatttttcttttctgtggctgtgtagtattccatggtgtacatgtaccatattgtttttatccaatccaccattgataggcacctaggttgattctatgtctttgctattgtgaatagtgctgcagtgaacatacaagtgcatgtatcttttttggtaaaataatttgtattcctttgggtataaacctagtaatggaattgctgagttgaatggtaataccattttaagttcttttggaaatctccaaactgctttcaacagtgtctgaactaatgtacattctcaccaacagtgtagctttccctttcctctgcaacctttccaacatctgtttttttgtttgtttgtttttcactttttagtaatagccgttctgactggtgtgagatgatatctcattgcagttttggtttgcatttctctaactagtgatattgatcactttttcatgtaattgttggctgcatgtatgtcttcttttgagaagtgtccgttcatattctttgcctatttttaatggagttatttgatttttgtgttgaattgtttaagtttcttacggattctagatattaggtgtattttaaatgcatagtttacaaatattttctcccattctctaggttatctgcttactctattgatagtttcttttgctgtgcaaaaagtctttagtttaattaggtcccacttagcaatttttgtttttgtggtaattgcttttggagatttagttgtgcattctttgccaaggccaacgttctaaatggtatttcctaggtttccttctaggatttttatgatttttaggtctcacatttaagttttcaatctatcttaaataatatttgtatatggtgagaggtgtaggggtccagtttcaatcttctgcatatggctagctagttatcccagcaatatttgttgaatagtagcgagtcctttccccattgcttgtgaccatgagattttatgtgatgttgaaacccaaaactacccaaaggaattaactactgctggttaattgtacctatattaaacactttctttatagtattttccttatttgggggccatctcaaagtcctaacaatcagaatttgtgtcttctcatatgatttttactcagaattacacagaatacagtattcataaaaatgaaccaaccataaaatatttattcttctactgtgtcaggtagtcttgtaggttcctaagagataccaaatacaggttcataattcttgtcctcgaagatctcccaatctactgataaagcaagtaccatatgcatgaaaagataaatgtctttataaagtttcttaatcatgagtgcccatttgagtggtctgtgggtttttagaagttattcacagaaacgaggctccttagttctgacatggggaccatttgtttttattttcaaaaagctctatgaagtgatttggatgtaaacctctgaaaagaagttattgtcttaaatattcatgggaggctaggcctacttgcatctggagttggctccagaagtctttacaaagttagcttggcattggctgggtttcaaagaataaatagaaggggataaaccaagaagaaatgtggatatatatggggcacgattgaataatttccagaaagaaatcagatagtacaaggagtgtccagagaatgatgtatatggctgaaatggaagtgttatagaatggtagttagtaataaagctttaatatcacaagcatattgaaacaaattgcatgtaaaacactgatgtaataaaaagatttagattgttggagtattttgatgtcaagtacttgtcttcctggtgatgtgaaaccatgcatatgtgttttaagtagaaatgtgactccatgggaaaacatgtaagaacatgagcaaagatggatgagaatagggtgagtgtgaagggaaaacttattaggatgctagttctctgaggttataaagaccataaggtagtggcattggagtacaataaaaagatgacgacattttaaaggaagaacctccctggcagcatggctgaatagacctgggaagaaagagaatttatgcctgaatgaatggaaaactgatgattttgtatctcaaagtggataatttatttagaggcaactggctttggaggaaagagaaaatgaggggttttctaatgtttgagatgatagagaaacaggcaagcatagatactttggaggcagttggatatgtagcattggagtcaaaggccaagtaagaggtagagaaagagattttggagaacttctcatggaggaaatacttgaagtctggagaatggatgagacctgaagggaataagatatgtagatagagacaaaagttgaagggtaacactcagactttgggggagatctacatttaggaagtaggaggagaaaagtaaaggcacagtaagaaaaagaaagattcaactaaagaaaaggccaaaaaaagtgtaacccacagagaaaagagcatttctggggctaaggagtgatcaacactatcaaaatactacaggtaaactagtaaaacaagtaatgtcagcattagtttccttgtctgcataacaataatagttattatgaggtatttttgtgaataaactgaaatgatgactattaagcatttagcccaaggctaggtaaaagaaaaggctagccaaaagcatctgttattataaatataataattactaatcagcacccaactatgccgggcacttttgtagttacacatttgaataagatgcaaccctcaatttcaaagaggtaagtgtcaatacaaagataaagatgtgaagaatagatagataccattttgtggtattgtttctacaagaaagatgtaaatacaatggaaaaggtgccagtggagaaaagtgataactttatgagtcctttgccagacataagtgatagggttttctgtacatattacatgttattcttagacttgtgcaatttgctaagccagtttatagactcttgaatctgtgtaattgctatgttcttgactcaaacctgaagggacagactcttgggagggaatagccaggttcagccttttatctttcttctgtgcacagaactcttgcttactttctccaccatgggtaaatcagaatggctttgaacaatgagcattttctgcagcctgagcagcagttgctctttagacccaatttacaaattaggaaaaacaaataaattatttatagcatgacaaaaataggatttggcttaatccaacagctttctcagttacaatgcttgctgctcaagtaatggatcaattcacagttggctaaatccaggtgtttttgaacctttctatttaaagtatggttctctgaccagcagcatggagatcccttggatatttgtttcaaatgtagaatctcaagccccactccaaacttaactggataagaatctgcgttctgtcaacaactttagaggcactgtatgcagattgagaggcactgggctagaatactgaattagggctgaggaacatcatcacattctccacgctgtcccagtatactgttggatgatgtcagagcaacgtgaaaggattttgggttatggtttagctcatagtccatgcagaagaggccataattagcacagggtaccatggcacttctcatctgagacatgtgacatggatttgcacagatgagtacttctgacctattaatgttagtagtagaagtgatccttttgtcagtggaaaaagctgccagactcagaagcaagtaaaacctgaagaatcttttagaactgttagtcaagaacttcataggtggtttatataaaatttattgtcacttgctaactgcatggctttcggcatttcttaacctttctaaacttcaatcttttcattcatggaacgtagataattattgtacctgtatgacagggtcaatgaaaggttaaatgagtgaagatacataaagtagttagcacaggatctgggatttagtgagggcccagatactacttgtctgttattatttagtttatttagtttatttttatttatttatttatttgagacagagtctcactctgtcacccaggctggagtgtaatggcgcaatctcggctcactgcaacctccgcctcccaggttcaagggattctcctgcctcagcctcctgagtagctgggactacaggcatgtgacaccacgcccggctaactttttgtatttttagtagagatggggtttcaccgtgttagccaggatggtctcgatttcctgacctcgtgatccacctgcctcggcctcccaaagtgctgggattacaggcgtgagccaccgcacccggcctattacttagtttattattatttcattattattgagtatctattatttgatcttttatgtaataatagtgaaataatagacttctgaatatttgcagagaaatccaataattttaagtgatattggcaaatactatgatattagaaatctaggtggtacttaggaatctattttcttagtctctattctgtggccagggaaactctttattccttttgtccctgctatatttgagacaaagatcttgaatgcatccactcttccctaaggaaatgccatcaactcatcatccccataccatgcaaatgccttttacagctgcagagcaggtgtgggcagatgcatacagcagcatatgaacacatgtttaccctccttggccacactttgtcttactctatgttttctaggaacacattttggggtggaaatgcctttattccatttatatttagtcaattatctggtttagcttccattcttacaacctaattaaattcagcccatcaactcagtttaaggcatagcagctgtagacacttcgtttatctacttggagagaaaaaagataagttggtacaggggttccccatcttgtgaatgcaattcccattcaactacatgcaattgaatatgagcatgggatggtattctggacctaatgttaaattctgctactaagctatcatagttgaaataatatactcaactgcaactttacatattttccagggaaatgcaaatgattgcttttaaaggaatgacaactcatttgcctgcagatttcattcaggatatttaattctgaactactagcctatcacccattaactgccatttctaatatcttttgactccctcaaagagggaaactcataatttgtttcacttagaatttacatttttttaatattctagaaaccatgaaagaaatcactgagtccttagctcctgttttttttttttttttttttggttgttgttaaattgtagaatattagaatgtttcagttttactgattgtatttgttaatcattcttcttccactaccgttgtcttttcccatcctcttggaagggtgttagagaagactctatatctcacctacagatgatttcacctagaagcttagcctcccttcatgactactgttaaagataaagactgcctttggttgacaccataacccacaagaaatgattgcattcctcctggatggggagcaggtgacattgcagatgttacacttcccacatggctaagccactgatcgagattaaaaattcaaaagacaccaaagagccacgttattgtcccctcacagggagctctagaaatacatgacctaaattgtttcttctaagcatattatcagttccattttcaaggtatcaacatgatatctttccattggttcacaggaagaccaaagagtgacaagagaaaaatgtttccatttgtagtttttctacagactcatggtataggtcagcttttttattgtaaatatttaagatgtacatttaaggtgtctccatatatgtatatatatatatatgtatacatagtgaaattactagtagagtcaagaaaattaacatatccatcatctcagttacctttgttgtcataacggcacataaaaatctactctcttagcaaatttccatgatacaatacagtagtagtaactatagttatcatgctgtaccttaagtctctagatattcgttctacataattgtaactttgtaccctttaacctatatctccccatctcctcttccactgcatctggtaaccaactttctactctgtgttactatgtatttgactgtttattagtgtcgacttaggagtgagatcaaactctttcactctctctttctttcccgtttttttttttgtttgtttttgtttttttttaaacaagatctcacactgttgcccaggctggagtacagtcacatgattccagctcactgcagcctcaacttcccaggctccagggattctgtcacatcagtgtccttagtagctgagactacaggcatccaccaccacacctggctaattgtttgttgtagagatgaggtctcactatgtttcccaggttggtctccaactcctgagctcaagtgattctcccacctcagcctcccaaagtgctggaattatggtgcgagccactgctcctggcctctacagtatttttcttgctgtgtctggcttatttcacttagcataatttcttctgggtccaatcatgttgttgcaaatggcaagatctccttctttttaagactaaataatatgccatttaatatgtacatctaccacaatgtctttattcctttagcatgaggagaatattgaacattactttgagaactagaaaaaaatgaacatgtgggttattttagtggttaaaaaaaataggaaaataactataaagacatgaaccaactatcaggggatgtttgggttgtttccatatcttagctattgtaaaaaatacaagaaagaacagacatctctatggggtgcttatttcatttcctctgggtatacccagaagaacaattgctagataatatggtagttctagttctaattgtttgaggagcagccattctgatgttataatggctgcacctatttatattcccactaacagtgtacaggcattccctgaacttcactctatattttatttcccaaatgagatggaagtacatggaataaagtagtattcaagccagtttagtcttcacattctaaatcacccctctatgaaacctctccagattaccttttctccccatgtggatctgaatatgctcctttattcccagttgtcctgtatgtatccagttttacagacatagcatctgtaaaggacactgttgtcttacaccgaagtgtagcagttaagaactcagggtttgcacctttccagctctgtagacttgggccggcaactgagcctctttcacccatagtttctttatctagaaaacaggagtgatgcatgtctcataggaccggtgtaaggattaaatgaattgtaactagaaaattgttgggaaataccaaatataattatataatgactagcctctgtaggtataaacagtttaattacttataagtttacatgtctgcttatattaaagagggaaagacttagactgtagttcattttcatgtctctgtaacacagcactctgtttagtagttacataaatagtgattgaatgaatgtacaagtgagtgaataatcatctcaagtctatcctttgtcaaggaaaatttccagatagagttctttctcctttagggggtctttaagatggtcccagtgccagcccaagaagagccagagctagatcttcaaggcagtctgggacctggatcctcccctccagatgcctagaggtatctcctgggaccatgatgggtctcagtcataccccttcattcattggttcatgtcttcatagtcattttctttttttttttttaaaccactgaaataaccctcattgtttgtcattatttctaatactcaatgtagttttaaattttctccccatgctcaagaagagaaatggaaatatggcaaacatctccatgaacccacattttctcacatctttagatcaaaaactcttattcttcagataaacaggttgtaaaattttcagtgttgaagagaatgaaatatgacatttgattttattgattcattgcttatttttggcagaagttatcctttattcagtttcatctctttatgtcttaccacctctttgtgaactagccacttgccttgagggtttacaaattcaagatttctcagcacgattagccctaatagtatgctttccttccaaggtttccagattatccaatacagtattatttctatcccaatcatgtttaaggattattattttacatagaaataaataaagaaaggggaaccaatacaaagtgttagaaagacagctacgattaatatattggactggcccattatcagaccctctagattttacaggtagctttctgatcagaaatctcgggtgagaaatagtaagaatgatggccttagttaaatcctctatcaatatgacaggttaaaaaaaagacatatgagttagttaaaagcacctctcccttggtaactctaagtgttttagtttttcagatggcaatttgtgactttctatagctttttcttgagatgaatttgtggaccagttgaatagtgatagaaatacaggacttgctaaaaattacaaagtgtttatggcagttctggcaaatatcctctagatcaccagataatgccaagtcagcaatattatcaataatgagttgcctactaagaaccaggggaatgggggcatggactgaaactttaccatagacatctttgctattctggactgttggtttgcttcctagtgtacttctgcttatcctttcttccctttggcttcattgagatcctcagccactgagttctatcttggtgcattccagccacaccccaaaagaataacaagaatgaataagccatccatctctgaatgtagagcaggttggaaaatgataaccttattcattattattgcttgatacatttccgaatttgtgttatctgtcattaaatagctaccacagccttctttcattcttctcggtatcagtttaataatttgttcaatgaatatgagaaagaacaggatcacatccagattttaccacttactggctgtgtgacactgggtatggttattaaccccatggaacctcatctttaaagttcagatgatggtaactaactcatgaggttgctagggattaaatgaagtaccatgtttaaggcttctggcgtgggtgctgagatatagcagataagagatggtagtcaaaaagaatgtgtcttactttttttatagtatatagagtgacaattttcaatacaaatagtgtctgtatatatgcagtcttaacacggcattttaaaatttcattgtagactttaaaaaacctaacaaattggatttcagcctctttcttactatattagaaaataaaagaagattaaaataaaaaaaggtttccttttaatcaatctattaataaaaagataagtactgagattccgttgacataaaagtaattgaaagtttataggcaaattcttgaaatagaaaggcactttttttcctcataagaggacagtttagaggatttaaaaagcaatcaaaggtctcatgttttatatgatcaattcaaattgactgaattttcatcatcatcctcctccctccttctttctgatagtctacatttgtggaatagagagatttttgtctttcaaattctaaccctgaggatttttgctaggcacaagttaagacctgtattgttttctcctaacagttcctatgacatttttaaagtatttactttattctagtatgtccattctgttgatcttcgaaggacctgtgtctctaggtgacatctgtattcaaccaattttgaagactcttctgattggatttagcaggagatttgtagagtgtggggctttgactaggcccaggtcctttgccagccaggcatagtttgtccttgtgagggcagatattggaaaggtggaggagaattatgttctatggcactttcagaagctcgagaataccttggcagagccaagccttctgcttagggaatggctagcagtaacaaagcatggtacctgagatcaggtacatagtcaagagttaggttgaaagtcgaatattaacctgaaaaaggaagatttggcagcacagtgtatcttacagtcccaggaaaagagccagttgacatgttctgtgagacttcagaaaactgtacgacgtgaaagtagaagcatttctaatcatagttatattttgagtaatctcttcacagtagaatgagtcccccaacactggatgtactaaagccaaaggaagggccaccacttttcagagttattgaaggaattcacccatcagatatgttttgattttattcagtgattgttcaaactagatccgtttctctaccttattttcaatgggcagtggttctctagttcatcaaaaagtttttcctctggaatttttgagaagcaatagaaatccagagcatttaaaggtgatgattaattagtatattaatcttagataaatgtccccagataatttttaaatgatcaaatttgtatcaaagacattatttattttagcatcattttgatttcttctactttgttgctggggttggggtaaaagagggagaaatggagaccatatataattccgaaatgaaaaaaaataagcaacaatacactgaattttcttagagtaaacataatgctatgctgggttgttatagcatttacaatgctcatcttcccttacacttgaatgacttcctcctggatctgaaacaccttcctcaagagcatcatcacaggactgttaaaaatcctaacatgttacaattttactacctttcttcttccagtattccagcttggagactttgcgtagccctggttaattaatgttgaacttttcagggtatctgtgaatcatggtggggggtagggttggggactagaatttaattaaaggcacaagcttcatggggattgtgaaatcacagattccaaaagggagacagccattctagggagactgctaatagggagtaagcagggtgacaaagtgtgcaggaactgaaggaagatgacattcaaaggtctaaacaggggagaagaaaaacaaagagatcagcatgttacagctgagccttttcaaatgcacggtgataaagaacagatatgttttgtgtgtgtgtatgtgcgtgtgtgtgtgcgtgtgtgtgtgtgtgtgcgtgtgtgtgtgttatgcacagtggcttgaaggtagcagccctttcccctgatagaaatttgatgatggcagcaacaaaacctaaacagagaataattaaagagtaagggggtagttaatgaaatgaaaataactttaaaaggatgaaaagaaattgttgttaacacaccatgtggtttacctatgaacctagctgctgtggaaacataataacacagagtcagctcctgcaatgcaagtaagccacttcctgggtagaaatggggctcttcggaaaaagattaacttttctgtccacaggggtattatttagctcactggaatagcaatttgacaaatggtgcctttatggcccaagtgaatactgctggtttctgctaaaagggcaggtgctacaaacccaagaagaaaaacattcttgcatacttgcccccctcagcataaggacaactttgagcctgttcatttttgagagttccagcagtggaaagaaagctctaaggtttggtaacctgtgactcacagagagcagaatttcaagcctagttgagaaaacattccttcaagagggtgctgcttatctgctttggccacgttggattttggaatcttaactgttcttgtcactttggtcctggttcaagtcaaaagagtttcttctacttgggacttgaattaggtgaagactgacggacatttatttacgtaccaaaatacacaacatatgtgttgcagttagttcctccttacagaggaactggtaagcactttagccaggtagggctaaggcaattttcacagttctgactgtatgaggattcctgtttctttgttgtcctattttatgcatcatccactgattctcatctaaaccccaggccattttgcgtgaaaatagtccttctataaataaaaaatttagaccagaggcaaaggagcctccatctctctgcttacaattattgctcaatgttcaaagttctcaagacttatctcttcctattgcaatccctaatatacccgtatatagatacatttaggtctgagaatgcttgagcttaaagagagtaagttcttgtttggtacaagctctgcataatacgtctgagctgtctccctgctttagaatgcagtggtagaagttttttttacagcactctgattttagccaaggaactaacaaccgttgtgtaatgcactagctaaaatagtctcctttatcgtgtaaaagtcatccattgactcatttatttatttaccaagtgcctactatgtttcagaaagggttgtaaagggaacagctaagacaaggtccttgtcctcatgcatgtcatactctaatgagaggagacagatcatactttaattggtaaattatagtcaattgccaacagcagtaagtgctagagaggaaaggaccagaataagggtaggaggtacttttgagaggtgacaacgtgctagcagccctcgctcgctcttggcgcctcctcggcctcagcgtctgctctggctgcgctggaagagcccttcagtccgccgcggcgctgtgggggcccctctctggggctggccaaggcctgccctctgctggcggggaggtgtggagagacaggcagaggtgggagtcggggctgcactgggcgctcgctggcaggcaagggttcgggctccgtggccccgcactgggcgcagccggctgatgcctgctgggcttgaaaagggacgagctccctctgggctgccggagtgcccgtgctaggttccaaagtcgccagtgagtgccactgagaggtgaagccggctgggcttttgggtggagtggggacctggacaacttttctgtctagctaaaggtttgtaaacacccaatcagcactctgtgtctagctaaaggtttgtaaacgcaccaatcagcactctgtgtctagctaaaggtttgtaaacgtaccaatcagtgctctgcatctagctaatcaggtaggggacttggagaccttttctgtctagctaaaggattgtaaatgcaccaatcagcactctgtgtctagctaaaggtttgtaaatgcaccaatcagctctctgtcaaaacggaccaatcagctctctgtaaaatggaccaatcagcaggaggtcggtagggccagataaggaaataaaagcaggccacctgagccagcagcggcatcctggtgggtctccttccacactgtggaagctttgttctttcactctttacaataaatcttgctgctactcactcttagggtctgtgccgcctttatgagctgtaacactcaccgcgaaggtctgcagcttcactcctgaagccagccagaccacgaatccaccagaaggaagaaactctgaacatgtccgaacatcggaaggaacaaactccagatacaccatctttaagaactgtaacactcaccgcgagggtccacggcttcattcttgaagtcagcgagaccaagagcccaccaattctggacacacttcgagtagtgtggttggagaaggtccttgggagaagacaacatcacacctgaaataagagagattagaaggagccagtgataacagacctggaagaagggaattcaggacagagggagcagaaggctctaacgtggaaacaagaaggccagagtacccagagcagaatgagaaggggattcctaatcaggaaggaatcatatgtggttgttcactgagagcaatcattgacagtctcacccatgttctacaaaatttcacttcatgattaaaacaaattatatctctgtctttgcctaagacgtgtattaaataacagcaatacaaataataaacatattaagtccattctgtgttctagtcacaatattaagtattttatatatattatttaatcttcacattactgctaagaagcagtgataaaaccaagattttaaaatattaaccaatttctcaagactaaacacagctagtaagttgcacgacctggatcaattctccattggcttgtttccaaagccacaggtttactttaacatatacagcttttatagcactaacattgtgttctatgtgtccgtcattaagttgggtattttacacacattatcttaatatataaaacaattatatgcagcagatgttattaccatgatactgcaaataagaaaactgagaaatagaacattcaagggatttgctcacagccaaataatagtaattggcagtgttaggatttagactgatttctgtgtgatctgtagtccattctgttcaacactacatgtacctgccttcccgtggtatcattgccccagttctgaaacctaggtctaggtcgcaggagaactagcttgataaggatgggctttagagccaaaatttaagccatgctttgtcttatctgcataattttatgttcccagtcaggtaaaaccttacccatttatctttatttcctatcaaatgcagacttccctatgagctgttgcttggtaagttccaacccaatatgatgtcaccactgggtggacctctatggcacctgtctcactctgccttggttccagttatttttgtatatgcttcattgattatttctactcacttcccggaaatgttccctttccctgagaaatggagttgtatctccctcattgatgcatcctctgtaacatctagctgtttaatgtgtcactcagaataagtgctcaataaatatttatcaaagtagctgatgtttcaggaagtctaggaagcaaaccacctcttctgttctgctcttggattcaagaacttaagaggattttgttggaaatccacaaagaatattttaaacgagacacataataagactctcttttgagatgagagaaaccaacaacagcaaaagatgggtggtaacagaacggtgctgtttgctgccagctgatgttcttcttgcctcctggaaagatagagccagaagtcttccatcacttcttgggatgagccaactggcctgttttaacctatattacttgagttttggctaccaaaactctaagcattcacatgggcccccacgaagctctgccatctgacactttcagcaccttcaactctatccagtctcactcctgctgtactaacaaacattccataaacacaaaaccaaaaccacttaaaaaaaaaaatcttaggctgtccctacaacttttgctatcctcacgaaagagtgttactccagtgagacaaaagtccatcacaagaaatgatttttctacggaaacagctgtgattggagcaagatacaaggtaaaacatgttgtggtcaagttcaaggagaaaacagggtggctagccctagcaatcctactggtggacttacttctgcacacttcatgctactatctatcctgtgttgtctaaggctatataatgtcgagagacgggctagtccaggaatcatgacagcaaatgagggagagagagagagagagaggagacagagagatggctcttgcaacctttccaatagcttttgataggttacgtatggaaaaagcctcatattgacatcaggtttacttaggttcaagtgaaaataatgtctttaaaataaattatctcttttgatgaaggaagtcctttttgttttttgataccatgttgcttttgggaaaacatgcctgaaagtaggcaagtttctctaaagcaagaactgtaaaactcacagaaacataaagttgacttgatcatgcccattttataaataaaggaatggagactcaaagcggttaagggacatgtctgcagtattttacccgtgagctatatgccctctgggtttctcctcatccatctgcccccaacaactatgctctttcctctttcctttactgtttctgggcatatcaaagccaaacttaacagcaccaatttcacattaaacaaaagaagaggaacctactgaccaacctttccccatcgccaccacgtctagcctcgccagactctggtaatcattacactactctgtaattctaagatcgacctttttagattccatatatgagtgagatcttgaggtatttgtccgtctgtgtttggtttatttcatttaacataatgctctctaggtttacctttgctgcaaatgatgttctggtgttctgttgcacagtagggtaactagagttaacaataatatattgtgtcattcaaaatagctagaagagagaattttgaatattctcaccacaaagaaatgacaagtgttagaggtgatagatatgctaattgcccagatttgatcattatacaatatacacaggtatggaaacatcacattgtaccccataagtatgcacaatgattatgtgtcaattaaaaacaaaataaaacataaacaggagagaaacatgagctaaaaagaaaaccagtaagcaaatgcactagctgaatcagatcattttatgcctcttgatcggactttgatggtgggaacatcaggctacaactcttgcctgaatccacagacatggaaggcaagagaaattatttaagcctatgcaatcatccaggaatggaaagtgggaatggggttcaccaaacgtactagttttctagggctgttgtaacaaagtgtcacaaactgggtggcttcaaacaagacttatttttttcctattctaaatgctagaagtctataataaagccagggccacattcctgctgaagactgtagaatccttccttgcctcttcatagcttctggtatgtgccatccacctttggtgttccttggcttgcaactgcatcactctaatctctgcctgtgtcatcaaatggcgttttccctgtgtgtctgtatttgtctgttctcatgctgctttgaagaaatactggagactggataattcataaaggaaagaggtttcattgactcgcaattccacatggctgggaaggcctcaggaaactcaaaatcatggtggaaggggaagcaaacacatccttcttcacatggaagcaggagatagaagtgcagaccaaaggggggaaatggcccttatggaaccatgagatctcatgagaactcactatcatgagaacagcatgggggaaactgccaccaagacccagtgactccttactgggtccctcccatgacatgtagggattatgggaactactattcaagatgagatttgggtagggacaaccacatcactgtctgtcttcacatggtgtttctttcttcttataggaacaccaatcattttgagttaggatgcattctaatgacattatattcgtttgattacatctataaagatcctatttccaactaaggccacatttgcaagtactagggattaggacttcaacatatctttttggagacacaatttaacccataactccatgttataactgtactttttcagaatatcagtacgatggtgcccctaatcaacaaatatattgtcaccaatatgctgcagtctgggagaacattcagggatttaatttttctgacacacagactgtgagttcttttgttttttgtttttgtttttctttttttgttttcagcacatcacactctggctgtcattatcagttccccataaactgtgataatttttgtgtcacatagagtgtttaggttggcctctgatgaaatgaagcccaagtacttgctcttccaggcacctaacccagggcaaaaacacagagacctaaatgccttctctcagattatttttttattatatttccagtgagcagaaacattacagatgtgagacttgttctagaaatcagagtatttccccagggaagcattatcactgttcagatattactaagaagtgtaaaatgctggagggcaattgcatccacaccgtcctctgcccatcactgcaaagggagaaaggagaaggccatggggggatgcagcaagaccccaaggtctaggctcctctgccaaaggagcatggatgaccaatttggaaagaacacttgagaacctctgctctgtcctcttcacttcactagtgagaaagctaaagctcagaaaggataaatgacttgactaagctacttattggaaggtgggtgattaggatgtagcataggggtaagactgtgtaaccagctgacactgctttaaatgataaagcattgagttgttctgttttaatggtacacaagtcaaaattgttcaaggattgagagtggagccagaaagcctgggtgtaaatcctggctccttcacttacaagctgcgtgatttggggcaaatcaggtaaccccttcctacttctgtttcattgtctgtaaaatggatattataataatgtttacttcatagattgatgtaaaggtcaaattcataatatgctaaaagttcttggaacattgccttacacagatcaagtgttaaagaagaattgatattattattattgttattgttattattcttattatccttgagttcataatcagggtgtcctgaatatactacacccaggaatggaagccccaccacattgtaaagacacattcacttcccttaaacctcggcatatttgaggtggttgtagcaatagtggagggagagcagcaaggatggacacaaagcttacagtcacccagcagtgtaggaaaggggggaatcctgcacacactcccagacatggtggaggtcctcaatcactgcagagaagactgttgtgggaatgacagcaaacatgtagctcatcaagaaaatcagctgacttattagttcttctggatctggttggagtccctgaccccagagctaaattataaaggttattttgttgtaattttgatgctctaagaaactgatgtaagatatagaaaagttcttttttttttttttttttgagatggagtcttgctctagcacacaggctggaatgcagtggtgccatctcagctcactgcaacctccacctcctgggttcaagcgattctcctgcctcagcctcttgagtatctgggattacaggtgtgcgccaccatgcctggctaatatttttatttttagtagagatgggttttcaacatgttagccaggctggtcttgaactcctgacctcaagtgatccacctgcctcggcctcccaaagtgctgagattacaggcatgagccaccgtgcctggccttataaagttcctcctatattatacgtgcccatacctctatactagtttttctctcttaaagctacattgccatctcttgtattatccgtgcatttgtcacctgccacttgtcccccatgcccctcctttctagcctgtggtttataacatgctgtaagtctggaaaccaaataatcatgtttattagacttgtatgtaaatcgaacctaatgctcctttcctttgttgttgttttccttgataatgtggtcttttaaaagagtaaaatttgaactaggatttatgaaatctaggtttaagtttgagttctttttctacttatgtgatcttattcgagtctcctgacttctttggataaagcccaaaacaccattttacaggtgagaaaactgacagagtgacgtatgagtagaacagaggagaaaaggaattgaaaattcaggtctgtcaaactgtaatacccaggttctttctgtttgataacaccgttttcaaatgttgagaatgactaaagaaagatatagaaatttgtaatgattaggtatttatacattctcaataatgaattttggtataaaaacatatttttttatctaactatatttttcatgcagtcatttcagtcagtatcaccatctaggtttcctctagggaccacatatcaatgactcttaaaatcactgttgtgcaaggtgagtgggaaaggaacaggatggtagagtttggattggggaacagactttgagcactgaacagcaggcagcattgctgttggcagagtaacggagaaggcgctgaggcttacccatgccatcatggcaaaaaatagcacggaaacagctggtgagctgtcagaatgatcttaaggaggaaatgtgaaatgtttctgcttggtgcattaatcgagagttatttggacagaactgaattgccaggggaggaacaagcaaggtggtaactcacccttccctgccctttcatctctctgtaatacggttctatgtcatgggcctccttcacatacacactcccccagttgtccattactcccaccctctccgtcttacccacacctagagatatgtgtgcacacatccaaagagataacagaaaaaaaatccatttgaaatgcttacagatatttcaagacaaaatttaaagagatattggacagattagcaattatgacttttttaaacttttattttaggttcatgtgaagttttgatatataggtaaactcatgtcaccgggctttgctctacagatattttatcacctgtgtatgtaagccttgtacccaatagttatttttttctgctcctctccttcctcctaccctctaccctcaagtagacctcagtgtctgttgttcctttctttgtgttgatgagttctctagaaatctttgtgattagttgtagttgagtactaatgtggctttgttttttttttcatggagttgtttaaatatgtgtcctgattaatttttgttaactgttatactaagacttttcaccatcaatgaattcagtgaagggttgaagggaagaagtgcaggaaaggagaacacacaaatgagaatgtcagtcttgactgctgggtgaactttttttcgctgtagaagatgaaacaaattgagggccaacctcttgaatcaaattgcaaagtaactttctgctgggaacagtttgagtaacccgaagtagctaaggtcataaatatttttacaggtggctaaggaaagagcatttgcagccatggaatcaggtgttgttattttgggtgtgaccttgaatagaggctgctaacttttggcttctgtttccgataataaatctccctcctccccacccccaccatcagccccaaggaaagatgaatgactcaggtgcttcagagacttcccaagaagtggtttcagtatatgcagcaagtggacatttagaatggcacagttatccatataggaatattgttgaggcagttcatcttgttgtccctatagtgtaattctttggagtagaaagcaaagagcaataatttgtccaataaatgaaataaggaaatgaagagaaaatttacataagccagggaggccaacttaattttctaaagtagtgaattgactttttttccttggattttgaaataaatggcaataaatccagttgtggggtagagttctttgctttcagtgatagcttaggaacattctgcagattgttaggattgcttgtatgtggttttaaatgaatgaagctgtttctatacagctattttcagaaattctatgatctaaatgttttagattcaggcaaataaatacatatctatattgggagataaggtttttgctcaaacaagcaatgagtagttttcccattcctaatgtccacactatcttgaccactaccaagaaacactttttgcaccatgatgtgcaaaccatgtatttcttatcatcttgatgctgttgctcattttgcttaagttttaaagatttggcctttctctttttatgttgattaccaagagtgtctttgcaaagtcctttatgcagtactcaaagtatgtccatgccatttagctcctataaagaaaacaagtttttagccttcctaggaaattaagtttcctacaaaatatatgctcttcaaaagctctctcggcttcatttcaagcatggaaagcttgctggtgacttttgttctacttgatacggcatatccattcttgagtgaggctgagtacaaacagcattatcctgatgtaaaggaaacaaaaataattctaaccactaattaactaacagcaaagagactgatagtcttaaatggaaagaatacttccatggtctagtttctagagaacactaccaggggcttgaaggtaagtagcctctactggaggctaagggaagctaaacacttaagttttcttctatattatcagttgctgtttagaataaattataatctccacgtttttttttgagacagagtctcgctctgtctcccaggctggagtgcagtggtacaatctcggctcactgtaacctccgcctcctgggttcaagcgattctcctgcctcagcctcctgagtaactgggattacaggcgcacagcacctcgcctggctaattcttctgtatttttagtagagattgagtttcaccatgttggtcaggctaatctggaaatcctgacctcgtgatttgcccacctcagcctcccaaagtgctgggattacaggcatgagccaccgcgctcggcctcttctttactatagagtaaaagttgcatggtcgttttcttgcatttgggtcacagcttcagaaggttattaccaatcagaaaaaggttttgagtcttttatttcctaaaactgagtgtattcgttattgtctaatgacacagcataacaaaccactgaaattcagtggcttatcataccaaatatttacgcccatgtttacaggcctgcaggttgactgaaatttggcttgtctccgctgggctcagcatgttggctctcctttggactgcaggtcagctaggattggctccaggctgggattaggttcagatatgctccatgcatgtttttttctggggctcaaactgaagggacagtgtctatccagggcttagtctttcatggtacatttctgcagcacacaaaggctccctccaaatgcagcaattccttcctcagcggtagtagtccagacagaaacagttttggtggttgcttgagttctcccagttgttctcctgtcattttgcaggtcaatctgcttcattataggaacattctactggagaaaaaagtctatcattattcaaaatatccctccttatgcatacttcccactgcttagatgtctatactcagaaaagttactatgtggtttttctttatgggacaatactgcgtgatcgtggcgttcacatttctccctccaagtccttgcttttctagtttctgtaatcattcctcaggtgacataaaagtattttccgaagttttgccattttcatcacacaatattgtggacaaattaaagcctattgatgactttattaaagcagggtatttaccacaaattaggattctctgcattttgcctgactcctgcagagcacagagaccattcttgtctccaatagcaacactcttctattaatcaatcaagagctgacatgaatgtttttatagagattctgttccacttagcgatcctattgaacccctggccatgtggtatccccacagctcttcttctgaaatcccattttgaccaagccatccaaattatacacttagactgtaattgtttcttttccataaatgaatttacattcatcttaattcacattcgttgagattttttctctgtttccaagtctcttcacagcatttgtattctgtcattcaatacatttcctccaatacatcatatcacattcatatgcaatatgaatgaacttgtaacaatatctctctttttttttaattcaagccactgatacaaatattgaccaggtaggttgtaaaggacatggttctgtggccagccctgcaagatctccttatctgtttgtttagtacaccatgtatataatgtgtaagcctgcctcagttttcttcatggtggcctcagagatatcactgaagacctatctgatgctttgctgtgatttttattccctgttcacgccattctcctgatttcctgtatagtaactatattctcaagaagatgagattagtttgatgtgactattctttgtgaagctgtactagctaattgcatttcctcttagtttctaaaacccagaggtcccaaagtcaaatgctttgcagccaggcaagtaacaaatgtctgggtcagaagctgggtattattcgtcatttcatgaacagaaatatatatcctctgagtagaagactctgccagcagaacaaaattcttctgttagctaatttcactagccatcatatgatttagcttctgaagcagcttgctgctctgttattcgtgtgaactcatatcctttctcatttggaaagtcaagaccacatgggtacacctcttatcacaagcttcgtagagaccacaaagatgccactttagtcccaactcactaaatctcctctacaatgtctctaaaaattatccaatagtgttttttaaaatatatatcaaattatgctatctcaccacatcacagtatagctgctactattcctcctgtcttcctgtctcagaggaaaaatttgcttatcaccttccacagttgagtctacctaggtccttggcctcctgcccttttatcttttctgagatctcatgccatctgttacctcatctctattttatctgttataattcctctcctctgcttcttccccagctgctcagaacatactgaaatatatgtaagattttgggttttttttctggtcattttgctcaatgacttcctaataccaactgaagagagtttatatttcttaatacaacattgaaagcctaacatgatttggcctcaacctacctttttttatccagtaaaattcatttctctctaatgtatactatattccatccaaactaacccactgattagacttcatttttcttttaattactgctttttgctgtgctggtcccactgcttagaatgttatttcctcaaccttatttctgtttcctacatttgttgaaatcctagatgtccttcagaacccagcctctgagtcacctcttgcaggaagccttccttgctttccctagcagaacaacaatttctactgaaaccctgttgaattttgtctccattattgcctttaccaccttctatgttttgacagctattttgactatgtcttatctacccaattgtaaacttaatgaatacccacactgtatcctatttatctttatatctttagattgcaacacaattctttgcacatagtgtgtgccaaaaaatctctattgattgatggtgcaattctgatatttattaataatgatcaatctaagtatttatccaaatcaacccaatgccctatattttgggacaattacccttgagatttttataaaccaaattcaccccatgtaaaacagatgaaattaaccttaatttttatctgatgtgtaatggctaattggctaaatttctttcataaatattacatatgtactattttttatctctataagtattctagtttgtctagatgaagaaacagaggctaaaaatagttaaacaaaaaattacctgtttcagagcttgaaagccagatctgtccatggaaatctcctgagagaagaaggtttggggatgcatataatgagagcagagaactggataaagagatgtctggatctatttttggctgttgtttagatttactttgtgactgaaggaagtttatctgaggctttcccatttgtaaaactgagattcatatacaactgtgcaaaatatgtgtccctttacttacctccctctaagagattaatgagatgatactcaagaagcactttgattttctctgatgaaagaaatggataagtatgaaatgaagcatttactacttctatcgaaggtttttaagatggcagcctttaaaaattatcaaagtgaaagctaaaggaagaaacagccgtgtacattttaaatcaagtcaataattattgtagtgcacctaatgattctctgatatgtgttttgtgcattaaaatttaccaagcacttttacatatattatctcatttgatccacaaaactatcctgtgaagtatgtaggctaggtggtttcattaccatttttgaaataagaaaactaatactcaggccaaatgacttggtcactgctgctcgactcatgtgaaacagtccagggttaaactcaagtttcctggattccaaatcccaattcaggtatcttgcatttctgtccacttgttaacatcatagcatgcacattggaccatctcctctgtgttcacttacattctatccatgttcaggattgagtttaaatcccatttctgctcttaagacttcccttatcactttaactgaaaggcagactttcttattccatattttttttgtccttaaatatattgtttcctggaggtctttctagtgagttggatttcctgtattccattcttccttaaaataagcctttggaattcagcccagcttccacacttcttgatagctgccaccatccatttcattcctgggactgagcctcagcacaaggattatttaaaagttaaaaatagttgtattcataatcccagcattttgggaggccgaggtaggtagatcacctgaggtcaggagttcgagaccagcctggccaacatggtgaaaccccatctctactaaaaatacaaaaatcagccgggtgtggtggcagacacctgtaatcccagctactcgggaggctaaggcaggagaatcactagaattcaggaggcaggggttgcagtgagttgagatgcgccactgcactccagcttgggtgacagaatgagactctgtctcaaaaaaaaaaaaaaaagtttttttcgtgtcggtattaatgcctggtataatacctcgcacacagaaggtgttccatatatgcctgctaaagaagtggctagactaatcaacaattatggatgggagggaaggttcagaaagtttggtgacaatactgggaaaaaatgttggcacctgataatggtggacctgggataccaggctgaagagtttgaaacttgcccttttggcaacaacagatttattggcaccaaggaatagttttgctggattccacttttgaactcatcaaattccttgcttttcttttccttgtcttttcaatcctactgggacctcctcccaccagtgccactttactggaggcttgtgatatgtatgacaggcagtaaaacccaagtgaatcaaggaagcctgttaagagcactgatttctatgatgtctcagtttgttaactaaattgcaggttgtactgcttggccagagacagctgacaggcaactctgcctgaacaagtagcatctccaaaatgacatgtgcactttagtttcattagaggcagtggtatcatgattgcctgggccattgcaataaatatggtgatcatatgtatcccttgggatttggggttgacagcatagttgggctgcactaaagagtcttactctgacataaatgacggcaaagtagatctctgggcccctcagcaaggaggcagaagttcatgttgcaaagaaagttccacgggcctactgaaatattaccaatcaaaattacaatttcatttattgacaagtcatatttaacattcttctaatgttttttctcacatgccaatgtccaaaaagctaaaccatcagctgcatgatgctaaggctttcagcagtcagcagaagcagtggtagttgcgagctggttattcagaggcagctactgtgctccacataaccataaagtgaacattttgacattcccgaaaatgtaccaacctccaagtcacaaatcctctgtagatgcctgtggattggcttttcagatcctcttaaaagccaatctgtggtggcaggattgtctgaagagggtagacttgggcttctggtacgttacagaaggcatggtttctccatctacactatgctataagacaactgctcttctctgaaaagaaactactggaatcacacttcttgtaacttctctctattcccttatttagttggtgggattggatgaaggatcttcacatgtctagtgagactcctttcttctcttcttcctatccaaagggcttttcttcctgggctgagtgtatccaggcctatttcatctttgtaggaggcaaagggaaagagaagagaactagaaattggtgtaggcagactgatctgtggccaggtctaagtgttgccccaatccgttctcccatccaactccacaagcagtaaagtttgctggtcctttcatctatgtctatttctcaattggcttggatttcacaatgaagagggctatgatttattggcccacttaaacctcaacatggtagagtggcaattttgtttttctggctcttatattgcaatgaatattttttatttgacagtctgttataaacgaaaataatttttttcactatcagtttctactcaaaattaaatggtagctctagaatagtggcctgcattaaatttttctttatggttatagccatgcagatagatgcatgaactcagaggactaaaaatgtgtttccatgtaatttaaatgtacctttctatacggaacggtctgctgtcatgcaactttcaaataatgcattttattatcattatcttttccggcattgattaatcctactgtttattggctaagtgtacatttcctattggtatgtttctgagtcaaggtgaaagcagttaatacttaagagttgagaagcaagtttatttaaatctagtctttcttatgagtctgcctaacagtgatagattttgttgttgagccacagtttatgaaaagtgcattaaaacctcgagccgacccatctctctgaagcagcagttgggccattacattttggcaggcacttcagatgtgtgtatgattttatgatcaggtctgcttaattcatcccaactcttcaaagaggaagggaactaaaattccttgagcatcttctagtatgtgctagatgcctgcatatgttgttttatcctcatgacaatctctcatggtagatagtattttttcagcattgaaggtgagaaaattgaggttcagagagtttaaataatattgtcaaaaacatataggaagtgatgaagttaagctttaaggccaggcctgtctactcaaaagcctgtgattgttatattaagggttaaaaaaacaaaaaagtttgcaagagacagacaagttatttgaacggaatgaagtataagaaaacctgtgctttccttaatttttcttgaatcctgtggccttctcagtctatcctttattgaggttcagagaggttgctacttatatggtagcaaaagtatttcccttccctacttaccctactatacaaaacaaacaaacaaacaaacaaacaaaaaacagaaaacttgatgataaatgtcaatcaacactcagcctctgcatctgatgagcaacagaaattagcggggactgtggtgaattggaaaacctgtgcctttctctcccaatcagctctggctgattgtcctacagaaaatgttggctctgtgttactaaatcttaccattttttaaaagaacagtctagctgttcacgagagatctgatcttaaaatgttgaaaactaattcacatagaaaaatactatgtagtacccacccctcaaaaataaaacttatgtgagcactcgatccagcataaagtctctgaatttgtaagttctgtattacacaaggcagctaataagtaactactgggaaaaataattaacaaacaaaaatcaaatcaaaataattttcattactcttccaataattgtgccttccagatttagtactgtttgtgtattgtgcctctctgtggtagaggcatgacttctggtcctctatctgcccttcacagagtggagatgaggccagtatgcaatgactactcaagttttagatgttctgagcacttgtttctgtgctttctctggatagatctggtagtttggtgagcagagttggcgtggctcatcagcagtcaccctttggcaatggaaccagaaaagcatcatgctgtctgttaaagaatgtgtctatgcttgtagctagtttcctaagatgtttgcctctaggtatttgcctgcagaaagttttttgaagtcaatacaaagtagagtggcaagcgatgcatccatgtttgaggatttgggaagcatttttctgtattctttcaagtaaggcctggtcgataagtttagccacactcaatctaattccttgtctgtatccttattatctcccctcctcttctttaagttttcacttccttctgaccttaatcactccctcaatgaacccataagtatcactgaacatgggtgtcaccagttagcaacagtaagataaccgctaacttctgaaacatggaagctctagcattgcttggatgatgtcttccctgactgcctgtgagcctctggccaggatccggggtaagtgcctcacaaatcactgttcatctaaacagctaaagctcttctcctgatggaagagggatacctacagcagaaagcaagggagtccaccaggcacgtttggaaaataaaagattttatttatatttattttgactctatagtttctaaattccataaatgaaattttgccattatcaaggaaatatttgctagggagtataaggaaggccctttgggtaagagagaagatattctctaagctgtagcatgtttatgaaccttaaaaattacttgtctgtgtttgtatatgttcagctctgagagtcttccttaacattcaaatgtctctgtcttggcaaaaattagtgaggttttagaaagtagaaaagctggttgatagtgtaaggaatttttaggccaattttctattttttccttctatagactgaattttatttttataccaatagtttcaatcttctaaacttctcccattcctctttactttctcaactgcatccacttaaatacatcttattgtttcagtcagccttggctgctataacagaatggcatagattgggtgacttaaaaacaacaaatatttattgctccccattctggagactaggaagtccaaggtcaaggtgccagtcaatttggtttctgctgagggtccatttcccgactgacagatggccaccttcttgctgtatctttacatggaggagagagaaatcatgcctaatgtcttttctatctccgggcaggtagtgcaggaattgaacttggttggaggacatccagctggtgtctgctgcagattgcttgcttgcttgcttgcttgcttgatgtgtggggaaaaacctccacacatctagcgtcagaagcgtgttgtgagagtataggagaaactgagtttgttttttctacacagaagaatttcctatcctgaaggccaggtaatgaatcctctttctctggttacttgggcaatttatcaatgactgtctgtggatatttatttggaaatattatatgggaacgttccttcattttttatatctcaatttaggaaaccatgtgcttctttctcatttctcttttgtccccatcagcgatctatatttttttaaattgttattagaaacatctcttatttaatctccatcatcacccaacaagctcagcaatgtgactttgtcttacggatgaggaaactgggtgcagagtatttgtggctttccccaaaacctgcagtaagtgaacaactagaattatatccaagccttctgattcaaatgcagttgccctatgcaccacaccaaagtatcgtttacactcttgagggctaaagaatgccagatgtatttatctaacttctgatgtgcctcccaaaatgccctatacagaggataggatcaatacacacttgatttcaaaatttctatgacttgattctacttacacatcttattgatttggagaaataaaggtacttcttgggggaaaacatgactacatgttaaaattctgaatttggcaagtctagtgcaaactgaaatggatggtggttgaagtacagccaactcatggtggtccaaaagactgtggtgaggggatggcctcccaagaggcagggattgagccctacactgaccagaaatcactgcattacagaataatggagaaggcaagacaatgaaactgagtttctctgaaagcttggcatcttggatatttcaaagattaaagttgtatttaatgggaatcacgtggttcaattaactggtaataggatggatcagtgtccacctctaggacttcaatttgagtctaatccaaacacagaagcagagtaggttgaagcccttggtaatgaacactaagcctttcacctcccggtccacagagaaagttcctctcaggccacagaggcctgctggcaattttcctgaagacagtttggtagactatgtgaaacaagtgaacagctatggtcacctgagaggtagtggtactctacattttcaaaagttctctcccaaagcaaaaccatagcaaaaattgaaaagcagtaaatgaaccatggatggagatattgcactatgcacttgtcttgctagcagaagaatgcaaaggtgctttcaccattgtgtcagatgcttggctgaacatttattaaacttttgatatggaggaagacatagaacataaagatgcattttcttccctcacaatgctcatggtgtgacaggaaaaaaaaagaattgttccattaaaaaaacattgaaatgaatcaacacaaactgatgttattattgaatagataatggagagattgtgggataattagagaataaatctggttatcaaagatgtctctggaaggcacgtgtgtaaagttgttttcagctctgtacacctgtgcacactggccaggaaagctggaccttctgcagagaaaactgtcttctccagataggaaagtgtgcctcattgagctttgggctaggccagagctagaagatctttcctgtgtttgggtcattcctagatcagtgatccctaatgaccagttccattccctaaagctaatgttgactctagatctttctgacatttgattcatgctggaatccatagtttgttttgagtcaggtctataatagattcatattcctgagaggcttcctattgaaagtgaagactcaggattccactgactgttctgccactgtttaaggacgatattacagttggattatagatgacctccagtggacacagaggtgcttagattctactgagccaccattactttgcctaaaagaaaataagagggtcaaagggactaacttttgtgtaagttttaaggttttattcaaacacaaacacacacaatcacacacacatttacatggcaacatatctacaaataactatttctctagcattatgttcctcagcctcttgaatgacatcatttaccttcgtcatgttaatgaacaaaattgtagctcactcataaagaagagagagaagaatgtttgtgccctttaaatgtcaaaaaataaatgcttcttcatattgtgtatgagttcactataaactcatggataatttgtgtatctgaagctctgaccggcttccagagggcttacagtgcctgccatatcttaggggaacaatgacctcatgctgttccagggacatttctatttctccatttggctgaaacttactcactttatactttggtagggatactgaattcaagtaaattaaaattaggagatgtgttctctaattattctatcgaaagagcacatagctttgaaataattctcaatgctagtatggtggactcttttcaaaaggtatgagtcagctccctgtgacatgttttccagtgtctgcttggggtcacctttactaatttcatcaggactgagggaaagcactttccttttcatatttctgcttgggtgtccagatcattctcccctacagaggctttgatgctgtcatggaggtcatagggccggccttttttcgaagtactggagctttttaaatttcactttttaaaaaatttttgttgcttttattatggtggttgggggtaagtaaggacccaccttttgaattagaattactgatcttatccaagagagaatgttgtagtgggtgatagttgacgaagaagagaaccataaaatatcacctggatgaaagacctaactgcagcactatctccaggacacacacacacacaccagagtccccacgtgcagacaggcactgctgatatattacagtctgttggccattttgtttatgataactaggaaaggaaaaatgagcccttatttcagtgtgttcatcccaagatgatgacacagtagattccccttgcaggtaaaccgagagagctcagttaatcaccatttatcactcaagtgactcaagtattttgcagatgcattggagccctggagactgagatattcattgggctgcaatgctattctcttttctcattccatctaatataataaaataaactcaaatcctaacatcagagtgatgtgtgctatcttttagagtcccaagcctttaaaatgtatttgattcactcccatagaactagatacattttccaaacgaaatgtgatatcattacaattttaatgacttataactttgctccatctcctccattaccagactattcctagctactaccatcttttgccagaagcctctaatttatttctctgcatctgcagctgacctccttcaaacagtgttattttgagttgattttagtatataaaccactctcagtgggatctaagatagattagtttatgcctaattgagtgagcttttgtagatcctcttattttatataacttattagaaaatatctaagatatattgttctatttgccaaataataattgtgaatcaggttcattgtacactggttaccaatatgcctgagcctagtgagagagaacacccccacacacaagtcacatataggcagtaaaggacagcagaagctggggaatcattttgagctcattctccaaggctcaggaaagctgcctatggcaaatggaatccacctgtgcacgtactgcacctaagggaccttggaaagtaccccactctgggttttataccccaggggcaatatgactcaataagctgaagtgttgaaggacatcctgttctggtaggaagtggaacagagacttggctattccagccagttcctccttatctgagaatgttacatttctggtatattctttagttatttttgagaactacaagtgagaaaagaacacaaaccaggttggtccgaggctacctagagaactttcttccaataggtgaatgagcaggtatgttacaggttcctcatttgatcctctcaccctatttgagttattctgaccacttgtacatcaactattgattaaaatctgaaaaaagaaaatcataggtgaccttaaattaaacttaaattaaacttaaaaaaaaaaacttaaaaaaaattaaacttaaaaaaagttccacaacgaacaggggtcagcaactttttctgtaaagggccagaaagtaaatattttaggcttgtaggccacatgatctctgttgcagctactcatgtctgctgttgtagcatggaagcagccaaagataataatacatcaatgaatgagtccagccgtgtcccaataaaactttatttataaaaacagggaacaattatatttggcacacagtttgctgatctctgctctaggccaatctatctcctccaacttttgcatattcatacctcaaacatatcataaaaaactgccacaatctaaaccgtattatctgatgaccctaagtactaaatctctccattctgaaatgtgtatattaattttttttcaggtagagaatggtatagaatttagacagggaatttatctgagggattgactgaaaatgccttacttatgaaaaaagagttcttggttggtgtttattattcatgtaggtccatttaccttgaagccataatgctaatatagcctgtcatttggaagttagataaatagtaaagcactttaaagaatcactaaaagtttcctcacaaccacagaataggtcttggagggttactcacgctttgctgatctctcatttatagaggagcagctgctcatttttggcctagaatatccacctctaagagaagaaatttctcctttgcatcctgttcagagctgatcatgcatattcttggaaactgactaaaatgacctagtctgtagtaaagtaactaatttagagttgggactatcaactaatgttattttgccagaggagatgaatgaaaagacttccttagggactagcagcaatcagtcagtagggaacagggttaccaagaccagatggagaaaatggcataggacatgtgtattagacctgccactttctggctctgtgagcatgcatttcaaagtttatacctgcaaagtgggcatttgacagagtaggggacagtcggagagcttatcgatacatacttattgctctccttgtgttctgtttgctggaacacaattttagatcaaatatttaaaaattcacacgtgcgtgctcatggctgtgcactcatgtgcatgtgtgcctgttgtgtgcgtgcatatataccatacagaaaagtactgtctggagaatacattagactatgcatgtaaatgtgtgtagaatgtttttcttttttttcatgcaatacatgctctatggatatttgttaagtgactgaagttttgcactccctggtgcagtttctcaatagtggcactattgatattagagccagctatttctttgttgtgtatcattgtatatttagcagcatgcgtggcctcgacccactagattctagaagcactccacttcagttgtgacagccaaaaatgtctccagacattgccaaatgtccctggagataagcatccctgttgaaatcactgccttagtgaaccaagacattaatgtaagaaagtggttcctaaactttagcatctgaatcaatcaccttaagttcttgtgaaaatacatgttactgggcctcacactagagtttctgattcagagggtcttgcactagcactagacccaacaatttacatgtctaatgagtccgctggtgatactgctgctgggggtcttagaacctcactttgtaagcacataagtaaggtgtaagatgttctggaaaaattccagatgagttaaaatgtgtttcctcatttcaaggactgtaatgtttgttgttagtgtgagcacagggcttaaggtttctttatgaagaccgctgggtggttcctcacagctgtggttgagatttagcggggaaaccggacgtttatgggagacgttcagtctgtactggattttagtcagcactgccctgccagctgtcacctgagtcctgccaggagactgctccaggtcttggcacagggctggggcacctatggaaatgaacttgaagtttgccttgcagtcaaacttaactaccaaataaaccagcatgacattggggtctgtgaatgagaagtggatgttccgagtagatttgaaggacgtgatgactcaggatgccagttgtgactggtgacttagagccgtggtagctttgacttgcatcttatttacttgcatcggctgtcttgtccttccttgcttctcgccttttcaggtcatggttcctgatgtcctaagctgtcatccctactctctctctctcttttttttttttttttgcttggagtcagagatggagctgtctcgagctatttatcagtcttatctctctgcgccctctgttagcatttcagactgtggatctaatccactttaattgattgacctcgtgcaaccagacatcagtaaaacaccaggtgaagcacaactgcagccaggggagaggtggatgtaactttcctggttgggtgcaaagttcgctgaggcctataaagatttagaaaaggagaaatagttttcaagccatttaatatgaattttctagggacaatgtatacagatcccagagtcgatgaccttgactgggagacagtcgttgtaaatagagcagtatcctatagggagtgtgcaaatgcctctgactcacctgtcatccatattagtactatttctcagctagcatcactattatcaccatctccaaacccatcattaacatatttttacatcattgtttgtagataccttcagaatttgccaagattttatttatttctcttaataagtactatttaacacaagtattactgttgctcttgtcttcgttatcgtttttctagacaaagcttgagccatggatagttgagggacctgctcaagatcacatggaaaaaataatgtggagcctcaatcagtcccaattcttttgattctaaatctcaaattcttctagaacacaaagtagacattttcctctcccctgcttttcctgccacagccacacttcagcttctcaaggggaggggactgggtcattgtcatgaggtgatcatggactttgaaagatcttcaagctctacagccgtggtcttgtcagtttgggtgatttctgaaaggcatcttctctgatttagatttttcaacggagagacctggtctcttacctctcttgaaataccttaataatgaagtgcttactctgtgcttataaaccaacaactgtccagagtgtagaacaagaagaccataatgttgaaagagtagagactaatgatcttcactgaaagacacttaatagccacaaaaagagcgcaaattatgttctactgagttcaatgttttattctaaagaactgcagtaaaagcctctgttagtcaaagtcaaaattgatcaatcaggtaagctgtaactcatctttttgtattttacagatgcatttataaagcatagtgagatgttttgcctaagatttattgcacgaaatttgaatatggtagcaataatttattttatcctataatactgaaatcatatttggtctcttatggtacaaaaaagattcttctaatttttttaaaatcacaaccacacattctaattcatcatttattcatttccatatccattaatttaacaaacatttactgagctcatgttaggatacttacatttaaaatactcacaattaggctaagtggacagataagttaggcctacataaaatatgtaatatgtaacacatgtatttctgttatagaaataactcaattataacatgtaaaagctgtgattgtcgaaaatgcatggattttagagtcagacctggattctatttttccataagtctcttattgtgtgaattctcttgtaattaattgtaagaatttgaatatacttctattataaaaatatttactgagcacctattctgtccatttaggtagcctggtttatgttgcagtgacaaaagcctcaaacacttggtgctataaagcaaccaagctttgtttctcagccatctgcatgtccgtagcaagttggcttattgccatcctcactcaatgacccggaatgacaaagaagccgctaccaggagtttgctgggtgcagtggttgacaacaaatgagagaactctcgtgggtctcacaccagcaactaaatgcatggctcaggaatgatactcaatttatcagttaacactgttctcttggcccaacccatcacaacgagacccaaaagtcctctcttactacaaccctataatggaggagaactaggaaagtgtggtaaacagtgccgctcattattttctttactaggaaccagactttgaaatgggtatggaagaccttgctgtgcctggcccacaagaggcattatttacatattgccttccttgtgttcttgcctagcactgaactaacaaattctgtgggaagcctagcagttaagacactgagacctgcttccattgcccatatccctggcatacatttgaaaatcccagttctgtttctctcagctgcaattttctaaaatagcggatgatgcattccgtcttccccaggggcagtctggaatgaacgaagagatagccttcagtgacatctttattcctgagaattcttcttgcccctgagcatttctgctcctggagtctgaccctggtgtcggtagcatctcttaggtcagcaccaataactgcagtgtgactgattgaggatagggcagctgaagctggactaatttggggagccaggtgggcttataaacagtcattattgatgaagagtgacttactggctatttaaagacagctggtttctgtgctgttcagttttttttttttcctgaatgcacttgaggattctttggtaatgtcttctgatttaccacttgtttttgtttttaatatcaaggaagaatatagattgaagcaattgtcttggtagcaactttagtggtgatggctgtggagttattaaaatttatagtcatgctgtttttgcagctacactttgcatttcttagagaggcttataatatctggttacaaagaatgtagagagatagcaactaccaaattgggataggaaatcaaccctgcataaattgttttaatatatattctgtttgctaaaatttacatttattttcacaatatgtcttgatgacagtgcccaccaagccaactagcccttagctcatgacactactttcagttacactaatgaggagaaagaagggagaaagaagactgacattttgtgggtccaaaattatccacagtgaatgccaggtgcttcacatgtctgtgctctcctataaccctcacagcaagcttcagaggtaacaactggcccctctttccctccacacatctctttatgaaagagaaatcagaagtaaaataaccagaccagggtcatacagctttaagagccatcgctgttatttgaaccatgctaggctaaaacccacatttattctattgaaacagtttctccaaaaatcagagtgttttatatctgatcaaatgatgggtggttccttctcctgatctgttttatctcatatatttatgtaatgttttattacttataaagtaccatcatgttcatcatattatatcatccttacaacagccctatgaagtacgaaatgctgatatcctgtccttatagtgtattatcaagaagtggcttcagaaaaatcaagtaatttgcccaaggtcagtcaggtctgacaccaaagccaatgcttttgttccctcacatcttctcttttctagacacatgagccagcggagttgatttgcatggcagctgtgcatgatagtttcaagcctgggcaactctatgggtattcgccacaaggcttccgtgacttctaatgaactgaaacaaagcagttagccatggattataatgccaccgtggtcccatgacaaatgacaaggaggttgcagtaatgaaattttattactgcaaatagagaccacatctgagatctagcacggccacatttaccattgtgggaaacaaaatgaaacacctgggaaaggatctccactgactttagcagtgagctaacaggattaagaagatctcccagaaacactgattacaatggcaaatgtgtggcacctaagataaggaccaaatatttattctggcagagattaaatcttttcttttcctgaatcaaatatggatcttgcagaaaatctgcccaagaatatatcttgctgatcagcgaactcactgagccagaaccgtacttggccactgctgtcactgaaaagctacagaatgctgctttaaaggtctccatgcttcccctaaaactgttttccatccatgattaattagtgacttaggggtgaattgaatcaccagctgtcctttccatgcatccaggatttatgtactggtttctcattgaagaacagtggtgcaataaacagccctcatttgtggggtgggcagaggagtaatggtgtctgcagtcatggtttcttaactcctctagtacttccattctgctaagcaggttatggctcacattattacagcctagcttatttaggcatgagggtcgtgggcagtgacacacacacacccttagaaatgaataccagttctttaagagaaagcagaaaagtcatattaccatttctgaattccttgagaaataagaagaataaaatggacaataatattagctatgggcatgaaaagtacaaaaagaacccataatcaggttcatttatatatgcatgcatattttaaagctaggtgcttttcctagtgcagagatgtagatagcggtttcaacaaacagatttacgaaatcatgagtgtgtttagtcacaattttgggaggtacctggaactcttttcccagagaacagaacatggggattgcagacatcattttatattgcatattatgtaatcagggcacaaaggaaatactgaggtccaccctgtatctctgcatccttgaatgctcacagcctgctttggttgatcattctatattcctcgcttctaagatcaagacttctgcatgacttgtccattcttttattggatacaagatgaactgacatactaagtgataaatggaaacttgaggaaagccttcattttgggaaaagaagtgaagtgtaccaaactatatatagaaaccagtgtccctccctccagaactcttaatttgttgactttaggtgtagtaggtgcttaataaattttgtatttgtgtatttaatgaatacatgaatgaataaaacaaatgactaaatctgagatttagaaaaactcttttctatatcttgatttatatggattctggacttttctcacattcttctttttcttttcctccttctggttttcctccttctcttccttttacttcttcttgaataaaaaaataatagaagataacaaaggatcgtgaactagtactgtgactcagtcttgtagaatgtcagaattactactgatatggtttggctgtgttcccacgcaaatctcatcttgaattatagttcccataatcccaacgtgttgtgggagggagccagtgggaggtaattggctcatgtgagcagttacctccatgttgttctcatgatagtgagtgagttctcatgatatctgatggttttatgagggggttttcctcttttgcctggcacttctccttcctgctgccacgtgaagaaggatgtgtttgctttccaggcccccacagccatgctgaactgtgagtcaattaaacctcttttgttcataaattacccagtctcaggtgtgtctttactcacagaatggaaaggactaatacaactactaaattttattatccttgaatgcccaacatattgccagtaatttggaaaactaaagaaattgagcaagatgtctcccttctgtccttacacatgcctccaacaccctgcaatgctatgtctttccaagagcttaagagaggctgattatatttgaatagtaaggttacatttatttcatgtctcattgtgactactagttccaacttttagtcataaccaattattagagaagagtcagagttttaatagcattattatgtatgctttgtgttttagtgcacttcccaggaggttggtgatatcaccaccagcatcaccatttgcatcattattatctgtattagtccatcctcacattgctataaagaaatacctgagaatgagtgatttataaagaaaagagtttttaattggctcacagttctgcaggatgtataggaagcatagcagcatctgcttctggggagccctcaggaagcttccaatcatggcaaataggggaggaagagtctcacatgacaggagcaggaacaagagagacacagggaagatgccacacactttaaacaaccagatctcataagaactcactcactatcacgagaacaggaccaagggaatggtactaaaacgttcatgagaaattgtccccatgatccaatcacctcccaccaggccccatctccaacactggagattacaactgaacaggagatttgggtggggacacatccacaccatatcaccgtcttcactgccatagtgttactcttatctaattcattgcaatttcccttctgacaagtctttgatggccacagaggttctcttctgctgtgttgcataagctctggtcttgaatatatctctctttggattaatctgaggagtagggctacaagttgggaagcatggcagccatctaatcatgaaaattctaggtgagtttcattggcctctactggggttaccttttctatgtggtttggaactgcagaaccattatgtgcatgtgtgtgtgtgtacgcgtgtgtgtgtgtgtgtgtatatttatatacacacacacatatatccagcccctctgacattggctcctaaccattctgtacacctctgctttgccttgatcgcatgaaaatatgctgagaagctcatatttccactttaattgtaaatctgaattgataaatgatttaaggtccagtgtcttggtgtactctcttagtaaacaggcctaattcatctcacagaaataaactttgcattgtcattgcatagctactaggtagttccaggcctgatttgccttgaggggaattgaatgatgtaacctgtgcggtgcagcctgtgagagcaatttgggtggtttttatgccattggtttttatgctcaggatgaaagctcatggagaaatgtagaatgctattattatcttatcttcatgctgacagctccctctgggcacctacaggtttattgctggttggaggatcaagtttaaagggagagaacttcgtggttggtgataactatgccttttgtgtttctttattataggaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggtacatgttgttcgctcaatggtcctactctttttgactctcccattctcacttttcagtggtgatttttctcatgactgtcaccaaattccagaacactgagtgaagtacacattcatgatttttttgtatgagaagataagtcatctctttaggacttgatccagtatagggagcttctggagactttaccaactatgcactggacactttttgtcaacctttgactgatacagcctgactggctcataccaaagacaattacggtagattttgcagggcctgtagatgaggagcagtgaagggaaggatcatctctatcatgagctagtgtcgataatcataagatgctccatttgagacccagactttgtggtgccatttagtcggatgcagttgaaggtgcagatgccagagagagactctaaaaggacaattactgaacttgaagacacagatcaagtcatggtaacaatgagagaaaaactaaggtggaattttattcgtttggtggactttgctagtttttattttctcacttaccctaagcctgcctggatattcaaaggttggtcctagtagtcattttaatagcaagcatgctggtgtggcaggaaaaggggttaatcatctgtttaaattttacagtcaagaaacattcagcaacaaattcccagagccagatggctgaatcaagcacaacgggagaaaaggttgccttccttaaaagagatcattcaaataatccctcagctttccctcttgcctctcacttctcccaggaaaagtcctgaatgctgatcgtaaaagtgccaggaatggaagggacaacccttcagcaaagggccattgttccacaattgcactgtcatctgatggatgcaagagaatagtgagaatattgcacttctcactaatgtgggcatgaagtgatgtgctactctctatcctacacaccaaactcctcacaattttctcaccacttttctctaacttcctttacagtgaggtgggcacaataacaaagaagcttgaagcacattttcacatgtctaagagccattagctaataatggttatgcttgtgagaaagatacaaagtgaatttgcctatttgtaggccaagactttgaatggcttgaaggctgttgtatctccacacctaactcagcattaattttctttaaaagcctatcagaagtatctgcgctgttgggttgttccctaactgctagagtcccgctatatctgtttaagaattgtaagagcatctggaaacagcatgcaagacccccaaggtattgaggcaaaaagctccacccactattgatttgccatctcggtttccataaaacagccagctcagccattgctaggggtctcagaatttcttagattaaggcacataaatgcccttatgaggttatctttgagtatttgaagaaagccaaagctattaacagcttctaggaatttttatcattcaaattcactacacactaatagacttaatttttaaatgcttcctgcttaatccctgatggatgggggagagggtgaaaggaataaaagcagtccagtatcttaaaagctgttcataggctcatagaaaaaaatcaatctctctctccatatgtgttatcattggccttgctagtgttgctgaagggtttgttgtgtttctgttaggaatttcaaagatttctaaattgatgttaaccacttgccttgagccaatatagaatctacaagtttgctgccagcaatgagcaggctctttaatggtcatttttaaagccacagctatgtaaccaaaccggagattcttgctgtgcgcctatcttttggtgtctttctttagttccaaattatgggttgcttcctatatgttttcaaaacagattaagcctttctttaatagcattgctccctcctgaaaactattattatcattggaaactgttatttagtaacgatatgtgttattatttcaggacagggtacagtatagcatttataagtatgggccttggagtcaactggctagagttgggatcttggtttcatcacctgtgagtctaaagaccttgaaatgtcctaagcattgaaatatttggtgcctctccccacatgtaattcaaaatacagtaacactgaaccataaaataagtgtaagaatttctaagagtttttatttttctcctctgatgatttctgtaatgctttcaaaatatattagattctttcttcccaaattctcattttgtactttctctgttttgttgttctttaagaagatgttcattcttctccctgagactgtttcctagtctagacaaccagggtaatgataatacctggttaatgtgaagattaagtgagttgaccacatgtataatgctgggacaattaagtcaatcctcaataaatgttagctgtgaggattaccaatcatttggctagcattttaaattaggacatatttttgagtacagatttcttcattttgaagatgaaataccctatcaattagacaaggtagatattttttattctccatttcaaataaaaacagagacccaaggaggtgctatgcccttcctaaggtcacatagcaagtgaaggaagacctaggacaagatttttctgtttccaattgggcagttttcactattgctcccccagagaattgggggatgttctgaaaaatgcatagctagaaatgagtatttttcttcttgtgtcatcttagatttctttctttaaagaagtgtcatatctcaaaggtcactttccaatgatcacacaaaagtggttattgtgaggtgttgagttcaaaatcctcatttaaaagttttattggcaccagtgaccccaagctgctctccttacaacaatggcaatgtgctcccatgaagcagctgaaagaatagtgagtatttaaaggagctatatccccttaccttgctgcctcaattaaaaagttgttgtgtgatatactagatcgaggtttatgttccactctgccaagacttcctaggagcggttcactttttgagccttggataccttattttctctcctctctgcttccctgtgctattaaaaggatcaatttaactattaataatttaaagtatcatgagaaaaatctggcaatgtttattttaaatcataagatcaaaattccccgtgtctgggccatcaaacaaagccatcaacctggcaaggcagtcttgacagtttctacaaaaatgtgtccttttgttttctaaagtcattctattttattattttatcaataacagtaggtttagaaatcatcaagggtttagtctcactactcacttattactaatgtttaaacagtaaagacatacagagtagctcctatagaagatttatgttaagttatctcacttggagaacatgctctcggggaattgttcctgcctacaaggtctgaatgagtcagctgtgcaccgggatgaatgggtcatctccacagtcttctcatgggcatttatggggctctactgaaacatcccaccgtgaaatatttagaacccagctgggcacagggcatgtagcactggctctttctttgtgaatcagggaagaaacagaatgaaaatagttctatagcaatcggaatcttatatcactaaattctgggaggtagaactgaaaagcaacttctttctttgaacctgaaaatagaaaagctaagaaacaggagagggaaataaaagaagaatcagcccagagctatcatccaggcactgacaaatgttccttataaagtctctgattgttgtccctatacaatgcggtggtaggaacaagggagggggggtgaaaggtgacttgagtatgaggaattaattttagccacagctctaggccccctggaaggctgagctgactgggtttgttccatatcttctctctgctgtgagtgggtggccggtgatactgtcactgctgtaagatccctgagcatggtccagtaaaggcttttcaggtcctatctaggcttcctgggacatgcagactgatacacagcttcaatctttgtatgtcagggggtgctgaggagagcagggcataccaactcagttcaagtgctcttcacagaattcctcttcttcagtctttaaaatgcacacggatgacctacatttaaatcctatttgaccacccaacttagaacgtgaaaaagaggtaaaagtagctccctttcaaggatgctacattagaaaactctctttatatttgagtttgtcaaattccacagaaacttgtctttataggggttggaagagaaaacattgctatggtacttataaaacattgctatagtacttattgatgaccaaaataccttcatatcggttattacatttgagcctcactccatcctgtgaaggacagggtttggtattattactcctgccatacccattttaaggttacgttatcaaggctctgaaaggctaaataactttcccagtgtcacacagcttaaggagcagagccaacacttttctatcctgatcctcagactgcacagcctcaaactttctgctcactttcctatttctcagagccacgattttattaataatgacagtatttctttttgtaaaaacatattctcaaatggaaatctctgcctggagtagtctagttagtaaggtttttcaacctattgacatttggggctggacacatctttgctgttggtgtgtaaggaagggggcggggtactgttttgcacattgcaggatgtttagcagcatccatgacttttaccccctggatgccactctcatgtttccacaagtgccaaataccctctggtcagcaaaatcacccccatataagagccgctgacttagagaaagtttccaacatattttgtttaaatgttcatcatgtttttgtaatttagacagtatacatcggtataagaaagattttttttttgtccacatctcttcctcaattattgagactttaaaggattaaaaacaagtctatgtacttgacatgatgctgaaatttctcaggccttgggttttcattaattcctagccaggaggtttactttccttttctttatgtcttttcctgcgaacatttgagaccttgccagatttgaagcatgcattaaaacaagccccatctacctgctcattcatccgttcaggactagcgttgctttcagttcaacagggggaaaaacagagagagcagagtcctgcagagggaataagaagtataaatacaatcaagaaggaaagccatatttgaacaaggtttcaggactacagacatataagggcaaccagagaaagcctcacttaatgaatgtgtttgaacattgtgaggaacattttaaaaccatcttataaagaaggtgctccaacattcagtcacaaaatgtatcaattaatcactcaaactagtgtatcttgaatattcacactgctaactagtcatcctttccaatttgtcagaaatgaattaggattcacatgtttgtgagtttctatttccaagggaattatttccacattatgcagtttgtcttcggttaacaaaaatgttttaaaagaatgttttcaataggcacttatatatacatatttgtgtaaagcaatggtctgcaacctggctgaaattgagaatcccctgggaagtttaataaattgccagtgctcgggcactggtctcagggcatctaatttaactgaactggggtgtggtccatggatcagcagcatcagcttcccctgggagcttgttaaaaatgcagactctcaggcaccaccccgtacctgcaaaatcagatcccccagtgctatgggtacattgtaaattgagaaacactggcccaggcatttttttgtttgttttttgttgtttttaaaaaaagctcctaaggtgattctctgtgtagctaagtttgacattcactgatatgtagaagctaaaaaatgtgtctttctttcagactgactaccggtactgttcaatgtggtagccgccaaccatatgttgctattgagcagtgtggctggtatgacggagattctgaaatttttgttttattatgtacttatgtcctaggcactgaaggctttaaatacatttctcattcagtcctcactccaacactatgaggctataggttagaggctagtattagccagtgcaggactacaatatgccatcttttatttccttttatgtgttttctaccatgtaaacgatgggcatttgccttcatgtaccttctgaactcatctaatgagttttgatattatacaatcacagggataataactccaccctatccaagcagctgttggagagtcattaaagggtgatgattaagcatgagggttttggagtcagactttctaggtgtaaccaagggcccctggccctgtcacttgccagcttgcccacaaccttgagaaggttcccgctgtcgagaagtttctctatgctttgatctccatgatcatatatatgcattttctcgcattaaaaccaagtgaatgctcagattgacattactataggacacttcacaaaaaaagaaagtactggctagaggtatgtttcctaaacacacatggcaaactaccctttcttaagctatatttgtatgctctgacagcatggctatggtgcaaatctatcaacaaacttgaccctaagaagccagttacatgacctataaaatggggattgtgttcattgttctgtcttagaaagtggaaagttctttgaataccttaaagcattgcatgaataataattgtacctgcaggtgtattgtctggattatctaccacccgtatacattttaggaccattttttatcttgactttctacaatgaagtttacttatgaaaggtgagaataggggactaagagattttccatcttgctttctcatccttcatggagaattccacaatagtagaaacggttccaaagtgagggacatgtgcactgaataaacactttctcccagaggtgtaggaagtggcagatggtgccattcaccgtctctcagccaaactcacccaggtggtgatggctgccatttgccgaacatttatgacatactccccacttcatgggcagcatcctacttagtcttgaaaccacccattaggacagcgttggtcttattcccatttttttagattaggaacagtctatgggagtgtagcttagtttgggaaatgctggtattcaacccagaaccatctgacttaagagtcttaatgtttaatcacactctgctccttccttagattctcgtaaacaccctagaacagttgcatatcctagaaattctgggtttaactcaaatcttgacaatttagaatttttctctcaagttaaattatagaattcccccctcaggttaaatctctgatttctgcccagtctagaagtcagcatttccttgggcatctatacatatttggctttatctatatcatcggtgtggcctctggaagccttgtcagcctctttctttttgcgatcttgttttaccttctagtgccatatctatgcaaaaagaaagaacttttaaatgaaggtttgttttgccatttaatagtcttgcttggggagtgacagagtggcaagaaggtgcttagtatttttttaatttaatttttgttttatcaaggaaacttcctttcttctctgtgaattcccagccacagataaacaggcttgtatcttataagttaaatacaattactgctatcaaacctagagcctttttctctctcccataaatgtctctaagaagctgataagcatttcaaggcaaactggagcttggactaatgctaaaattaaacataaccacccagaagacaaagagaccagatagaaatacataaaacatttgaggtggtgggaacacatggacacagggcacatagaaacttgcccccaaaacattaggttaatacatagctcaaggttatttataaaggaattaacatacacaaaggagctttttataattataaggatttacatcagataataacaattgtagtagccaaagatattatttatctagaattcacttgtgaacagggcatgcttttggtctacagggctgttgagcaaaagaataattttgctgcaaccctctgtaggactttataggatgcacatttacattttccccatttttagtagactatcttgggatttaaagaagaagttggaattttaaaaattagaaagcacatcatatttatttagccatatgttaaatgttataaatattatagtttagggactcagtaaaatgaataattaaaaatttgagggtcacttctaggtacaatgtaaccagggatgtaagataaagaatttcttgatttccaaccataatgcatctattttaattaaataatatctttcaagattagaaatacagtgtagtcacactttatgggatttttaaaattatacttatctgaaatagtgtgacataaataaaaatattaataacatctccctctatgtgaggcatcagtaataacatacattcttctgaattaaaacaatcatcaaatattgcataatttcaaagctggttagtgaattacaagttttgttttccctattgtcacatggaagctctagtttaagtagttaatacaaattctggcctgcagaagttgtctctaattacgaaaacttagaattattatcccagccataaaatacaattaccctgtaccgtttttcctctgccccagagctgcctgaacaccaagtgtcctaccacccatacaagagcatagttttatttatgggaaaagtttccaagttccagtctcttcaatttaaattttgcacaaggttgcagagtctctctagttatttaaagtctaaaaagaacactgagcttctttgagaaaggtggtacataaatatccaataataataatatatattcacatacagtatgtcatttatacttctataaagcagagaaggtaatgaaaggtgctctatactgtaaatcactcaatcgattgtaatcatattgcagctcatctcaaagagataaagaccttccactcctctaaaatccctgtcaatatcctagcaggctgaagagaggggaaagggggtcagaagaggaaggagggaatgagtcaaggacaaagcggcactttgagtcttcagttcatggagttaacatgaatttgattggattcccagtgatatttacagttttctccataagatgcatttcttttccacacggtacttttacagcctttcagtaagtccctgatgctctgtgttggccttgatggcatagtttactaagtgccaatggtagatatatagcacagcataagaagacttagggactaagtttataagtagcaaatgtcaattcgacagaacttaaatgctgaagtgtatatcaaacaatagaagtcgattgatcatgggctagcaaaaaatttatattgcactttcaaacagcagaaacactgtaaaaacctttttactaactgctgttgcctttaatgtaatagaagtattcccctatcctcatcaccggggtagctctgagtggagccatttctttatgcacttattcattcaccttcattcactattcaacaaacatttgttccacatctactttatatgtgaattcatactaggtgatgggtatatggtgaaaaatgaaacacagctcctgacctcaaggatcctcaagtgtagttgaagagaaatacaagtacacaaggaagacatttttattgagcagttattaattgccaggtagggtactgggttcttgtatcaagtctttgcagtagccccaaggggtagatattactgttatcatttcacaaatgagaatctggagcttctcctagggtcaagctagcacatgaatacctggaactgaagcctgtatgtcttagaaggcaaacccaaagctcccgtacgctgccctatcttgaacctacaattccacaaagtgaaagaaggtgctactattgaggtgagatccaagttcagtagcgggtacacataaatgcctaatggagcctgaagatcagacaggggcgagcatggaatacaatttgggatgtgaccttgaattatctggaacaatgccaataagctctgctcccctacctagtgtgaaagatgacatgacaacttatacctttctcattgaggaaattaatgaccatggaattctttcttttacttaaattttttttttacagttttattgagggatgattgataggcaaaaaaatcctgcgcatactttgatgagtttagacatgtgcgtacacctgtgataccttcaacacagtcaaaataaacacattcatcgtaccttattttacttagtgtcatctccccagtggttccaaggtagaagtattaatctccctcatttacagatgagtaaaccaaggttcagggaggttgagcacatttgctgtggtcactgtccaccaagggtcaactctgagattccacacagatatgtttgccctcatttgccctcacaacctaatacccaggttgcccactccacttttccaatgtcttccaagagcactccagtttgcatcatctacagagctcaaattcacatggttgacagatacaaattcacatgcaaatgtactattatttcctacatcccagtgcatgcagaacactgtaatcccattattaaacatttactagaaatgtgcttctgcctgatgcacaattgccagcctcaatgtttaattaaactagatttgttttcattttaatcacattagagaaatgtgtttttctcagagttcagtggtgaaatcttcattccaaatgcctccaagtgactgaaaactgtatatcccagaggaagggatgagggtattacaacctatccttgcataaaatattttaggggaaaaatattaattaataacaggtaagactgggatacactatttgtttttgaatcatcatagcatcctggaaaggggtcctattattattattaccattttagagatgaggaaacgaagtctgagtggttaagtaacacactccagtgttgcacagctagtaggtggcagaaccaacatttggatgtagacagggaaaccctgatatctttatttagattagggatcaccaaaccttttcccccaaaggccaaataacaagtagcataggctttagaaaccaacctatcttataaatataaatatatttagatattaacttcaatattttattaatataaatatgatatgatttgcatgatctttgttgcagttattccagtctgctgttataatgcaaaatctactatagacaatacataaatgaataggcacagctgtattctaataaaacttgctttacaaaaacaagctgtgatgaaccacgtttccccattaggtttagctgggggaaccctgatttaaatcacggatagttggaagcctacagcttttactaatccatcagctttattttttgaattgtcttatctgtttggaataaagagagcaagagtatctctaagtggatgggttaaatccctagagagacagagaatagtactaccgtgtagggtgacatagacctactggtgaggttaattcaggataaagaaataaagagatacaatatgtaagaaggacaggcactccatttacgtatagttaaaaatgacaaacaacaaaatagctaaataccatttttttaattcaacaccaaagacagacacagattccattctagagcaagatttgaagatgatggacagaaagcattgtttctttacttctgttacttctacttaataagccgtggtgatttaaatacacccctctctcctaaaaaaatagtgcttacttttcttttaaattcaagaattttgattagccaccctagcctatttctcatagcccttatgcataaaggtgccagttgatgccttgcattgatctttcttttctcctacccgcaccctgattgatatgtctgtcttctaagtcttagagagcatgcccttcattatctcagcattggttgtccctgtcttgctgctgagagcttcctgcttgagcttcagttccattttcaagccattgatctgatgttctgaggatggactagcccactttagaggtggctcagcccacttcatgctattgagttttagagattttagaatcagatcccctatttattaaagcagcaagaccaggctatcagtttttatagatgtgcatatgcctaaaaccatgtagtatttaaaataaattttgacctacatcctctattccccaccacgcctggtacccaccattttactttctctttctatgtatttccttcacttttattttttgctttttggattccaaaaagtgagattgtatagtattttttttctgtgcaaagttataagggatgaataagtctagagatctaatgtacaacataaggactatatttaataatattgtattattatatattgataatttgccaagagagtagattttaggtattcatacgacaaagaagaaagaaaggaaagggagagaaacaatcactgtatgagatgatgggcatgttactttgcttgactacagtcatttcagtgtttatatgtatatcaagattacatatataccttatatgtatatataccttaaatatatactttttttaaaagccaaactaaagcacactgggtttttatttacaaaatagggacccccttcacagtttgctgacctcaattttgactccaattaagttatcaaagttctaactaccagaatagaaagcatatactgccagatttggccctatagtgcaagaaaagtggtcacagttttcttaatcctcttttaaaaaggaaagaaacaaacatagtaggtaatcagtaaatattaaactgtacaactgaggtttttggagctttctgacttcaatgactgcatatacacaacaaaaatataagttgttatacagcatccttgacaagcattaactataaatacttttataacaaaagaaaaatatcatttactacaaaacttttaagcttttgctttagaaatgtttctttattgaaacaaatatgattttattgaaatattttttatattagtacgatgactctttattggtctcaaagggtggattgccaagtataattaaacaaaatgataaataggaggaagatttcagtatccttgacagaaaaatacatataaatctaatatagatatatatgtaaaaagtaaatctaaaatcttagccaaggtttagaaatcttattacttcatttttatacctttataaaactgttgcgaggtgctgtttcaaataaaataaaaatttatgtaagtaaaatacaagctaaaatagaactgaaatgtctttaggtttacaaaatgaatagctggattagtttactgaatttttttctgtggtatgggtggcactggatctctagaatcggtaaaaataaaggcaatatattgttctcagggagcaattgagctctcctagaggaggcaaaccaagtgaaatctaatagttttgcttcattctgtgactttcccccgctatgacctcagaattttgagctacaagtaggtctataaagggaattttggaatactcttaatagatctgttcttgaaataagtcagctaaactgagtgaggtgctttgccaacacattaactgaaagtcctgaccaaccctgatcccagaccttcatggacaattctcttgttttatttccatttccagtagttgtatgtaattcttctaagagacttgttccaagccaaccttcctagtggtcttgttgaaatgagatagtggttgtaggtatcattgatgaacacataggccaaaacattattgaactattcagaaagtaaatctagcttattctgtggctgcataattatataactgtagctttctgtcaggttacagtggctttaattttctgatcaaataaaacaatcaatataattgtactttgttcctccctcttctggcttcgattctttgatttgtgccactcaccactctcattcttccaacctccccctactccactggcccctgcagctacttagaatagctagctgttgattaaagggaccaagagtttgagcagttactgtatactttcaaaccccactgccatttggaagtgaagtcccaactgacatagccaaactgtaaggacaaaagcaactctaatacctgctttcctttgtttatagcaactgctcaaattctcctctaaaagtattcattaagcatccttctctataaatctctgtggtagaaactgaataataggacttgaaccattattcaatcagaccaagtttaaacccaggttaaggaaagaggaagtctacacgtctttgctgctcactgtgtttagtatatatcctctataattcacaatcaaaagtaaatctttggacagcattcttgtttgggttagaagaaaaatttcaatccttgttcagaagtctaagcacttgtgaggattccaatatgatttttaaaggccaccatccctgatagtcagaaataaaaacattaaaccaagaagactgcaggctttcttctcacctgtccatctcttgtcctaattacaccttatacttactaatgttgtaagtgctttttgacaagacagcaatggtacatcaatagatactgcatgaacttgagtaggcaaatcaagtcactcagaggccttcttttaatctcttggatcattattgcaaagataaaagcaggtttctgaaggagtgaaattcaaaggaacctagtaattagaatggtgaaaataccaggtcacccggtccgtttccctgcttggttcagatatttctaacaatatgtactagtttaattttattcatctaatttaaaatgagagactttatctttcttccaccaagataatatatctgatttctcctctttggcttaaattttttttttcattcacatcttttattattagggttgtcagttgaaattattttgaataatttctttaaatcatggatttttttcttacatctcatatctaggagctatttcttgttgcaaggtgcaaggttctatggcacatacaaaagcatgctttcatttgggatatttataaaatctctctatacacacacacccatcaatgggcaaatataaaaagtattgcctttgtgctagcatgtagttaatattcaatgaatatctttacacgtaaaatcacctataatctttagacatgttcctcagatagccaagatttaatattacatataaagtcatatgaaatagcttaaagaaggaagaggcattgttattttatgtatatgtctcaaatgttataaaggttataagaacctttctgaacatcgaaaacttcaaagctaatagtttaatagtttgttggatacctgccatcttttgaggtggccaatagttgtcaactttttgagtatccttgagcactgaaggtatgtcaatgtttggtttcattgtgtgttaaggagggaattatagaagtagaatggagtaaaaagcttaaaaaagaaaaagcactgcttctaaggtgattctaatttcataggaaaaaaatactttaaggactaatattcaatacagagtagcggaatctgggtgccagataaatatttaacatttgtggataattttacataatcattggccactttcttaaaagtgttttttaaagccctaattttaaaaaatgctattctggccatcacatttacaatgtgaataatatttgagtcatgacgtaactataagttacttctaatgattgactgtcacttgagttgtaaatcacagcatttagcagtgctagttgtccttacttttggtaaccccttagtccctggatcttgatcattttggggtctttactctagagtctatctttgctctagagtctagctgccattcacatgctaaagaaatgccccttaaatagtacctataacatcctaaggaaatgatttctaaactcttctcaatgagtttaaaaaggctgctttttgctaatccataaactttaacaggggctgaagaggcagtgcctgctttttaaaaaccaatgttgcaggctgggcgcagtggctcacacctacagatgcatgcctatagtcgcagctatttgggcggctgaggcaggggaaggcgggaaaattgcttgagcccaggaggtgaaggttgcagggagctaagatcctgccattgtactccagcctgggcgatgagagtgaaaccctgtctcaaaacaaaacagaacaacagaaaaaaaggtaaaaccaaggttgcaaggtaggactgtttgtgtgtgtgtgtgtgtatgtgtgtgtgtgtgtctagttttgatctttaatgagagttttggtttgtttctattgttgtgtgttagtagggaatgtggtggaggagtgcctttctagtctaagtatacgtaagtgtattcatgaccagtattcaaagggtattcataccctgcagggacataaatggttttgttttggaatgttagggttaagaatgaaagtgatggccctgtttgctcagaaaaaaaagaaggtaatccttcagtgctctctgtgaaatcatgtatggaatgaaaaaattcattgatggggtgagaggtctcagtgccagcaagtcttactagtaaattcagaattcagcctgctgttcctagagatcttcctctccactcctcatccaaagagtgatagaaggaggtcagataagtaggtccttgtccctttagggagctacttaactctactcattatcgtcttggagtcaatccccacctcattccctgctcttcccctagtctgtgtctagaatcaaggatcagagaagcatcaacacatgcatcaacctttctccaattttccttccctttcccaactccctcagccttaccctctcctctcaggaactgcattattgcatctcttcttttggatttggtaattctttccttagaaagaggaacagggctaaggataggcaacaggggcccagctgtccatgtctccatccttggacccctaagacttttgccacacaaactcctttgaatctggagactgcaacggagctgcttccctcctcctgctgagccttcatggaaatcctcataggagatagtgtttcctttacccactctcggacccctgttcttcctggatctcctgaattcctggctatatcatttaggttcgctgcattgcaaaccactccaaaatttccgtggctcatgtgagtgtttttttctcttctgggttggcttggatggagctagatgatcttgatggcctcatgtacccctctggggtctcagttcagatagccgagtaggttcacatggctgggtttcttttctcatggaagttcacatggcaatctcaggtgtaggcagcaggcaagggcaagcattcatacacagatggctcttcaagcttctgcttatatcacatttgctagtgcccatatgcccaagcaagtctcacggcccacccagaaccccaagggtgaaaagatagattcaaactgttatgagaggagtaagagtctcactgccaagagacagattttgaaatgggattgtagctattttttttttttttccaatttaacacactggaaaagaagaaaggctctggttctactaatcatatttccctcgtaaattttctccttccaaccctgattcaggtctcaagctgtggttggaaatcagtgactttcactaagggattgtcctttcttttctttaggacatggctttttgaaattaatcttgattctttctgccatatcccaagccttacatttttttcctttttttctctatgtctgatcattttgctttaagtcaaattgattttttaaaaattaaatgcccattaagaaaattatccacattcatgttcccttggatgctttcaaatattttattttcctttgcttttggcagttacaatctatcagtgttatttgtaaaatgtcttatatttgtatagggtatgttctccctttcctcttttcttcttttctttttaaactaagatagatgtgttataaaacagcccccatgctgatccatacttttctctagacatttctgtgagctcagtactttgttgtttatcattatcctttgtttgtagccagatttgaggccatgttgcagttctcacaaacaaatcaatttgaattaatttgccaagtagaattaacgaggcattgtatgaattcaagacatactacaactacggcatcccctgaggttatttcttctctgggaaaattttgattcttgtaccacattttaatagtgtatatctgacctttgaatcttgcactaaatgatacatggctgccagctggtttaatttttgagaagccttaaaaattctatgcagccaaacaaataggagtgtagacaattctttaattattaactttacggggagaaagttgtcttcaagatcgatactctctgatgcttgcttgttgctaggagttctttttctaatgatgttctaagcagaagtttgagaaacatcaaaatagagaatatatatttcttagatggtctttgaggtctccacaacctaaaaatgatgggctccttctctcaaattataagctataaatcccagcaaactctactcccagaaactgtttttatttaattataaaatgggaaagcatttactctaaagagggaccatggtgattacctgaaattccttcactccctaaatggacatctacatctgtcactaatatattatttagcaaaagaatttccttcagactatgatgaccaatgcaaacaaaataaataagaaaatccagtcccctcccacccctcacacggtgaggaaatggtaatagagttcttcaaagaaactctaatttctgggtcttagatgaataacattagaagtgcttaaggaacttgaattctaagcccctttaatgttcgctcagaaataattaacaggagccagtcagaatagaaaactagtctgggaaaagtgtcctaaattttacactgtataataggatggatctcttaaactcgggactgatatataaaacttctccagtgtttcatttgaccaaaaattggcacacatttagctagatttaaaaaagaatatggtgatggctgagaactaacctgggctcattaaaaaacaaacaaacaaaaactcacgcatgctagtgtaactttctcttggatagcaatagcaaattggcaggtgaggaggatattataaataccatgcacagtgtatcttcatttccctaaagcagtatactgtaatgtacagagaactatgaagggatcttaaagagacctgcctgtgttccatcatttgaagctttctggttacactgtaaagtttgaggtaaactaaaataataaaagtaaaatttattatctcacagtttctataggtcagaatttgatagcagcttagttgagtgattctggcttaaggtgtctgatgagttgcagttggtatgaactacggctgcagtcatctcagtgctatctagacctgggagatctgattacctggaaatctttcactcacatggatgttgactggaagcatcagttactctctggctcagttccttgccttatgtatgtttccatagaacttcttaagtgtcttcatgacatgagtctagcttgctcgaaatgagtggtccgagagagagcaccttttatgactcagtctctaagtccacacactgttccttctaccgtgttttactctgtagaatcaagtcactaagtccagcccacaatcaaggttgaagaatcaaacctcacctcttacacagaggagtttcaaagtatttttagatattttatagctccatcataatcttcctattcagggactagaatgaatgcacaaaaaatatgcttattaaatttgcagataacacaaagctaagagaggtatctcctaccagaaacaaaaaatcctagagttaaacattttcttaccatgtttggatgctgttatgaaacaaaaagaatacatttaatgagatataaatacctgttggacgttcataaagtatgttgtatgaatgcaacgtggaacaatttctttgggaagccattcaactagaaactggcttgagttttagttagaaacaagcctaatatgcggtcctgttatgatgtggttgttgaagcaacggttgcaaatcagtatactagtcaggcctcctgtgggtggtgactagaacagtgattgttacttttagatattttgggaataataaattcattcttaggcaagggggttcaaggatggtctaaaatgtctacaattttataaacactggcaattctataggatgtatacagaaggattactatgtcataagtttcttgagcatcggagatattaataatagcatgactttcctgttgtcgggatgacaatgttcctgtgttgtgcagcggaattgtcctcccaaacctcctccctgtcctctgagctgtgtggggacaccacatatgtatgtttaaatgaacagaattttaaaaaatcaaatattctggcattctggcttcaaaaaccttgcgtttgatgttctctacttagaaataaataaccaaacatgagaggaatgagaggagatggggatggggagtgggaggaagagggtagatagaaataaaaggaagaacaacattacagagaagcagagatgacacagagggtggacacgtgggaaggcctggatcacaggggaaagagtgagccccaaaataacactgtggcttttgcagcaaggaggaaataagtgataagaggaaaggcacctggggaaatcttgaagggatcatatgtcaaacggctgaagagcaaacattaaagctttattttgaaaaggatatttgaaaatatttgacaccaaaaattctgtagggaagtaattcttgtggagtttgccttctttttagtttaactcttctgaatcaggtacttgttataacaaatcatatattgagggattattttgtgccacagatttgcaacatgctttatatacatttccttttaattctcaccgcaatcccatgttgcaattattattacgatccccttttaaatatgaagaaactaaaacttaaaatgcactaagacatggctaaaactaagcatggttaccagaaaggaacaagacaaaattcagacattgaaatcaactactgtagcttcagtgcatatttcagaataattgtggaaggaaaaaaaaagtgacatttgaggaaagaaagcaaattttacagtcagtttatgttttgttaatttataacatggcctttttgagaggggctcttaaataaagaattggtgccaggttaacctggcatactgaagaaagtttcatttgaagttgcttgaaaatattctcttaaattataggaatgaataaagaggttgcagtcgcctgggcctagttttattaacctaactgggattgaaagtatccttgatagaggaggagaaatgagcttcaggaagtgagttacaaatggcctcaaagtactgagaaaggataatgattggtaaaatatgttgtaattattgcatcaaagtaaatcattttagtacataatacctcagcagaaatggatttttgatttgtttaggatatgaaagagaagtctaatattaacatgtatgcacaaaacatgtatgttcaaccagcaacagacagcaaggaataggggcatgaacattcggatagctggacgtaatacaccagggttacatctccggcatggttccattcccattccatagcctataagatatttggacatgataggccaggtgtggtggctcttgcctgtaatcccagcactttgggaggtcgaggcgggtggatcacgaggtcaggagttggagaccagcctggccaacacagtgaaaccccatctctcctaaaaattagctgggcatgatggtgcatgcccatagtcccagctactcgggaggctgaggctgcagtgagccaagatcacaccactgcactccagcctgcctgtctcagagaagaaaaaaaaaaagatagttggacatgataactacatgtctacaggctcatcagagagagagcacaggcagaggctagagctcaatgcaaatatcgagactgaaaaaggttttggaaggctctcaaggcaaggatttaccctgactcccatccccctgctgttcaaggctccttactgggagaaagaactttcttttctaagccttaggtgagtgttagggaaggatcctaagaattaaaacaaatcacaggctctctcaactcccaacctcttttgattccccacaagctaagcccttgcctgagttattgcatttaatttggataaaaccatgcaatatagatattaccttttttaaaaaaacaaaaaacagatgaagacaccaagagtcatctagattaaataaattgcccaagttcacagaactgataaatgtctggacttgattcaaagtttgtctgactccatatccaatattcttttcactcatgtttgggccatctttgcttaaacagatcaactagcacagcctagagttggtaaacccatactacaactttaatttaggaaggaaatgatactgtctgctcgtatatatttgccattatcagaacatatccagaagacatgtagaggtgagctttatcagccaacttggtgtacgacagggtgatttgcacttctttccagggtctccctggctcaaggagccacttaaaaagctcccttacttaataatgcccttgtgctctgggtctattaatttacttcccacaagctgatcaattttctgttccaagacattaatttctttaccttggcacattaaaggatcaaagctcacaacatataaatagttctttttccttctgccccaaaggtgtgtagtgaggattaatgagatgatgcttataattgcattttgagctccttggtcgaaaggcactttataaatacaagatattagttttttgctgagatccatctatcacttacaagtggccaaacattctagatggcctttgggtgtgcaacacctccctctctgactctgagttggtctgggacaatgccagaaatgtggctcaagccaagttcagagtttctggagttcccttcctttagtgtcatatactttctctgaaacttaacttagaaagtgttctttgggggaagagacatggcaataacctctaaactgccctagtacttgagggcagcagtaccactacattgattttcttttgcctctgactttaatacatagcatttattctttgactgttcattagacccacagtctgattttttagtgtcaacaaagcaataaagaaaatttgttcctcctttatttcagggctcaagacaaaattcaaaaatgcctttggcattcattttgcacagacgaatgttgttaggatattcctattagcatgtccacgtgcttgacaacatttcaggtggtattaatagtctacctgcaagaaagtgctttctgccagcctggtgcaaattggcagaacctttaagccactctttctcagcttagcagcagtatatcatcattacctgtggctggaccaagaaatcacatttgtcaatgcctgaattgctcttttactttcagtggttttagaaatccactttgttttggaaatgggcttagctgagtatgttagaagatacagaaacatataaagtgatagataagggatttaagggaatattaaggatgttacattttctatggtcagttgatctttggaagatgacttttgtgggaccaaatagaatatggtcatcttttgaatgaaggactggtaagtgggaccaaatagaatatggtcatcttttgaatgaaggactgataaggtagtgagacaagggaagcataccgtggaactaatgagcttccttctgatcactagaaaagagtcgagtcatattaataatgatagtttaaatatgctgtactccctattattctatactaagtcctatggtaaattgagaaatggggaaactgaggccaagtgacttgcccacgatcacacagctaataagtgataaagttagaactcaggaccagatttgtctccagagcccatggtcttaactcctatgctgtattgattatggctttaagagtattagtataccttctaattaaataggacccatgtttggaccaataaagtgtaagcgcagtgttgtaaaagttattttccatgttatacaagagttctatttttcagttttttcacttgaaataattgtattccttggagactgttaataaatttcgagtctcaccttaaagaggaattgatgtatattgaggcctactcaagggtcagtttgctttccgtttctttcccttttacttttatcctaagtggattcacccaaagtggaaaatgtgaggttggagtgtaaaggttggaactatgaaccagttgggcttcaatactttcacctcaaagtattctgttcttcacaatattataattccacagtgcatgtgcttgttgcacacgtctccaggagttgaaatacttgatattagagccagtggtccaaatgaaaatgaccagaagaggccaaatgtataatgttctcaatcccttatcaaaaatagatgggaataaacacacatatatttaagtacaataaaatgtgactaatatgtttttttctaaaacccagtcccatataggtgtcggatccacagaagtaatttaagaatggtttatttgaagatctctttgtataatttatagatttctcagtgtgattaagaaatgaagttattacatttttttctctaattagtaatgcacgtatgcctccttttaatgatattatgatgtttactactcatagggccattctttcttgagtatagccatcactttctgttgaagaattgatttcactctttgtttaaatgtacatacttgttgctatatgaaatatatgactgaatatcattaaagatttagcaagaatgtaggtgaatttggtgaggtttgttcagcttttagagtagccctgtataagaatacttatatttagaaggttgtttgcgcttcagtcaaactagcaaatgaggcatggggcaaataactcattctcatgcacatgtttctaaaacagttcttactaatgtttgagataaattaaaataaacaccaacaagaacatgaaaagagactaagaacaatgttaatgcggcaacttaaacaaatttggttttccaaatgaccttccatctttcacaacttttaacagcatgcaagattgctatccttagtgccagatactatcaatctggtgtggaaaacttaaaacttttttctaaatgtctttaaagctgaggtggagaagaatgactctctgtcactttcagaagggtctaaggttgaatcatgaccatgctgtccttccccatgtcacttactgtttatctaacatagttatctctttttctagcctgtatcatgcccccagattattttctatggtgctttacgtttgaaagagagtagatgatgagggtggggatgcttaggagggacaagggccctgtgtatttggaggaagtaaattaatacagcttcttaattaatttggtgtatattaaattctagaaatttggaattttagttacttctgattttgccctgcattttgctaagaatatttagctttatacttgctatcgactacaccaatctattccgtagtgagtagaatgaaggtcattaatatatttaatgtgtagccaacaatggcagatacagaaaacccaaagtaatagaatacattcaaggcagatctggcgcaagccaattaccttttctcagtatagtattctgttgtgtctaaaaccctagaggatgaatgacatcctttatgatatctgtcacctgtagggtaggattatgagttatagatgtatattcgtttcaaaaaggtacacgttctttttctatgaaaacgtctaaaaagtttactcaactttattttgaatgaatagaatgttgtaccaagatctaccaaggtagaccattataatgatctctaatcgatagctatattctttcgccatgggctattgaaacaccaagaaattaacttgcctgtctctttttcctctttgcctgccctctccatttttttctatgagaaatgattccttgaggaaaattttaaattatccactgcagttcgaaactgttaattgttcctattgcattttatttttcaatacattaatatgttataccctgtaccaaccagatacagtcccaaaacataggctagaagcagattcatagttgcctcttttatgagttcttattttaaaaattcctggtagtaaagatatgagtcagcttgttagaataatttgtctgtatgagaagtgaatggggaaccttgtgaacatcctccaatattgctacccgtttcctatcctatacccccaccctcacaacacagaaggtaggtaccagtttattcccaggtggaatctcctcagccaataatgactcctatatggagatggccctgcaattgaaatgctttagcatgcccctattcatttggtctgatgctatatgcaattctaatattctttatggcttttagaattctttgtaaattgtttccaagccacctggtttgagatttttctttcatttttaatattggtagtttggaatggagttccccaagttgcaatataggcctatgaatcaaaagtaatgaattacaattcactaatttctgccagatcaatgtgaggttggttgatgagatagaacagttcccaaggcatggcttcatcattttgttatttgaagcatattcattaagggtgtatctccacagcaccactctccaagtctgtcctaattatggaaaccattcagcagtgttaataacagttacgaaggaagagggggggcatactggcagttaaaaccactatgtttgagccttgaaactaattagatatttcatgcttggaagaagtattcctaacaggctttatgaatggatgcttgttcagaaaggtcctcttacagtaaggtaagagaaagagaaagcaggagggagagaggaaaggagggaagtggagggaggctaaatatacaaaatcagtgtctattataaaatatcggtgctcaaaagtctacaaatgttgtaccactatattataattacctctatttcctttgacatttgagtttccttatttttaaaaatgtggaacaaatctggaaagatagtgatataaaagcttatctgtactgatctacctctttgacaaagataatgagatgcaaggacatcctttatgtaataagaagtctcccttggccatcaaggcttaaattgtcctctcctcctttcccctgtcggaacataaagctgttgcaaacacttgagaggagaagaaaagaaggacatggccctatgtttctgatgggaatacggtagattaatagtgcagcttgcgtgactgtggagcgagggtcccgtctcacatgtgaaactgatctggcaggtgaattagtcatgggtcaaggagatccttgtgtctcaactggcccaattaaggtgtggttgagatgagacagagagagagtgaaggtaaatccatttccgtaaacggccagacctcttaaggattcccattccatgccacttttccaaaacatgatggagtactgcatggctaagactaacctgacctttaaacctatcgaccaagggcagagtgacttcaactccacctctactaaagataaattgatatctatctctaaaaacttcataaaacaaaccaaaaaacctaggatgttttttaatgacttattgacttttcagattgttctttaagctgttttttaaactttaaaggcaacactgataatgaacgcttccaaatggtaaaacagaaaatccccttcaaatataatcggcctgtagaggagtggctgcaggaaaaaggtaaccgtcattaaaactttcattttaaaatcatttgatcctaaaccctcatttttaaagcctgcaaataaatgttccttaaatgataatcgcctgctgcataaatgactgttttaattttcattataatttgtgtcagcttccacctgccatatgttgataaatcatgctataatacattgccattaaaatacagttaaagggactaacttctagcctgctatcagcatgacaaacacaaacaagaaattccaggaacttctaaaacagaaatgtattatggcaatttaaccactgcatgacattatttattaatttgttttaaattaccttttacaccaaagctttctaaagaaattccaaaagggctttttaaacttacacctggaggctgttttggcttgtagcatgcttaacaaaacaaaaaacaaacaaaaaaacaaacaaacaaaaaaccatagattgactcttgtaacttaaactacttaaatattgtaaggggagcatttttttttaacatttgttcttaaagaaaaaaatgaaaaagatgaattttgcctttaaaacctacagaggcaaaattattttctaagagattaaggttgtgtcctagttgctgactgaaactaaaaacaaaaacaaacttattttacacttcggttgtgtgcatacacttgtgtatttgatgttttatgcaacaaaagtgtaagaagttaacataatgagttggaaaagaaaaggttcatgaaaggcaaaacagcagtctctgatttgctggagacaacaaccactgttaataaaagagggcagcggttataactgatgttagaattttcctgtatagcttctagctgttagaaaataaaccattgtttttcaatgaaaaacagtctctaagaagatacgtattctttgttgttgttgttgttgagccagtgtaagctactcttgtctcaacacctaaagggagctcttaacatttgtagagatttcattgagttatatagaagaagtaaccaggtatattacttagtatacaacttaaagagcaaaggactactacagttttaagttggaggaagacattcagacctttaaacgtggaaaatcctcacggagtgttaactgtttgccctgtttttaatgtatgtggtctaattaaaaataagaataactctaaaaagcaaataattttgtttagtaatcatcagctcataaagtccctttaacattaaagacaatgattgcctcactttaaacaggaaaagcaaactagatgcatgtctgagtctcatgtgcctgagaaacctttttgtttctttcaattttatgttaataatttttattttactccattgccttttaagtctaagtttaatagcatgccaggcattttcatttgtataaaccattataaagttattagtaggcttttagtttttcttacaatagaattgttacccgttggctttcacataaaaggtgctttcaaatatacaagttgaggggttgggatggggggaggggtggctgaggtgggactggggaagatatcctagtttcttaaatatatgtatgattatatatgcatataaatctgaaaagaattatttgcaaaccgtgagtttctcttctacattttgttctctgaaaaaaaatttttgttgtaatttgggtgagtaacatctatgcattctattgtcttacctcttcctctgcctagctaaccttcccttcaaaaggaataaaatataccaaagacttgtaaagacaatgaatataaaggataaagatagatggatgattagacagatgcatttggaagtatttggaatgcctctttggagttatttctgtcactggggtggagagctgggtcatagcattcccaagtctcttttctggctctgtctactattgactaactttctgaccttagacaatccacttaacctctctatatctcagatttcccatctgaggacgggcaaaataatactgcctattccccaagggtgttctgaggtttaattaattagtctttgtgcaacactgactggagacatgcaaagatttaatttaagcagtatgtgaacttgatgtccaaatgaggtaataattaatgacttccaagaggatgggtatctaaaacaaaaagtaacctgctacaattcctctaccagtgtttgttataaccaaattttgcattaagaaagataaaatagttctcagattaggatatatatgcataaatatgcacatatatatatatgtttttatgtacatataatggtcagttattataaaaatctgatcataagccatgagtgaaaataatgagaataatgagatctggcattgatttggggaaatcttgggcaaatgataaaaagaaactggtcagttcttcacattcttcatagggaatgaatagtgatggttttttctgttattcactaacccctgtttatctgagagataaattaatcagagtaagggatggcaggacacgaagagtgctctactgttcctttactgattgctagctttgccattaaccacctaatccaaggtacagggagctaggagagggttttactacagcagaagagcagatctagccagaaacagaccatgaaacaaacaagcaaacagaaaagcaaacactccctatggcaagatgaaaaactgaaacatagacaaccccctttactgtctcactccatcagtgtcttattctcaagaattgattagtcagatctctctgggaaagtagctgtagtcaggagtagaggggtagtttaaatcttgtagcccaggaaacctgccttgcctttcctgatgcttgggtcagtcttgaacaggcaaagagcactttgtggagtgaatgatggcaactggaatgaaggagactcatcatctctagccagtgtaattcagctttgcattttcagttttctctgatcctctttttatttgtaagcactggcataataacaccactggagagataagatgagaactattatagaggttatcattgtgaagtattttcaaggatattagaatgtaagattttctacctgtaatcaagtataactgttaacttatcaccagtgctgaactatacacaaaataaagagatggataaatattatgattcgccagcagttgtgtgcatggaaagtatctcttggcattaggctgtctaatgtaagatactgaattttttcctagaaatctcctgctaggcagctgcttctaatttctaattcattatgttaagctgcttcaaatgcctctgtggggttgagggagaatttattttccccttccatcatttcatgtcttttgtagtaagctcagggcttccagaaaaaaaaaaaaaaaaaactgtcatcaacaataaacagtaaagaggtatgaactccagcatattacttagtattattatgcattgaactttctgctgtgtcttgtgtgaagaggacagaggacaaaatacagacagtgatgcatatgcacaacacactaaatgaattgctgagaaaatgatgaaaatctatgagatctgttttgattgcatccttgggatctgggtaattctgtagtcattaaggccagcagatcccatattcaggttctggagatttttataaagtatagatcattttcactataacaaagttctctggccaattcaccatactgcagtgttgaaagcttccaaagggctattatttgtaaatcattcttgattaatgggcactatgagttgcctagtgtgcagaattaactcttgtctaaggagtatcctctgatcggatgagcattctcttctctgccacttccatttctttcattgttatacattgagaaggtatttcacattatacaccaggaattcaaggacagatcaacattgtgtagccttgaagaccatgtaatagtggtagatttttaaagcccaaacgtgacaatatccctctattcatattggaaattataaagcaaaaagctttataattttgttaaaaaccctctttttattaagtagtcataaataacaaaattgtttctagttatttctagctaaggtaattcaggtgattagattaagaatgagtggagcgttgtttgatcactaagtagagaaaacttcagaaggcgtatatttaattccattaataagtctttcttttttcctttcttcatatggaaaagcaaaatgaagtaatctggagacataacagtaaagaaggccttagcatattgctgttctgataaattgcaataaattttaaaaagctcttactttgagtttgcttgggaaaaaaatctcatacttgagagttttataagtagaaagagttgggaggaattttagttgggtttcattcttctaaactctatactggtatgttttttcattttgatacttttcagagcagtataaatggtgtcaaagtgggaactcgaaataaagtgaactattgatattcttcaactcattaacacacctctatgtcattttaaggagttttatatgttgctttcttcattaatatccatccattttaaaaaatttattaaatctgaaggacaacttccccaggactggagcattaccaatatgcttatatttcatactgagggaataatttagttgtgggaccataatccatcctcctaaaaacaaattaatagagataggaatttatctctcatgattttgttaaccagaaaatagaatattatgcccaatgaagatttataggaaatgatacgtttggtgactagaaatgatacgtttggtgactagtagttcatttttacaagtatgcaatgaatccaagtctcttaactgaaatttaatttcagctaatttaattatcagacctggtttttaaatttagttttctgagtcacctcactgagtttttttggccatatttaattcttttcattctcattattttacttcgtagctttaaacattaatgcagtaggtatccgtaatttattctggtcatcacctgatttgagtgtttctttctgtcatcctcaattatatacccaagaagaccataatacttcttatcattgaaccaagatttcttcttcctcactatgaaggaatagagacttgattgttcaagttatcaaagattttcagctagacagtggaagagataaccataatgaaatgttacttgctaacgtcagtactgaggttttgttgtctattttttcctccccttcaattgctcaaggaagcctgttatgatgcctggtccattcagaccaggtaaggcaaacaaggaaaacgtatgagaataataatgtttcctccacccaacccactaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcaggtaggcctttttccaagtattaattgcgtctgtatttttatctttgcaacattgttatcatggtcattgctttatgtagctaaagagtttgaattactatgtaagaaggatgctggcagatactcatagtaatgagacccaggagaagagaaaggtgaagtcattgctaaagaagtcataaaagtctgtggcactcctgggttgttattcttattgtatttatcactgaaatggtaaagctgttattcaaaacgagcaatggactacactttcagtatgaaatactctctcctttaattttattaccttttcaaataacagaaagggcaagggagggaaggaaaatctgttatcatatgaaaagctatatcctagttcaatttcattcacattctccagatggctttgctataacatgaatctttcattattgaggtcaatgggtaccattaaatcaagggcagttaaagttagaagtgcaactactccttgtaaaatgcagtctttatgtttgttatcaaatcctgattaatcatgtgtcaggtttgtgcccattttgttttctttatatttgatcaagatactaattacagtagaaaatttgaaggtttgagtttggctataccggaagtccttgtttttgtggcagtttttttccacttgaaagtaattatatccaaactaagcttaatactttgctgactcccttggcatttcataaatctagttagtagggggtaggaggttaactgaattattagccttaaatgctctggcataccatgagacattccaattgctgctgcgacaacaattacttacccctatcctagttagtgtttatagaaaaatcagtagattagcacttgtcctgtttgcttctttgttttaagacattatccaggagctcagttgtgtctttaacatcacctttacactgactccaatggacgtggttaacttaaagtcaataatcaattataccacctatgtgttcccatttttcagaattaaatgtatgtgagctaggtaatggtaagtgtattatctgttgccttcctttttccttttccttgagcagaagtatccagacagctctttgcatggctccacagtaacaatttggagttatatatgctgacagtgtcataagggcaattttatcgttttcaaaaggcttctaaaaacctggttagcatagtactgttaccgtcacacatgctattacctgcatacctacacacatgctcacgagaaaaaaaatagctcttctctactgatattaaaccaataactcctgacaccttgctctactcactgaaaagaagataaaaggcaatatatatttctattatgactctctctagctcaagagcagatctgtttattgttggtgaaaggatagttctgtctgcacaggtcttggcagacttgttttgtttctgtcagaatgtattctgctaactctgtgggaagcagagaagcaaatggctttttcttcataggaatggctggtcctgtagttctttttaaggccaaattttcactgaccttgagatgatttaatgttacacggggattcgggaaccaagctgtagtaattattggttttttggctttccctcctgtagcacatacataaatgggaataaactgggtgagttcctgaactctttccgcaaattaagaaagtcagaactttggaagaaaagtagggtacaagatacaaaatcttgctagtgattataactctaaacgttatagaacctatggccattttagaggagatgaacaactgggaatgccttctccaatagcctctctctggcatgtgtttctttaagtccagtaattatcgaactacatctacatgcttttccttttacttccaccaagtctacaaaaatgagttataaacctgttgagactctttggttttaagggtaagtacatcctcttggaggaaagccaatagcctacaagaattgattagactgcgatgagggattttaaaagccctggattttttggaagactaactagaggaaataactttctgccaagggttttggaaatcttttttgttcttgaccactagtcatcagaactctgccctgtgctccattaaaaacttaaaagcctcatcttcaagcctagtctggtcttaaacacattctgttgatcacatcaaacctatgttaggactggggacccaacaactattggattctattcaaagtttaggacaattcccagactctagagactgcaggtaaggaaggtcagtcccagaagcattaatatgcctatgtgaccccactacttttcttagatgaggaggattcataaagttctgatctctgggagatacttcagaagtgagtggggaaaaaaaggtagggaagactggatttcatattcaccgggcccattattcacttttttatctatatgtgaaatcatacatagaacattttccaaatgataccactgttctgtcctcttttgctaaatttaataacattgtcaaagcaaagttttcctaaaatgagactcctctaggagaaagaaaataagcatgtcagtccaccagtataaaaacctgtctgttcaaaaatcctctagttctttcttaaagcataagcaaagaaaacatcctttcaagagttctttcctggtcaacctgaggtagtgttgatttcagatcaaaggaaaactgtaaggtgctttcagtgctgcttttaaccgtgtgtgaatgtgaacaagtagtttttgagttggtatgtctgtctagtgttatagcctcttagaagtaattggtgctttgatctttctgattccattttgttacaggtaagagtgtagaactatctgtgaataacctggctgatgttaatttactcatagcaatcatgcccaagcatcaggtcttgatcctacattgagaaggatagctctaggtactctattgaattttaaaaaatttaagatgtgcattgagaaagcaggtgtgtgagtgataattctcaagtaaaggcctggcacttcataggtgctcagtaaatatttactgaatacatctgaaaacaagacaggctttattacctactttagagtcatttcacaatggaaggtagcatagcttgaggaaagtgtttcctccacagtgatcagggtgctttggccaaatttgttgtatttttcagtagtaaggctatagcatagtgattcagtgcatgcacttggagctagattagctgggtttaaaactttgttcatcctcatattagcttacatgaccccagacaagtcatgtaagttctagttaactatttatatgaaacaaattttcccataacttggtggtttaaaacaattatgtcattagatttcaaaattctgtgagacagaaatttgggcacagttcagcaaggcaattcttctgtgccatctagagagatgattgtgttcactcagtggctgactttgcctggagggtctggctttatttacataccttgtgctttgctgggttaactgggaagatgggactcagcagggcccttttccctctctatgtattctctgggattctccttgtggtttctccagcaaagcagatgggctgtgtttatagaggctcagggcttccagagagagtacttccaggggcaggaagtagagggtgccagttttatatagcctgggctgggtaactggcagtgtcacttgtacaatatgctattagtctaaacagtcacagagctttcccagtttcagaggaggagacataaatatcacttctcaataggaggaggagtagcaataatttgcaaccaacctaagtctaccacattactaaggctaccatattataaagtagggagggtggtgtacttctagtggctatgttatatgattgtcataaggataactgagttgatataagtaaaatgcttaaaataagtgtaccattcaaagtaagactgcatgcgttttaaccattattattatattctgtttcccacaattggtgtattaaatcaagatcctctcaggcaaatatctgcctcagaaaatggggctgtgactaccgacagtagtggctatagtttagagtaagggctaggaagtttgggggaaatagagatttgaaggtggatccaagcagaatttaggggctgaaattagtcctggcaaatcaaaatttctatgatctcaggaacagacttctctgacacctcactacccatctttaaagttctgttttattttaaaccaacttagagttctatgagtctttgaaaatatgttctgtctatccacatgtcttttagggttgcaaagaagacaaatccagattccttaccatcgtggaatttacaatctaaatagggcaagagggtttgacatgagctatccatatgaagtagtgactcatgaatggctctttgtgctggggatggcaagtgttgcatggtgtggcttgactggatctcatgcactcattctactaggccttgttgtaaaaagagcacaattggacaggtggtgagaggaacatattcctggttggtcaaatgtcagccagaagctaagttgttaaaagcagagattataatctctgggagagatagccaagtccaagtagaacagagaatgcataagagggagtttgtgagtagcaaggggtccagaatcaaaatcttggcctgaaactttgccaagtgggagagggcccagaggggtaaactgaattgggttccctgtgtaccttactaccaggaatgccccaataattgcacaaacacttcctctacaactgactccaatattggtgggtaattattatggtgctgataggtcagcttctaaaatagaaaagttcaactcagtctacactcaaattcgttggtcttccttcaggatagaaggaaaaagtgagaaacaagtcttttaccttatgtctccatcctgagttatcagcagaaaaaaaaaaaagctcagtgtgttctgtgcaaatcaccatttggaatcatttataaactatttgcaggatactgatcatgacatactttttctgtgttgggcattggtaaagtcaccttgacattggcaactgctgcctgaaaattgccagaaaatcacaatgctcagcatggattggaactatccttataactagtcaaaatgaaagacttaagaggtttgtgagatttcattctcaagcttcacaaacttggtggttgaatgtgaaccacttttgcaaattccagaaggaagccacaatttctcatgttttgtaaaaattcttataggcaaagtactcttagcttttcagtgtcagactggagacagtaagaagcatgcttcagccttgatactgatgattacaaaacaaagaaaaaactttggattaaaatgttcatcctgcgcaacgtctgttctgggtagagtctcagtgtgttgaagagcgtgggcttttgcgtcagagtttctgagttggactccaggtttttccagttgcttagctgtatgtataagtctgttctcacactgctataaaaaactacccgagactaagtaatttataaagaaaagaggtttaattgactcacagttccgtatgcctggagaggcctcaggaaacttacaatcatgatggccggagagagaaaggagagtggggaaactgcccccctgatcccccctcccaccaggtccctccctctacatgtgcggattataatttgagatgagatttgcctagggacacagagccaaaccatattgctgtatatctctgggcaggtgattagcctctctaagcctcagttttactgtctgtaaaagtggccttacagtacctttcccgtaggctccttgtaaatagtaaagtgcaatcatgtgtgaaaagcaccccataacttttcagtaaaaattttcacataaggaaaccacttcaacctaagggactctcccagaactcacagatctccctagagcttagccttcctgtggggctggataagcccaggaacaattttgtttatactcatacaaactcacaagggcctggattgtgagttcttctaagggccccagattgaatcagagccccaagctcatcaatcaggagagattgctacggcaggctctttcatattctggagtgggaattggctttgctgaacagttacaacacatagactattctattaggttgaagtgtatgaaaccactatttttgtagatcaaaatggttaaatattagcaatatcacatggttctacgatgacacacagatttacagcatgttgttatcaatggcacttcgaggcccagactagaacctcagatattctccaggtcttcaaataatcaaactgccttgcactgggagacaagatagatccaccttatccccaaatactgtgctatagcaggatgtagatcacactgtatcaaaactggttatatttacccaaagaattatcccctctgggtccttccaccttttccctgctgccaccagcttgagagaaatgagataaggaatctacacagttttcatctccttgcttttaccactagacaacagagcctccgggggaagtttatttttaggatcagggctcaactaatattgattaacagccttacataatgtgaggctccagggtttgttcttttcctgccaagcctcataactggagaaggcgctgaagatttgtcagtctaatcagactttagctgccagccaagaaatatcttctgtcttctccttacccttacgcaggtactttctttttccctcttagagaataatttggggggagagaaattgcactctaatttacttgttgcctggtaagattctctggtgacatttactctctggaactgcacagttctaacaacaacagaaaagggagcttgatgggtttaccttcctcttaaagacttagatgttggcagtacaaataggcaagtgaaaagagtgcagtgtagtttgttttcatccttcctttaatacgtaattttggtggatggaacaggtgctttccaaaactaggtctagtcgatgaaagggtcctgagggcagacgaagtgtgaaagctcccaggagaattcatagagatgcccttccaattaggatgtaatatttacaggatggaatttccaccagaactactaataaagtgctggctcttatttctaggcatctgaacagctgggagggaagtggggtcagttcttggctacccacgggtggaggtccctgagtgtttttaaacctcagggtggtttttctaattacctaacagactctttagccgaatctaaagccaaaatccttgctgcgtggcatatggttctcctccttcctattgctctgaccatattttccaccacgttgctccaatcacacaggtcttcttgatccttcttgaacacagagcaagaagaagggtgaaaccggtgaggcaggattatgcaattgcaagcttagattttcatcttaaaattgatatttgactttttgcttttgcagatttttttcctgcattaatattgattttaaaatatttcagcaaatgaaaacaaagttttagcaaacccccgttaaatcttacaccttaagcgagtgtctcattcaatcttctcagccctgcctgaatgtgccaagcgtgcctgtgccttttcacctgccatttcctctgcctgcagcagcccttccctgctattcacagtactcactccctcacttcacccaggtttccgcttatattgcaccttccagaaaggaccttcttgaccgtctgtaaaatacaacactctatcgccttttcctgttttgttacctctcatagcacttatcactgcctgacattatagctcacatttatttgtttattgtccctatttagtagattgtgagttctaggatggcaagatctttattttaggcactaaaatagcacagtgcctagaacagtagcgagcacagagtaatacgcagtcaatgttggttgaaaggtataaatagtcaaccatccaccagtaccttctcagggagtccacaggccacacaatatttacaggctgaatccaagcccctgtttcccaggacccactccctcatgaggctcaccagtgagggtgggcaccactgggtttgctgctcttggatctttgctctaggaataaggagtcccagagatatctccttgtctctggtatgtaagattatttttgttagcttccagtcttgttgctcagccaaaagcaagggctaattctagcacgtatagttttcaaatcacttttggaaatgtaatatcacccacctttccctttccagtttcttcttcttcctttccaaataacttaatccttaattctcctaaaacccactttcaaatatatgcaaataaaaattacttggtaaggatggaaaattaacttgaggcttttttacttttttttttttttttttttggtctgttgagaaaagggcttgtagggtggtgcctgcataaactggccataaaaatatgggacaataagttgttgaaagccacaagaggcctctgaggaggaaagcctcctaaatgccatcatgttcccaggctcagagcgagatctgctctcttatctgtaaacactgtgttcaaaggagaaagactctgctttgaagcattgaaatgtggccagatatgctggctcctagtgaggcccactccccccagctgctctccgataaattaaagaataaatcagtagttaattttatgctgcttcagcacaaagaaaatttacctaaactgccattgctatagattaggtgtatgacacaccgcccccctttcaccgtttcacccctgaacatctgcttcttagagctaagtgattgtactcaacaaatagtgtggagaccagagcttggcgcctttgcagcctccattttacacttggccccctggcactccactctttatgcactcttaacctgtctattctcattcgtttgtcgccaccggacttcgggtaccctacgggtggtgctgaggctggtccccaacattggtctaatggctgagtatattgtgtgagcaccatttattcatgtctgaaaccctataatttgactagccccatatttacccatttttagtgataatttgaaaaaacattgatgattgagagaaggaacaatagctatgttgctcatcattggacatttagagcctagaatggtgcctgccacaaagcagggctcaaaaatatcagttgaagaaaaataaatgtgttaaacgaatgaaagtaagttaagcaaatgcttatcatcagagtgaagaggcagtgggggccaatataatttatttacaaagtaggcaaagggagttaggaggaagcagcctggtacggaggaaagtgcattgaagcaggcatcaggagacttagctcatgactggagaagttcttaaaaccatgactctaggcagaccttcatttctagctgtagaattttggccagggtcctttgtggagctatgtttttttattatctgaaatatggggatgatttccaacttcaagggtaggttaagataatataagtcaagggcttaaatgggtgcggctcaaagattattattgctgctgtcttaaatgggattataatctggtctcagctgataaaccagtattgcaactatattttcttttttattctgttgctagtttgtggtctctgatatggcaattagcttccttgggcctatgctctttcctcagaaaagaaagttttattttaacattatctagcatagtgtcttgggcacacacacacagggacagttaaatgtaggaaacaatgaattagaagaagtaaaagaaaggagaagaagtaaaagaaaggaaaaattgagaaggagagaaagacagcagcgatgctctgtaattattgctataagaattacgtgcccatttcatggatttgtatggcttaggttgagagagatgaataaaatatctttgatataattaaaatcataatataaataatattttttctatatctcccctctttgctgaaagctgttgggtgagacatcacaatgaccacttctatgtaaaaggtagattatagatggccctctgcatatgtgggattgcatctgcattcaaccaactaactgtgaatcaaaaatatttttaaaaaattgtgtctgtactgaacatgtacagacttttttcttactattattccctaaacaatacagtataacaactatttacctagcacttacattgtactagacattgtaagtaacctagagatgatttaaaatgcacaggaagatgtgtataggttacatgcaaatactatgccattttatattgaggacttgaggattttgccatccatgggaggtcctggaaccaatcaatcccccacagatgctgaggaatgactgtacttgataaatgtctcttgaatcatccaaaaaaaagaaaaagccaatggtttcaatttaaactgaggtaagaattgttttttttttttctgaaaatatatgatgttctatttatatataataggaaaacgacttcaagcagcaatcgtcacttgccaggcatcaaggcggatatttccattatgtctatgacaaggtggtgggaggggtgggatgtggtttcatacctttctggtgcatgtttgaatgattgtaaaaattagaaacacactgaggctgttatgacagccttgccttttgaaaccttctaattaatgccttgggttgtctagagagcttgttctgttagctaaatggtgatttgtaaggttctccttgatttcctcatcattcatggatgaaataattggggaaataaaatgattggggaaataaatgcacaccacgtctgtggtggctagcagtcactgagagaattacttgatgggaatttgattgacttgtgtgtataatgcaacctcttatatctctggccccatcttattatgtgtgtgtgtgtgtgagagagagagagagagacagggagagagggaggatgctcgtgtttgcttgcactatggagaacagtgcttcttaaactttaatgtgtgtatacagatcacctgggtaatcttattaagcacagattttaatgcacgtccggggtggtatctcagatcgtgcacttctaacaagctcccagatgatctcatgctgcagatatgtgtacctcactatagagtatagagcaaggctctaggaaatatttacggttccttgctgagtaatcatggtatctgtttacctatctcttccaaatggtcttcccaaacttagctcagttctcttcaagacaggaaattttgttaacccaaagtattaatgtaagtgaaagggtggataccccaactaaggattagaagagaaaactgtatcccatcagacaatgctgctccgggtttcagatgccccttcttcctgtcccttactttactgcatacccccaaggcagatggaaaaaaacataggtaaaatttaacttgtcataatatttatccccctttctgagaggtgacctccaatggaagcagaaggatgtgaatgattttaatccacggtaacaatggggagccagtcctgaccatcttaagcagtataaatgtataaaatgacagatttttctgctctgcctctccactttctcctcccggatactgagagagacacatattcatgcacccacaactcacactataatgcacaatgaaatttcacccagcctttatctcggggctgctgttctcatgattaatgccctactggctgggaagctattccactgaagacagacaaggagagaggaagatgcatgaaatatatctctgaggccatttctcattattattattatcattattagttccttactaccctatctatctatcctgttagaggatgcttgatctattggcaagggggaggggatgacatttgaaagcaggttttatgagggagaaatgaacaaggacaaagagagaaatagacagtttttatgaaagagaattaacctggatggggtttttgttatgattgttgtcctttatttgggggtttgtttgttttattgttgctgttgttttccatttaaagtcaaaaataatagatgcctccatctgcggcttctgatttttttccctagggatttatttttgcatgtgttcttttgtctttattgagtctctgtctgctagaatcaatatgatataacttatgcaaattatatccctgaccacttatgcaaaaaacagaataatttcgttgctctgtaacactcttaatataattacctccatatcctggttgatttcaagcttttgaaagggctactttaaaaaaaaataataaaaatctatttatgtgttgtataaaccacagtgtctgattctctcctgtttctcattcaaagaaagggtgactgctaaatgatttctggctctgtcatttaagaagactgcacagcagtggtcttagttgggaagttgggaccacaataagagtgctattgtaacacgtgtctactgataaaatggcaaattcattagcctagacaaggagtactatgatctggtttcaaaaatgctgtatacttccacagtccagtttatgagggcatgagatatataactgaggtgcccccatgttacttcaattttagtttgactttgaatttcattaaaaaatatttgagttatttgagtgcctagtatgggctaagtactgtcctgggcacttgaacaacatcagtaaacagacaaaaaccctcttttcttatggagaacattttctattccacaaacattgggtgtctcataagtgcaagactttggagaaataaagaatgaaatagaaatttttctgctttagaggaacacacagtctggtactgttcttaaatattttcagactacaagcggactcacttgcagcccagttttttacaaaaactttagcatgctgattggctagtacagttgcaaaggcagcagccatctatatttacagaggtctattccaagaatagggtctttaatttctattcaaaaaagaccaaatttcaaatgtaaacaatatatgttttgactaaaaaagacagaaaccgtaaagcaagttacaataaagtgattgaaacatatttcggtcctggagactaaatttgcaatgtttatggcaaatatcttcttgtgttggtttgagattatagttttatggaatgtttatattggaagaatctcagagattgagccccacacaaccagatgagcttcagagatgggccattctggtttcaagtactagtttcattgctcaaagctctacgtccaggggcaaattgctcaaccactttataaaaaatgtaaacaacaggtaatttcacattttaatttatttttatctaaacaatatattcacatagtttatttttagtgtatatatgtatatatatttatttcttatttatttcttatttatatatttatttatagagatgaggtcttactttatttcccaggttggtctcaaactcctgggctcaagtgatcctcctgcgttggagtgctgggattagaggtgtgagccactgtggttggcctaagtaatacagccacacaatttaaaaccttgaactgtgcctagatatcccctttggggaaaaggcatcaccttagttgctagagtgctggctgatggctgttggctaaatccttcacgaagaactgcctttgactattgaagccaccttgcccaaccaaggtcaagccccttcctgaagggtggcccatatccaattaatgatggtgaagggtggcccatatccaattaatgatggatgatggagctggggggatctatcaagactcagcccattgtctcaagactggataactgggaagggccttttagctagagagtttcctaaggccagctgaggtctctattgcatgaatgttcacctcccccttctgcccagactctgatgtcactctccccaaacttcccaaacacgataccgggcctcagactttgttttctgaaaacgcagctgaagatagatagatagcatcgtgagacttaaaataagaaaacaacaataacaaaagaaaaacagtagtatctttctaaccttgccctaaagtcctgctctatactggtaacccttttatatccttttcagacatttcccttcatagttctagcaatatgcttgcatttctatttcttgactttttcagtttgacatattaactaatgacttctgcttctggaagtaaaagttgagctttctcatgctctccctgccctacaacccacacacacttttttaccttccagtttcccagtaaaattctatcgcatttcgattaaataaatgttcagagtttgttattatgactttgtaatatcgcctattgaaaacaatgtaagatcatacatgaactgacttgttccacaactattcaccagctgcatagaatgtgccagacactgttctagagactgaggatacagcagtgaaaaacaacagactatatttctacctctgacaaaacattatactgttatgacaatttctgttttcctgtaactctttgtttgttaatgaataccctcgttatctcgttagcttatttttctagccacccatcagtgccacagccaacagctacaaaagacctcacaagataaaccgacaggactccattatttctttttctgtcttggaggtctcccttctggagtcgtctgacctcctgctttagtctgggctgggcgctcgctgagcctgcctcacagctatcatcctgcgtcttccttgctcgtcatgctggaaaatccctgggccctgctcctgtattaaatcctagtttcagctctatttatttcctcattttcaaggtgcacattgtcctgtagcctcctgagaaaggatagctaaaaagtaaaatcattgagacattgctcatctgaagaatgttttattccattctcacccttgacgataatttgcctgggaaggacttgtatcttggaaattatcttcactaataaatttaaaagcatccgtccaatgtttttgggcatccaatgttgcagctgttgacatcacagtttggtgtctaattccttgactgcactgatttttacttttttttttttttttttttttttttaccctctctctgaaatatccttatcagtggacctcaaagtagcacttacaactcaggtctcttgaaccacatgctgctgccccctatagttcttgcttttgtaaagttgtggttatttgccgattagctgccctgtgttggcatcctgactttggtatgatttgatgagctaagctattactaaactataacacacacacatacacacaaaaaatgaatagctataattaattagcataaagttttgagggtaaccaactttagtagagatctgagatatatataatgtatatatatatatatatatttgaacattttgccttgggttagagagggaattggtggtacagtaattcttactggaattgtgtagtgatagctagtttatatatacatatatatatacatacatatacatatacatatgtatgtatatataaactagctatcactacacaattccactaagaattactgtaccaccaattccctctctaacccaaggcaaaatgttcaactcttttttgtattcccttaagagcccttattttttttttcagtttcaccaatcatgttcatttcttagccacctcagaaagaatgagaattaaataatatgtataaaccctttgaattttttacatccagaaatgagcataagctcattcctctgcttcacaccagatgcttatatttttgagaggagcaaggattagaattgtcactctggaatttttatgctacaaaatgtcaatcaatatgtttgcatgtcactgggttccatcctacagtgtttggtgataaagtcttttcatttggctcccagctttatcaccataatatatttatttactttaccttacatgtgctagttggtagaagctgtagaaaaagaattactcccacatatttctttcccctaaagagaaacaatatattgtaagaacacagatggggctccacacaaaaagaatgccgaattaatgttggatggatgtacatatacaagaacttgctatcagtacacaattccaataggaattatatatacacacactgaaaatagaatttgattaaataattacactaggtacaagctacattttacttccattgaaggagagctaagtggaaactagtgtgagacaatcatgaatagaaaagtgcagaaggaatttgatgaggatgttcccagggctatttctagccagaaaacgaagctggaggctttgaagtaaatcaaaatatttgaagaagtaagaggataaatagcaaaactcacttccaacatcatactaaaagcaccatgcaaccatatagaaaacatgcataatttattttgactcaaataactatagggagattcttgttttttttaattaggagatttgaggtaactgtctagactacctatttttatgttgcattcagcaatatgtctgctaataattagagggaaataaattacataaaacaatgccagtcatgtcattgataaaaaggaaattaaagtgtgattgtgtttctctttctctctctccctcattttcagtgagctacatcctcttgttgtcctcctcacctgattaggcatttttgtaagggagtttgcctccgtcctctgttgtaaacattttccttacctcagcatcctttttaaattcaaaagacactttcctttgcaatgcactatgaaaggcgattgtgttagagaatatcagagatggctttgtcatgtctggtgctcttaaatccttttcttttttttcttttcttttcttgagacggtgtctcactccgtcacccaggctggagggcagtggcgtgatcggggctcactgcaacctctgcctcccaggttcacgccattctcctgcctcagcctcctgagtagctgggactacaggtgcccaccaccgcacctggccaattttttgtatttttagtagagatggggtttcaccgtgttagccaggatggtctcgatctcctgacctcgtgatccacccacctcagcctcccaaagagctgggattacaggcgtgagccactgtgcccagcctcttaaatcctgttgtgtcctaaagagtccactaaacgaggttgagggtatgatttgacaattgaacaaggcctcagccagctctcctagactgccccaaaactccctgagcagagagacccaggtggtgatggaagtatttttcctctaaaagactgtggagattctggcaaacctatattttgggtttagctttcaaggaagaggtggcatttgaaaagccaggggcctttgtagccattttattcactacctaatgtgaaggtggtggcagggaatggaaaagggaagattatttagtcgataaacacttaatggccactgcctgctgtgtggacagatctggatagagttaaaaagataataaagcaagtgtaggatgcctgtcttcatggtacttatatcatgggaagaaggcatgaacaaaccaattttacacataattattcaatcacaatcatgacacagtgtgataaaggaggacaggcttctaagacagcagaaaaggacctgaggtagtgttgtcatctggggaagctttcttgtagaagcagtatagaagctgtcctgtgcaggatgagatattagattgcaaaagaggacaagggccagtgttcccgccaaaggaaatagcctatgctgaggccctgctgtagggatcatactgtatcgcgttcctctggctttggactacgcattgatgctaaagtctggaagcataccatattcgaccaagtaaagtgaccagttaaggtccccacttaatgggctaaagataggtcattccaagagtgagcctcccattattatgactcatgacaaaggggtgtgggactggttggaaaagagtttccaaagctggactgcatcacatggtcatgtggaatgggctgcctgctctcccagtctgaaccctacctctgtgctatgccaaaggtgcagatccccttagtgaaaattggagacatgaatcatttaaggcaatgcctcacagacccatgtgcaaggttccatggaatgtgttaatatatcacactcatctcaattttgcacggtacatgaaactatgcttgctgatgagggaccatacacattgaacagatcatataatggttatggatgtaatgtcaataatgtcatggaacctatcatatgttgtaatatcaagaaaccttttagcatgtacatttgtctaggtttctggactttacagccttctggtatttcacttgcttgtgtctttcattgaacactaataaccagaaatcagcaacgtgaaaatttgattcttcttcctatttttctcatgccttactttggtctttctttctgcttggtggaaactgcggagttcagtggaagttttcctgcagtctaattagcccctctgtttaattttgtaataaaaacgctgaaccagaagctggagataatgtgcccaattcaattcacagatgtcaatttctttttaattgtaatccttttcttgagttcttcccactcttacttccctggcacagctgaggcttgggtgattacaaaactttcatgcctacgctggagattatgcctcctgctttaggattaaattcattcgttatcattgttgtaattattagtagtaacaatgggcatttccacccaaacctgatgaatagtagttttcacagtctttgcctccaaacttagcttatttcagttctttgcccagataagttcttcactctttaatggcagggagcattccgttttctgttgcatttaaatgctattttgagatcattcagaagacaaggctctttttcctttttagcaggttctcctgggtgtggagagatggcttctttccccagagtaggagtcaccacttagtgaatgctaatggggtcttttcttcgtgatgcgactgctgctttgaagatgcatttgaactggcaaggggcacctcttagctgcaatctcttccttagaagggtgccagctccaggccctaaaaagcacacatagctttgacttccatgctgactccaaaagaaccttttctctgcctttttgatggagtagtccctaccactaacagaacagcagtgtggcccaaccaacttgaaaatggaactggctcctcagcaacatgctaattctttcaaacttccttgtcagactcaaacctcgatgtgtcttttgttcttaaactgcatttgtagtaagatcttcaggaaaagcaatcagtgagagactgggtcaggcttttatttaattactttgcactttttttccccctctgaaccttctccaaatcaaaagaaagcaatgcagtttaattctgaatatatgaaatgtttgcactttaaattataaatgtctctcaacgataacaccttctgaaaataatgctccgtgggctctttagaagaatatttaggacagttcatctcaggtttaaggtgcccaagctactatagtgccctttcttatcttggttttatgtttttccactatggcttactgatataatttcctaatccttcttatctcaaatgtctcttagaccgttaaacctttgcctataaaatgaaggggtttgactttgaatctaaaggagtggaccatccctcaagcaccctagtctctcagcgcattcattccacaaacatttttttgggagagcagggtgattcctgctatggacccatcacccttgtagactctgaggctgcaatgaaaatacaataaaatcagtaattctagttcttatggaacatacattctgggagtgggggcagagactaccgataaataaattagcaagagaatataatatgcagggacaagtgctatcaagaaaataaacctgcgcaatgtcacacagaatgcctgatgggtgggtaggtagtttaggggaagttactctaaggaagaaacatttaacctgagattggaatgataaaacatgtcaggtctgtgaagtctgggggaagaacatttacagcagagggaacggttagtgtaaaggcctttaggctggaacatgttgagcagtgtttgaaagatgatgaatatggctgtagcagaagaaatctggtgtgaggtaagatctgagaagtggcagggactgaaacagacagggcctgtttggctgtggaaagcagtttaggttttataaaagtgcaatggcaaactattagaacgtactaagtaaaggagtgacatgatgtgacttatgttttttaaagattactctgccatgttgagaaaatattgtaaagcagcaagagaggaggcagagagacctaatacatggctattgctttaattctgatgaagtttgattgtggtttgaactagtatagcagccaggcccccactacaggcccacccagcttgatggcctcaccctgcatcttgtcctgtctctgaactgctaaatctcaaaactttaaagccctaatatcttgctgattaaccataatttccaaatcttatgcttaagtccaggcagtttttaatttttttttattttttggcttcagcaaatttttcatttgtctatatctataaagtacttctcatcatcaacccagattcctttttctctctgttgtgttcattctagatcattccaaatggtctctgttccttctgccttcaacctggtcttagaagacttctctgttttttatctctcccccattccacctccaactcttgatcagcacctatttcaaactctcaacttggtctcctttttcactttttacacacttggattttaaatgttaccttcttttagaaaacaatgctgaccagtcatgagtttctttgaattcctccatgcttatccacatcagtccttactttaggggaatcccttcgtccctttgtttgaaatcttatgctaattatctcttcactcgggtctcttcccaaggtttggacatcatttagtgttctcattttccactggtgccattaatatcatcccgtcatcatagacatatatgtgtgtgtgtgtgtgtgtgtgtgtacatatatatgtatgtatgtgtatatgtatgtgtatgtatacacgcgtgtgtatatatatgtatatatacacatatatgtgtattgtgtgtatgtgtatatatatgtgtgtgtatatatatgtgtgtatatatatatatatatacctttcccatttcaaaaacaaaatcaaaacaaaaaaggcaattatctatgaacctgatttctgtcccttctattagcacttactgtccccagatgaggacactctttcacttccccatatgctcaaatatcctgaattttatactctcactgattttactttctaaacaaggaatatatacgtattgtagaaaaaaatcactgtgaagtaaattccacccgtgatccaaccctccagagaaaatcgtgcataaaaggtcccgcagattcccacctgtctttctttccttccttatctaccaatattttttcacatgcatgcaacattctagtcataccttgttatactttcagacatgttctttctacttgagcacatacaacatacaacttgagcatgcttgtttatctataaaatgaagataatatgatcatttctgtaggagttttgagtcaaaaataaatttatgtatttcaaatgcttagaatagtgtctgttgcatagtgacctttcaataaaaattattattattattgctcttttgtccactttatctacctggaaaagtaataatccctcaagactaagttgaaatataacatccctggggagtgtattagtctgttctcacactgctaataaagacatacctgagactgggtaatttataaaggaaagaggtttaatagactcagagttccacatggctagggaggcctcacaatcatggtggaaggcaaaggggaagaaagacacgttttacatgtcagcaggcaagagtgtgtgtgcaggcgagctcccatttataaaaccatcagatctcttgagacttattcactactgtaagaacaatatgggggaaactgtccccatgattcagttatctcctccttaataatccccttgatgcatggggattattacaattccaggtgagatttgggcggggacacaaccaaaccatatcagggagttatccttctcctctgccatcctgtttcactctgccaggctccttttctcagtgcctccacaagtggtttacttgttgtgatgaacactatgcacagcagagagtttaaggaccttagtcatgtttcctaccaatcagcggttggcttcctattaaacctttctcgatgttctggacctctagagagccattctgtgctgctatgcaatctataatgactcttcaactaggtttctattcatttccaagtcttccctaccactgagatacttcaaggagatatgagtggatcatgaataaatatcctaaaactaaagacagttaagtcaattgcactctcaatattatcagactattttaactaatatgctatagacaaataattcttcagaatggtgtttgctttgtgtgtgtcataagagattcttgtctttagagaattagggaataatattaaaatgaataaatagtaaaggtgggaatatttttaatattattaaaataaataaatgattaaagtagggagcatgtttgaaggtccattttaaaaaatatatgtagacagaggaaacctaagagttaaaatactgagtgagttttgctctgcatcagtggaggctataaaatgcagtatttatctgtatatgagttctataccaatgtgatctatctctctaattagatagtcaactatttttaaagagctgcaaataagccttacaagaatgtcataaatgcattccatttagaaacatcttgcagataaattgtatttttattcttcctgcagcctcctgtagccttaaaagaataacaaaaaataaattcttactacctaattccagacacagatcattactaccagtagtatgttaatcatgcttgccattccttctccttcgatatcattatgctttaggatagaaaaggtgggtggtatgtgagcctccttggataaacaaaacgttggagtgcacaggcttctcaagaggtacaatgttattttcatgcaaaaaaatcccaagtattacaaaggggcttgaaaatgttgaaaacacattgtgaataagtagaattactaacaagagcactgtatcttttgcttcgataggctctttcaagatgtagacaaattggaggtaggccagacagaatctacgggaatgattaggggaattgaaggaatgacttcggaaaaaagattaaaagagctaaatacgtataggttggctaagtgccaactcagagaaaatgacattatgggctatagatatttgaaagtggctggctataagcaaagcaagggattacttaggtaattggattaaatcaagggggtaaacattttaaactcaatatctggatttattttgttgactataagaattattagattttagaactatcccataacctactgcttggattaaagcaagaggtagggtgtggtagcatgaagtctctaatagtttacccagttctgagcatcttgttgccaggaagcagatcttactcacttttaatccctaggatttagcacattaaaagaactccatagagagctaagtcatgtttagttcagcgagaagaaaatggtctgtggagtcagacattacagattttatatctctgctgttttattgttctataacagtcagcaagttacttaacctaagccttatccataaggtgcgtattaatatcaactttataggattgatgtgaagtttacatgagttgtcttgatctcttcttttacctatttaacagcggttaaatacacccctcctctccatcatcactgccattgtgttccttctgactttagtaatgtcttcaatggtttcctggattccaattttgcctatcttcaagtttccacaatatagtcaggaataactttttgcagcgcatgtatgagtaagcaagccctagcttaaaaactccaatggatcccattgcctgcaggataaaatcgaatatccttaggatgacaaacttcatgccatcatgcctgtctttctaattccaactcatattaccctacccttctcacataatgctctaactacattcacttgcttgagtttttcttttgtaccttgtacaaatgtataaacatgctggttcctctgctgagaacccactttccactccaatttgccatttctttgccactctttgtcttctgccttgcttcacactctttctaaaatgccaatctcagattttacctcttttgagattccaggtgcctctcccatgtgtttccacagtaaatggagcttatcattatcctgctattaattctactgtgttctaagtgtcttttcactctgcctctcctaatagatgttaggattcatttgggcagatacttagattagtgcctaccatttagtaggcattcaacatatttttagattcaaagaatgataaatggtagatggatagatggatggatgggtaggtaaaaagatatatggagtgtaacaaagtacctacaacataagaaattatcaattaatttcagttttctttccttggagttttgagattaagaaatgcacttcgttgtcccgaataagcatagtcttgagtgggctttagtcagagttatttgtgtgcatttatgtcgatactacccactccattctatcatattgggaaaataatgcaatctcgaaggaataggagtctaggaaacctaggatataagtgagcacataccggagaaaaatatgccaacatagtagcttggaggaaatacttggaaatatcttgcctttatagctagatatagaacttcattttttacaactagaagctttgtgacttctgagaccatgactgaagaaaaatggaaatgaagacaaaggggactgaaatgggagtggaagtaggaaaaggggatccatagacacaaaacaaacttttccttttacacactccatttccctctctggtgcttgcccatggcccagctatttaaccttaagacacatggccagcccccttgtctagagtttgccctaattgttgggcgcattgtagcgtcttagatgatcaattgctcatgccaaaagcagagtgttaagattcatgaaattcgagtctgtgctattaataacctgagcagggttttcatgcctccttcccctttgttttctcctttgccaagtctccattctcactcttttgtggatgtgtgtgttatggagacgaatgaaatttcagacacagcaatgaattgccacctaaaaggatacaccccagggtcttctgtgttcctttgcagctgtgtgataaattgccatctccaaaattaattgttaccttttcaggaagtgtttactcattttcatctcctcactggcatcagtgaacctctgagctagaaaaaccaactttcctttcccttctcaagcccttgatatgcagctagaacggcaatcagtggagctgacaagggcgagcagtggtacctccgtgttgttctctagcccatgaattcaatgaacatccaggctatgcctttcatctcaactgccttttaatagactaacccatttctctttacttttggctccacattaaaatgtctataaaattttactccaagctaggtcttccaggtttacggaagaaggaacatacattcagcaaaacagttttctctttttgttagatttctgctgttctcaagagctgaaaaaaagtgtgatacttcacatgtactctttaaaaaacttactaagcctgctcagcttttacacagggtacgccggcacacaagtgtgacctggtccttactccatcctcaaagataagttgtccccacagtctgccaaaaagatgtccctgatgcaatgagaatgagctggagtcctgactgtgctacatttttagtggtatcctaactctctattccacagacatcagaaaatgtcacaacatactctttgtaactagtccctttattatgtccatgaatgtaatatatacaatgattttcaaagagggtgatttttcacccctcttctctccctgccccacatacaaaggagactttgcctatgtctggaaacatttttggttgtcacaattgaaaaggaatgtatggaggtgttgctgttatccagtgagcagaggccacagatgctgctatacattttataatgcacatgaactctggaatatataaatcaagtaaatctcagtattctgccatgtactctgggagatacttaaaattataagccatgacttctattttccaagcattttggagaaaaacaaccaattttgtttttgatttctgactatatggtagagttcagctacacagtatatggtactttaacaaagctatacggtagctgcaagacaacaccatggctgggcccttcagagcctcataagtgtattggggacactgagaatctagtaatagactaacacatatgtaccaccattgagtggcatcaaacatgctttcatttagtgctgaaattgatgatataatggaggctagaaagatctaataatgaaaaaaagaggaatttaaccagtcttgaggtgatcaaatgaggaagcagaaaggtaggattgattgtaatgtgtgcacagaggagtgaagcctgattacctgtactactcattgccagaccttcaagaatcgcgtgccaagtgccaggtgcagaagttgcaaaactgtttgggagatcaaagagaaaatatcaacctggctttcaagtcttttcagggtgctttcttagaaaaactgtttttggtcttgaaacatgggcaaacattggctgcgggccaagaaatttatagttcctgaggaactttagattgatacatgtctgacaatttccattttgcaaaacaagagaaggcaaaagtgggcttggaaggcattcaatctttgatgttgtctttgcttcagctgagcagaagtgagaatttagacacactgagccattaccagagtttaagaaaacttaccatcagtgtggtttccccctttctctcagtcaagcacatgggtgtgtgtcattgtaaaaggactataggattggaagtggacacgtgaattccatttcttactctccactaactacctgagtgacattaggcaaacttgcaaatgtggaagttgggccgggctaggttatgttccgctctaaccttaaacactgatttccccattgactttcttgttccattcaaagagattaggaggaaaaaaaagtggtatatcccaggcacgttttgtgatatttcagtgaaatattgaaataagcaatgtcagcagcctcatgttctcgctaatggtctggtatactttatgaataaacaacactagctttatattactggatctcatttccagcagatttataaaattgtaactctacagtgttttctgacagagcttctggaaggggaaaaatgacagtgcagttgtttgctaacatctgggtgtactttttgcaacatggggagaattgttccaaggcagggagctaatctgattcatatctctacctagaagcacttaaagaagctgtcagatgattcccacagtgacaaatttgagtcccaaggagatgatggagtgaaatcagacacattttgggaagaaattcctactatcttttcaaaggataaactcccacagtatttgtgccaatctcttttacagcattcctatctcaaaaaccagagacttaggctaattttttttgtttctgttattctctaatatatttgtttaaaaaggaagttttaatgaaaagtcagtcatgtgacttagagaattaaatgtagggctctagcaaggatttgctttaaaatgtttctctccgatttagttgctgcacctgggtaataactaccttggaagtattagtgttgtttctctgtcataaaattgacatgcttggtgtggataagaatatttgattgtagaactgcttctacctaactgcattctgttatactaacaatttggctagcagaatttttttttaaaatcctccatttgcagctttttgtactctgatcacaatatattaaatcccccagaagaactactaccttgaatacaaagcacatagcggtgctcttttaattgatttgtaaaggttagttgctcagtactagtggaaagtttcatgattacttaattgaattacctgcttcccccagtagagtgcttactgggcaccatacagtaagctgagagttttacatgcctggtactattatttccccagtttacagattaggaaagcaagatgtagcttacaaaatatgctgaaagaccactggcataaaagccttttaattccttgctgaaaaactccctgggttttgaaatatgataaactacatttttgttgttctctgaagattcaggttcatatagtatgacagttttatttttgtgactctcaatcatatatgagataaatgatgggggaaagagaccgctttgaggtcaagcagacctatgtccaattctaacatcaaggagaagccacgtgctttggcaaagtttgtgtatttacactgttgggaaaactaaaagtaatttatataaagtacctagcatagtatctggcagggtaggtgttcagtaaatgttgctggtattatttttgctagtgataacattattcagccatataaacacatagcactaaggttaagcaaaatatgtattgacattacagcatgcctaggtatttattgcctaaaatatatttccgataagcttttcttagcatttgctgctttctactaagagttgagtgaaactacgatgaccacaatttagtctacttatttaaacctttaattggttggcttccggtaaattgcagtttgaatgactagcccaatcatgtatgagtagccgggaatattcgataggtatagaattcttcctgcctaatcaagtcagggataccgatgttaatttctgaaataaatactttctcctctcaagatctacccagtggttcgttgccccttgggatcacttctacttttcaacaaagagcaagggacagtaattgcaacttcagggtagaaggagagtttgcatgcctggcccagaatgaaataaatgtggaggaacagagcccaaatgacttgtatgtttcaggtacagctccatgtatgctgcagatgatttgggttaaaaaaaaaaattggccagcctaaactttgaggcaaagaaattgcatttcccaatgtctcatttctctttccttttactttacttcatctactgtgaatgacccttatttttttgttgttgctttatggcaataaataaacgaacccccattgtgcaaatattatgctcttctcattggcctggagggaaattgctacgagagaaatcctggacttttttcccctttttagaaggaaataccaggttacgaatggcccttctcagtctctagattgagactaggattcttctgtcacctcctcagagccctggatgcagaaagcaattcatttcacatgtgtgcaaatcagacacagaaattctgcaaggcacctcttggcagtaaaagtggactattaactctcaaattgctggcctctactgagaggcaacttctccctgaagccaggtgggagtgtccctttgaagccttacacaacccgacttctgttgctagggtagagtactttagagcaagagtagtcctgcggtatgttaactgagtaggtgtttcccagaaaattaaaagcaaaagtaactacctggaacagtctgatttttaaagcaaagcaggatctttgtacgtttaaaatttagtccagctacttgatagcctatagagcccccaactccttcttccagcccagggagagtctgcagtgagcaaggtaagaggtagctccagcattttcagcatggggttaggttggaagtcccagttgacagggacagtccttcctgctctcacctgccaaaatctctctcctcccaggagatagctcccttttctccctgattgcttcctctcatgaggagaaggtcattggcgctcaccacttccagggcaaccctttatgcaagcagtgggtgcctttgaaaggcaaaccgcagcaggaagactttgaaggcaagaagagactttttcatctttgcaggccccagccagaacattggttctcagtgcagtacaagcagtttcaaagttatctcccttgctgatatggatgtgataacatggagcggagaggtgccataatgatttcctttcaaatggctgcctcaccatttatctttgcacactgtcaaagactgatattgtcgggagttagcagtggcatggaataattaatctcgtacgggggaagtaagttcttcatttgtctcctgagaaattagcactgcattgacagcaaaagtagatgatatcatcggaaagggaaagggaggtgatctttgtaactccagatgccaaattgtaacattgattcagttctgtgaagttttgattgaacacctactatgtgccaggtgctagagatacagatacagattcctgtgctacagtagatcataatcccttgagggtcacagcttatttcaaaatccttgtcaccttgacaaaatgctcaagaccaccatggtgacatgtgtgccaccatcattattattatctaaagagttttaccaagtgtctgtatcattaatatttattgtaaaggctcaacttttataagaaagaatccttgtctcccacaccaccagtgcaaagtagattaacaaagttggcatttatttattttattttttctttaggggaaaatcaagaagttagtgatctagggctaatggggatattgtgttactcccaatatgtggttcccatatttggattcaagtttttcctattttccaatcagtgggaggagaaaaagaaaagcatgcctgcttatatcctattaaggccacacctgtctgcaaaacaggtgggatccatgtgaaccagaagcaagctattaaggatgcaagaaaatgtagtgactagttggatggccatataccttgcttaaaaccagttagggtcttttatttctgaaagaaagaagggaaactagatatttggggatgataagcaatctccccacagagattctgggtgaaatcctttttgcttctctgaatttccaataactcacctcttaaatgagagaattgaaggaggtgtgctgtgtagtccttttcaatttcaaagtcaaaataacaactctaggctcctcctccttcctcagcttctcccaggcagtaggcacagtgatgggctctgtgctgggaattttgttttgagcctgtttcttttatttggaaacatcaggtgctgaacctatcctggattcgagtgagtgcagggcatggctctaagaagcattttgtggaaagagtcaagcttgtcatcctcctcctttgaggcactaattgggctgactgggccaagcaaaacaatggtatgatccatgtgaaccaaaagcaaattattaggcttggagagtggtgggtagtcagagaagcacttctgttgtagacagaaaaacagcatcatgcttctcagaaagaaagggggctgctatctgggtggaaagcttagaatcaagggagaattatacatgtttttaatggaccgaggaagaagccagatttgtgtatgcggagtttgatagggaagggcttctcttctttttcctactaaaggaatagtgtttttgacaaggtgccaaaaatctaggccacagcatcccactttgtgccacagcatcccactttggtgagccataccaggttgcaggaaattaattgctttagactttgggctggctgagtggggcctgaagccaccgtagtccctgggcaagccccctcccactacacaggcctcctccatctccctcattttctctgtgtgctgtgatttggaaaaaattgacaagcacttgatagaggctaccaaccaattagaattggttcacacgagacacttgggaatgaactcagctggtcactatggtgatttaactaaattgtgttatccagacacattagtgaatcaagtctggcatttcaattttctctataagatgaattgtggaaagaagttcattataataattaaggaagatttatgcagtgagtacatttttatctctgtagcctgttataatgctggtattttgtgaccaaaaaaattgagttgtagatattaactatgtaattccacaaactgtgctcccgaacgagttatttatatagttagaatttaataaatggaaactttttgaatgcacctgcttaggaaaatattgaaagaaaacttactgtaagtttttcagcacagtgaacaatcatcccccagtgaacaaaatgctagccttaacccggtcagtaaattatttggccataggcagatatctcatctccctgtaaaggaaagccagtttcctccactgtaaaatgagtcttagtaggaaagggggcattagcaaagtaatccctgtgcctacccaatcgttctaatgtgatgtttcctttggaaaaaacctacaactcagaaatatattgaatgaaaatctccctattacaggaagacactgcgggttgctaaggagtgtggtttctgtggttggagtagagaaaaatagtggtgttttctgagatctcaactcaactgtgcagggtagatcgaatgaacacagcacaagccacagccactgttctgcttctgcctgatttgcttctccagaaatttcccagattacaacaatgccgaagtgcccattggctaccacggagataacttcataaattgttaaacaggcagagctcaggtttaaagaactgcctttattttgagctgtgattttacttgtgtttcagacattccctcagatattttatttaaaagatttcacaggagcatcatgcaaaatggtaaataataaaacattctataaaccacacatcccatctaggactaatcattatattttccaatttaacattcattccttccagatatgttcttactcgttctttaaaactatcataaatggaaagctaccatttaagcacaaataaaactcttaagaaagctaagaaaatctgaactcattaaatatttctaactagtgaactccttggttctccaaatgacctattttttcccttccttcttttttttttttttgtatttttagtagaaacagggtttcaacatgttagccagcctggtcttgaacacctgacctcgtgatccacctgcctcagcctctcaaagtgctgggattacaggcgtgagccactgagcccaccctccttccttccttttttaaattagaattttttattttttatttttttttttaattttttttttggttgcttttagccacctcagttaccttgaccatccgatttcacttactgtagccagatttctaaagtatgtgtttctgtggcttttccatagtttttttccccaatattttggcagtggttgaatagaatccttttattcctccctccctcacccctcccaatcagctccacctatagatatagaaatacaaagtgaacaaatgtgccatgcaacttctatttttgtgcccgttcttcctctttgtctctatttttgcctctagcacatagtatcctggtaaactggatttttttttaagagacatggagaacacagtgcagtgctcattctctctcagcctctctgtttttactgtaatgaatctattctacataccatgttctcaggatcccactgtatgtctgataaactaagtcaagctaaggtcattattaccaataagtaatcaataaactcaatgtttaccctaagtttgatacggtaacttagttattttaagaggaaattttaagttcttgtgtgtgtgagtaagaaggagcatgagaatagggaaagggccgtttcacagaagcggtcctatctggttggcctcaattgtgcctctcaggcttgtatctcatctgcttagctgtaaggccagtcctgttaggcaagaaaaaatttaatttgcaacctagtttatgaaaggataaattaagggaccttgtgggaatttaaatcatctaaggtaatagaacatgaaacttgcctagattaaaaactgggtcttttgtgaggtttcattcattatggccccataataatagctacatgtctatgcacttttgagcttgggtctgtttaaaatacttatttgttatttcacttaattcccacaataactgtacaaatatggttctcttgcctccatcttatatatgagaaaaattaggaacaaaaaaacttaagaaatttctttcactttctatagctgataaactttggagatcagtttgaacccatatactcttaaacactatttatacagtattaatgtgatttgacaaaagtggcataaagagcaatgactctttaagactcaaaagaagatgttcagatttatattttgatattaatattaatatcagcaagataagctgttaaataagcattacatgtaagaatcctgaccttggataaaattaaatctttgtcataaatctactactgtgacaaaactgcaaaatatgcagtgaataattaaatccagatgtctcttccggcaacagcagcagcaaaaactggaggtgggggtgaagggaagatggaagtgacagactccatattcataaaagctctgatgataaatttttttaaaaaaatgtgtttgttttaaataccagtcttccatgaatcctaagaattgcacagtaaaaaataaaatctgcctaccatttaacagcccgcaatacaaaaatcttactgtgtcaaatgtaatatgcatacctggcttcccaatttggttttcttaaggaggagtaatttagttgtcattaaactctttgggaaaccgttttaataatgttctttggttatcaggggtatcctttttttccttaaggcaaagaagagaaaacgtgccgctaaaacctttactgtgtgtggtaatgaagttggtccatttctgtgcaggattgcaacaattctttatcacttaacacgatcggaggtgtgagagcagacagtttctcaaactgcaggaaaatgctgaattcaccgattgctatcttgacacaatgaagggaccatacattatatgaagcccacatttggtttgctgttgttgttttttttttttttataactgtgattattttttgatggaataataatcacagaaaaaagaaaaacctgtaagagaagacaccactgtatcatctttttatggcaatatgcaagagggtagaaaaaatgagagtgtctaaatttatcttattttcctgtgggattttcagcacagacatattcctaccactacaaggaccaaggacattcacttgcctgcttgctctgataatggccagtagctggtcccaatgttgatacaattaattaaaatgataaacatgactctagctagcttcagcacagtaagagtaccacagcattttctggatcatttattcaagattcactgacttggagtcactgatggtaccaatcattttatgaaataccttccactagagacagaaaaacgttgttttgacaaattcatggtctgcacctcccccaaaccagtgcatttctaaacagacttgtttttcctctaaatagctttgccaatccggccaacaccccaatatttctttatattttgaaaagtaggtctttcacctgctgataatggaggatccaattctgtgtaaactctggaattctatttaaaattgcagattttaaatgtagggaccaagacaggatgtaggttgtgtcaacttgggaatgctgaatgactgaactgtcatgacatttacaatccagatgtcatggcaagctgggagacaagacagcttggttgataattagatggcagatgtccatgcagtctcacgtgatacacgttactttttgtatattcaagatttgggactttagccctgaaagataggtgatacatcatcttctctatacaataaaaaatagtttcaataattgtatattattttgttttgctttttttctcatttatttggaagtagcaaatacaagaaacaaaaattactcataacccctatttttggtgtatctctatgcaggcaaatatactgatgatgattattttcattttttgaaaatttagattctcacactcaattaaaaaaagaaagcctgaggaaattaaatgatttctaaaatcacccagctaattagtggcagaaatgagaccagattccagtctcttgctttcccgaataccttattctggaattcaattataagtacaaggcatcccactcttggcttcctttctgaataaatgcttgcaccaaatccccagtggcttcttgagaaagctggctacaaatcttcaaagcctcagttgaagaattcttattaagcctactaggtaccaaagcaatagcctgaagtttggaaaaattctagttggtgaagctagaattttattcaatttaaagaatacttggtaggggggaatgtaatgaattcactccctagcctttcttgaactctacctatttaacaccctatttctaatacagcagcttctcactatagaatgttaggtttatcaaatctctcttccaccctgttatacggcattttccatcccttggatgtttcaagtccaggaccttgggcttaaaggcaaaagtaaaatctattacacatttgtagctttgtacaccaatcagggaaaagtagtaaagtgggctattatgtacattattttacaatgcagtatgttagttgtcaattgttacgcaagactaattttttccacagcaaaaaataaagctattttaaaatattttggaagcaagtcatggttgaagagaagcatcccttgaaaaattagacttaaagctgcaaacttcccggggttgacattagcttgaacttgatgaaaaaggaaaaattttaggaggatttgttcagctgtcttctgagttatgaaagcaggaagaaatgagttttacatattgcctggaggtaatttgtgtacatataagtcaaaaacaattaaacttcaaacttcacacacagccactgtcctgtaaagggtggtagtgtataagcagaagaaaaatgactagaagagaacagggttataaagcatccagacatttcccatgtgaggatcttgaaaaacttctgcagccctgtgactggattctttctcctgatctaatagggctgtttggaggaagtatttctactgctcttgagttgttgctagttttcctttgaatatcctgctcagttccctgccccagttcaagcttccttccaaaatgtgtttaaaataattagctcttcctgttggtataggaaaaaattagtcacacataattggtaattcacatattgtattataaaataatgtacaaaattaccacccttacttctttttggagggcctgtggcttgtaccaatggatttatcttgttccagggcattgagaaattttgccttactgatggcatcaccacttacatttctcaacatctttgcctcccatcagaccaggatttcagttactaggtatcctaccttgttccattgatctgagaccctcattaataccctagctgacagtcttaactcagcactgtcttctattttctaccaaatagaatacaataatcagatacattttactctctcttctgaataaagatattaacaaaatttccatgagtacttataagggtgagtttccagaccaacctagatgagttaccaggatatatagtttgaaatattaactttaaacatttcttgatttttctgaccccatcaggtattttttggaaactggtattaggcttgtagaaatggacaaggagctctaccatgcttgaagatggtttaagccttcagcaaaataattgagagcttcctcttctgaatattccgaatacacaggtctatcagttagtgtatcatgttatgtgtagatgtgtgttggggtgatcagatccaacaccaggtcgtgggggtgacaaaggccggcaattcaaaggaatgagaaaaagacagtttgagagagaaagtgggaccagggggccatcgcgagtgtggaggctgtgaaggccccaagttctgggagcccatgttatttatgggtgctcaaacaggtggtgaggatgtcgagtgaatgagaaacatatggctgtttgacataatgggagtactagaagcaagaagccagcaagtctagcagacatgcaagccctgcctcagcttctctcccaacactcagcttttctccaacagatgtgtatgaataaggcttattaataacaaagcctggctccacaggtgagagggaagatgtaacttaatctactggaagtcaccaacatagccctctaaaatgagtcattattttgactcaaaaatgaacagattaaaaaatgtttcagctaatcctcttagctatttgatgtacatcaagcatccagatgttcacaacatccaagctgcaattttttgtgtgttatttaaaagttttacacttgcatatattattcctttcctcaaagacaaagtatagaacccaaactggactttttaaattcactccttaaaagtgtggtaacttaccattccagagctggtgggtccccgattattggcccatgggttgtccactttgtggttttgctgttaggaaatgttggctgatggcttccttaaccactcagcagttaaccaacaataacttggaatgtgtctaataagtgcagcctaatcttaattttattgggagttatctcagctaaataatggaaaatttgacaaacctaattaatgaattatccactgttaaatcttctgtgccactgagtcctctttttagtaaaatgattaaaaacattaactatagtggtatataattactattaacaactattatgccaatatatattgttattcctgcctaagatactatgtctcagcacggagtttatattaggtattttattttaacagttttctaattgctgccactttttcgtcagattgcatattttgacccacaacattgatttcaccttaatgtcaccagtgggaattaattatctgaagcttggcataatattaattaaatccatatgtcacatcatggtgtggcattcttttctttctttcttttttttttttaagtcagggtctccctatattgccatgctggtctcaaactcctgagctcaagcagtcctccctggttggcctctcaaagtgctgggattacaggtgtgagccaccatgcccagcccattgtgcagtgttcttacaaaagtattctaacaatccaaaatcaagactacttccaaaagtggcaggcttcatatagaatccaacattctgttgcaatgagattgggatgagtgggtttagaccaacattgatatcaaaggccagtttccctttaaatcaaaatcacctgtaaactagcatcttgacattcaagatcccaccagggggatctagctgggaatgtcaccatgcatgtcttgagagagtgcattagcccacctgcagtaggttgaaaaatatcttccaaggataatttcttaagctgtatattttaccttatttagaaaaagggtctttgtgagtgtgattaagttaaggaccttgagatgaggaaataatcctggattatctgagtgggccctaaatatcctcaaaagtgtccttataagagtgaggcagagggggcatttcccccgccacacacacacacacacacacacacacacacacacacacagaggagaaggtgatggaggcagatactggagtgaagcagccacaagccaaggaatgctgacagctgccagaacagtcaagaaacagattctcttttagggtcttcagagagaatgtggccctgctgatgtcttggtttcagctcaatgatactaatttcaaatttctggcctccagaactatgagaaaataaatgtgtttttgttttgttttgtttttttgagacagagtttcactcttgtcacccaggctggagtgcagtggtgcgatcttggctcactgcaacctccgcctcccgtcttcaagtgtttctcctgcctcagcctcccaagtagctgggattacaggtgctcaccaccacgcccagctaatttttgtatttttaatagagacagggtttcaccatgttggtcaggctgatctagaactcctgaccccaagtgatccatctgcctcggcctccccaagtgctgggattacagacatgagccactgcgcccagccaaatgtgttcattttaagtcactcactttgtgccaatttgttatagcagccacaggaaactaatacaatacttgtgccaacttaagtaacagcaccagccaaagtacataaagtggaaataaaggtatttttagaaagtctcattactataaaatatggtgtaaataaaaacagatctgaatatgcaaattgaagtttcaaaataagtctcctgccatcccatttcaaagacactggaaatcttaagctcttttctttacaaattctgaaactatcattgcctgtgggttgggttgaaatgaaggcacgtgggtgtttcaagggtatgttctgtgacaaagagacagaatagaaaaatccaaagtcatagcctggagctaatacagtaatatgaatacataaaacaggaaggacaagaatataaaagtgaatttggggacctgagaaagtcaagaaaatgattggagaaatacaatttgggagaccactttagaacccagccctcactgggcatggtggctcacgcctgtaatctcagcattttgggaggctgaggcaggtggatcacctgaggtcaggagtttgagaccagcctggccaacatggtgaaacccgtctctactaaaagtacaaaaattagccaggcatggtggtgggcatctgtaacgccagctactcaggaggctgaggcaggagaatcactggaacccaggaggcggaggttgcagtgagctgagatcatgccactgcactgcactgcagcctgggtgacagaacgagactctgcctcaaaaaaaaaaaaaaaaaaaaaaaaaaaaagaacccaggcctccaatggtgcgatcaggtgccaggtactcttgtctactgtgctgaccatatgctgttgaggtcatcaccagctacgggaaagggcattctcataggggcaagcccaactctatgtatcttacgttatttaccactatttcccaaataaacctgtttcaaagaataccatctttaatgtctttcacaggtacctatcctccactctgcatccttttccatgctatcacttgcagtgaaggtctgttcaccccttttttaacctgtcttccatcttgagttccaatttccagctgccctctgaatatgtccagaggatgctggctgctgcctcagactcactggatgaaacagtttcctgttttctttactaaaactgccaaccttccttttccttgtttgagttagtgtatcactgtcctctagcccctgagctgaaaccttggaatcatctttcactcctccctccccctttatattcagtcaactgacagtaccaatatttcttctcttctccttttatttcttttgccactgtcctactttgggcactaatctctcttctgaagtataacaatagcctcccaactggccactctgctttagctgctccatggtccaatctcccttgtcacatgtgttatctttcccaaacactgtcacaacttgtcagtctactgcaaaactttccgtgactcctggggggcctgcaggagagagtttcagatttctgagtctgccttcctggctcttcacaatgcagcctgagtccatcttttcaaccgtctctctggatacataccaacacttgccctttgtctcaatgaatgtgcctgccacttttgtatctccttacctttactcatattgtggtttaactatgtggttgtcttctccaccctgacaatagatacatctattgtccatcagcccaatttacaacttttgcatctcttctgatttctatcctctgctaatgacacttattaactactgcctttccactggactttgcatttagttttttatatatatatatatatatatatatatatatatatatatatatatatatatatataaccttacttctgcttttaaacatagatcattatttccatgtctaccttccactttctccaacactagattgcaaatttctacagggtgaagcttatgttttcatcccttaacacccagcttaaatgtcacctcacatactgactaatgctttttatctcagttctaaaacattattaatgtacatcacataatttaactccattttgaaaattagttcttgttccagtatcttatctcttaaaatagactggaaccatctcaaggttagagaggatccactatattaaattcttatatatccctcagtagatggcactttgttggatgatttaattgacgtatcttcttaaaaaataaaaatatctggctcttcaaataattagctttgtgacctgaggcaaatcatttatcctctaggacatttagtttactacatggtgaaataaatgataccttcattccttaaatatatagatccagtgacatgttgctttgaatcacagaatttggtttcgtgctaaatctaagaccaaaaacagagcacaaacaattcagaatcaacagcatgctttctggaagcaatatgaaaggtgttattaatagaattcagcattattctaatttcctcttaaaatttcaagaaatatatctgacatttgtcctgtcattgtaagttgaaatatgtgtgtgtgtgtgtgtgtgtgcatgtatatataattttttgttgttgtttttgagacagtcttgctctgtcacccaggctggagtgcagtggcatgatcttggcttactgcaacctccgtcccccaggttcaagtgactctcatgcctcagcttcccgagtagctgggattacaggtgtgcatcaccacactcagctaagtttttgtatttttagtagagatggggttttgctatgttggccaggctggtctcaaactcctggcctcaagtgatctgcccacctcagcctcccacagtgctggtattacaggtgtgagccaccatacctggccaaaatgtgtatacattacacacacacacacacacacacacacacagagtatgtatacgtatatatctgtatataggtaagtgtgcttatatgtatatacacagacatatacacacacaacatatacatatagatttgttgtctagatattataagagtattgcactaatgtttctataaaacaccagttcacaggcttctgtcttctaacaatatccttatacatatttgtcagccactatttaccttaaaatgaaacagaggggagcctgatatataattacggtcactgtgctttgttctattttgtttatccctttgcaatatagtgtggcagacagaaaaatgtatgaaattaattcttttggtttagaatgacattcctatcattgttagaacaagggattacattatacactacctctaaactcaaattttctgagcactttaactattaaatagcaataacagaaagcattgtaaatcttttggagttttgcatgataatgtacctcttgttaattgaattgagagatgattgccctatgattacctcgattcatttgctgcataatttaccataatgataattaactccttgtactgaatgaggtaagatgtgtgttagttagacaccccctccctcccttcttgcctttccttctttccctccctattttagtgtttaaccattttacacacaatttgagacttgtttcagaatctctccacctatattatcatgtcaatccaagtatttctaaataaaagtagaagttgggccatgtttttaaaatttctagctaattgcctgctacttggcttattgttgtgatctaattatgttctggtttttgaaaaaaggactattgcctggcccactgtatgacatttgatttatgtagtctcacctctccctaaatagcccatagttcacaatgcagcagagcctatattaccgcaatttcttctgcactgaaattagacaattatgaagttagtagattattaaactaacgtatgctttataaatacttcttcattctaggataagggagaaggaagtatactgtaattcccaatatgtaaatgccctcacacatttgatagttgatggttccattttttagatgaaaaaactaaagcacaaagaagataaacaatattttgttctgccctataataaaataagcaggcaaatatttatggatatgattctgggttgcctcaaaactttcagggtcagggtaggcaggcagttggagatatgagataatgttagccatgaattgtggctatttttgtggcacctgggtgatgagtccacggaggttcatcacatgattttatttacttttgtatgtttcatattttctataataaaggtattttaaaggaatatatttaggtatccacagtgtgtgacacctgtcaaggagcacatgctagaggcctggctctgccagtgacataggctacgtgactgtcggtgggtcacaacttcctagacttcatttttccctcattaaaatcaaagtattagaagagatcagtggttcccaaggaggtggagttgcttagggaactgtctaaaatttcactgacaactcagaaatctatttggatttagaagctggaggggaatgtatatttcaaaataacttctcaagtgactgtactgtgaccattccttacacacaaacttgggctaacaatgagaatgacttaaccccccaccccacaacactttaataggtttaggatgggttctgagaaataaagatttttaaaacattccccaagtgattctaataggtggtcgacatgccatactttgagaaacacttttttagctcatctcagggtcccttccaactctgacacctcatgatattacttgagcattcttggttctctgcttctatgatgtactattccatgagcaactggagatttagttacaggtgtatacaagtgtacaggagtcaagaaaatgatgctaagtttcttgcactgactgaggaagcaaggtagaagcagactctggcttaattggaattcatgtttgaggcctctgggccctcactaggaaaaatattcaatttatatgtaagcatatgtataatacacatatctcaccagcattctttttgggaaaagagaatttccaaattaaatttaacctatcaattttatactgactaagatgaacacattattttaatatattgtttcctcttgcttcctaatacttacattgtatagagtttcattctttatgctaatcctaatgcatagattggtaaattgagattaatgagattcttcctttactaccacctgtttttaaccaaatgcctacatgctgcatgagcaggaaatgaggtgactactgttgttggccacagagcttcaatatgtcgtgaacaagggttagatgtgaatgtcagaaaaaatgttatgatcaatttctgcctccaacaaggaactacaaatatgggtcacaaaagttctactagtagccccaaatacattttttgaaaggagacaatataaataaagctgaaaagcagtcacaacgctttaatgtgtcattctcttcttcacctttctatccacttagatgtttcctaccccccaaaaatgaacttatgtcacatcacacttgtgactcccactgacatctaaagtagtgtgagccacacagatagaagcacaggtaaatgcctcaaaacctagttattatatttgaaggaatttctgattcagtagtgtttctgtaattgttactaacatcaacgcttcgcttgcttctaggaagacaggatggtaaattcctaacaatggaattgcaaagttcacagtgtgctttaaggagtccctttctccataaacacagctcttgtgatggctttgcagattttgtttctgcatttagtgtagataagttgaacaatcctaattcctgagttctaactagtgatagagcacattatattgttaagaataatggatgttggagaaagtcaggacaaaagtaggtatgaggtgtccctggtatgtggccaataggaaccacggtcctgaagtatccggagcagtccggacatcctcaagtagacccaaatcagccctatcaggagccaacagaaaagcttgctagggcaaggtcagaagataaatttattagccaggaccagtttaagtcaaaagttgaatataagtcatatctttagaaaaaaaaaaaaaaagcaggtagaaaggcacattgtttttagctaactctacaaaaagttcagagcgaaaagaaaaacagtgatgcagaactaggggagaaattaaggagcaaacattccaaaaatagaatgagttgtacacttggttaatttcattgctcagtgatgcctccatagaccagattcttctctctgccatcctcagaaataggctctagggatgctcttagataggctattctgtatgcaagaccttctgtagctgttctagatgccagatcctgaaatgacaacattcagtgaacaataatagctcttcttctacgtcatttccttagatgtgaagaaaccatttccagcaaactcccctcatgtccacaacacctcattaatcaggattaaatcatatgttcatttctaaaccaataagagaaaaagaagtatcgtggctatattatactgaaatgcaattgattttggagagttaaaaacaaatccaaaccagcagcagagcctggggagaatccacgtctccttctcaatccacaagacatgatgggtctgctgcagtgtggtactaaatttggggttacaagaaatttttggcttattagtttcctagggcttctgtaattaagtaccacacactgagtgccttaaaacaactgaaatgtattatctcatagttacaaagtctagaagtctcaaaacaaggtgtcagcagagccatgctcccccctgcaatctgcaggggaataatttcctcttcctagtgtctggtggtttgcccagcaatctttggccttttttggcttgtagttgcttaactccaacctctttcttcctcatcacatggtgttctccctgtgtgcccctttcttcatatggctatcttcttgtaagacactagttatattggcttagggtctcactcaactccagtatgatctcatctaacttaacaaattacatctgcaaccttcctatattcaaataacttcacattctgaggtagcggggattagaacttcaacatatgtatttttgggtggaacaaaattcaagccataacaggcttctatagacctctctagttttactcagtctagatcccaatccatggagtttgaccaaatgagttagggtgctattccctaaacttgctgaaacataataattgctagaggcccttagtaaaatacagattcctggccctcacaacagatgtactgaatcagtctctctaggggacatgcctagaaatctgctttttgacaactgcccagttcaattttatgatgaagcaagtttggaaagcatagagtcagggtgctgagcactttttgagcatctttgagcactttttgaccatgttattcctggctgtgaaagaattctttttgtatgaaatctcatctacccataacaagtcttggaagctgctcttgtcatcctcatcacagacctgcagaaatggaggttaggtaagagtggggctggaaatggagctaggtccaatctcaaaatacatactttttcaatcatactaactcatcatgttagtagtaagttaaagaatcttgaatcatatggtccactgtagtttacttttcttgccttattcccaggagttttgtttttatttgttcttgtccttggagggaacaaaagacagctggtagctgttccctgtttggttttgcatgtattcaaaaggcatcatcttctactgctctcttactcctttactttgtggtcatttgttttgcagctatttagacagttacttcttaaagaacccctaaaactatttagacagttacttcttaaagaacccctaaaactatttagacagttacttcttaaagaactcctaaaactaccatttgttcctctagaaaggattaaagatttgctgaagcaaagttctcctgacactttacctagagcaaggctgaaacaaaagctacctacacctgtattttccttctcttatccctcaagtacacaatagggcatttggctctcagcagttgatgccaagttctgctagggaagaaatgagacttcagagctccctacaagttgaaatggagtcagaaaagctacatatataaatgtcagaaaagctacatatataagctacatacataagctacttataaagtttctgcaaaactacctcaaagggcaggtagttttgcagaaactggagggacactgttttctggagcactctgccactaggattttacttttagtgtaatgaaggatcactgaagacttttaaaccagacggtgacatgataaaatttcatttcagaaatttcatttctgaaaattatgatggctgttggaaaaaagtagattggaagaagcaagaaaatgctaggttacttcacaacttctccaggaaaatagtgcagtgggagaaccctgaactcaggaaatatggcccatttcctgcactatgtttcccaattcaaaatatcctattgtggaattctacagctcaagtcaagagccccttctgaactacaaaggacaaggactgatctactaaagccgtgtagtaaatgtgaggaatttgcctaactcagccaattgatgtgtcaaaatctaaccaatgtgtctaataatctaacatatattgttattgatttcaggttttaagaaccagttttctaaaaatgaaaaacaaaatcaaagcactctagaggaagtaatcatatgtttaatgtcataagtcactgattgtatacttaatagtaaatggtggatatgaacttgggccctggagtcaaacttaggtggctcggtcatgcccttgatgtgtgtctttgggtgggctactgaaactctgtcttagtttcatctataaaatagaatgctaacatcgactttatagggttattgtgaactctaaataagacaacaaatggaaacccaacacatgttctcactcaaaagtgggagctgaacacgtagacatggggaggggaataacacacattggggcctgtcggggagggggagggagagcatcaggataaacagctaatgcatgtggggcttaatacctaggtgatgggttgatagctgcaacaaatcaccatggcacttgtttacctacgtaacaaaccttcacgtcctgcacatgtagcctggaacttaaaattaaattaagtcaaaaaaagctaaaagcaagctttatgccaaaaaaaattttaaaaacttaaaaaaaagcgcctcttaaagttataagggagggtacacagtaagcacttagtgagtgagtgttgtggttgctgtttttcttaataaacatatttttatccaaattattaagcagaaatattggactggaaaagggtaaagtgtggattattaacggttgacattggaagagcaaagagatagagatgttccatgtggttcctttgccaagccatccagatactcacctccatccttttggtcatttcccctaatacacagtatatttatgatccccttctgacaaccccttgaagagttgcttgcctcctgcacagtgctgagttatggacgatgcatttgaagccatatattcactctgtcttccccacatgtgcctagtaactatggcagagctcaataaagaagaggccagtggcgggtttactcatttttaaaaaaatttccttgttgttcttttctgtgattgtaatggctagcactggtactctttccctctctctccccttcttttgccatagagctattgtcaaatgtacaaatacatagtgaattgcgatggtttctgggactgacagagagaaggaacctgttttccccataaatgctgtagaatgaagggtttgcaaacattgtgattgtggcagattaaaaaaaaaaagtcaagcaggctaaattgaaagggaggcatgagaaaagctggtgcaacctgtcagctcctggtccgaaagaagctgatggtattttttttaatattgtgaagagaaggaaaattttttatagtaagtctatggatctgctttaggaggcttttctcttgatctaattgagctgtttgaagtgtgcttgaaagttctcacccagcctgtgtcagccacctgcctgctacaagctgtgagaagttaatcgtcttgggcattgttaggaggagactgtctggtatctgatggctttccattctgaacaagggtgtacggatatggaaaatgtgtgtgctcacatttgtctttggggtgtggggctgcttcactatgcatgagagcacatccacacctccatccagatggtgcctgctcatagtggcagtgctagataaattcatgtcaaacaggcagataatccaaaaaagcaactgtaagtatccacattgctgttttctgcttccaagcttcagtgttgtttttttttttgtagtgacagggtattactatgttgcccaggcttgtctcaaactcctgggttcaagtgatcctccagccttggcctcccaaaaatctgggattataggagtgagccaccgtgcagtgcctggttttttaacatgctattcccttgcctgaaacaaccttgccatttgccatcaacactggcttcatcttccaatctctttgcctgttgcctcacattggatgtcaccaatctgggaagcctttgtcacccctcaccacattgaggtgaggggtacctcatattctctccctgttccttgatttcccattcaaagcacttaatgcaccaaacatttttttttattgcatgtctgaatacattccttagtagttcaacattctttgaggttatatcatgttcatcacagaatttaaagcaatctcctgtgtatagcagattgacaataaattagctatgaaaacaaatgaataactatggtttgggaagaaagacattgtctgagcacacagaattctaactcatgacttgtgcactgtcaagaatcacttgctttcagataattttgatgagtctgattttacgcttttcagtttgtatgtctcatgatttgtccttaatagactgaagaagtcctagcccttataattgaccagtgcctggtaggggaagggcagcagagaaggactggattagaaccatctcaaatgcttctattctgattagtacttagggttggttggagagtaagaatagggactcagcctagttgaaggaaagcctgtatagtggtgagtctgagtgacaaaccagggagaagtaataagacaatttatttctatttttttatcctacacctgaaatgtaaacaaggacacattaaatttttactggttagcattttttaagtaattatgtgctcaactatgtccttatatttgcattcttaccaatgtagactctgttatggaagtaacccatgctgctgctgcctttggacctgaatctctttttgcccttgtcccatttgtgaatttagactttcagcaagttgtctttatgattctctattctatgacatactttgtgaattcatctgtaatcaaatctgtttgatgaaggtcacaaaagctaagtcaacatgagacctgaaagtagaacctgggggtactgattttcctacccattaggaaacagcctccccacccaatcagggcaggttatagtattcaatgccatcttgtcttattgactgagtcatacatctctcattccgcaaagtcagggtcctaaaatacttctgtggagtcgcaaggactcttcctcattagccatctttgactttgtcattgatactattttctacctgtttctgataattaaaaccccccaaaaagtaaaatgtcagggtgaccagagagaaccttagataggacagctaatctcttgcttctagagaaaggtatgaaaatatactgtgcttattatggggatgatggtatgctctctgaattgaaccttaccttttaacatgaaatttctaattgaaacaaagctgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtgtggccattttcacgatattgattcttcctacccatgagcatggaatgttcttccatttgtttgtatcctcttttatttcattgagcagtggtttgtagttctccttgaagaggtccttcacatcccttgtaagttggattcctaagtattttattctctttgaagcaattgtgactgggagttcactcatgatttggctctctgtttgtctgttgttggtgtataagaatgcttgtgatttttgtacattgattttgtatcctgagactttgctgaagttgcttatcagctgaaggagattttgggctgagacaatggggttttctagatatacaatcatgtcatctgcaaacagggacaatttgacttcctcttttcctaattgaataccctttatttccttctcctgcctaattgccctggctagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgctggattacattgattgatttgcatatattgaaccagccttgcatcccagggatgaagcccactcgatcatggtggataagctttttgatgcgctgctggattcggtttgccagtattttattgaggatttttgcatcaatgttcatcaaggatattggtctaaaattctcttttttggttgtgtctctgtccagctttggtatcaggatgatgctggcctcataaaacgagttagggaggatttcctctttttctattgattggaatagtttcagaaggaatggtaccagttccgccttgtacctctggtagaattcggctgtgaatccatctggtcctggactctttttgcttggtaagctattgattattgccacaatttcagatcctgttattggtctattcagagattcaaattcttcctggtttagtctgttttggttactgcagcctatactacaaggctacagtaaccaaaacagcatggtactggtaccaaaacagagatatagatcaatggaacagaacagagccctcagaaataacgctgcatatctacaactatctgatctttgacaaacctgagaaagacaagcaatggggaaaggattccctatttaataaatggtgctgggaaaactggctagccatatgcagaaagcagaaactggatcccttccttacaccttatacaaaaattaattcaagatggattaaagacttaaatgttagacctaaaaccataaaaaccctagaagaaaaccaaggcattaccattcaggacataggcatgggcaaggacttcatgtctaaaacaccaaaagcaatggcaacaaaagccaaaattgacaaatgggatctaattaaactaaagagcttctgcacagcagaagaaactaccatcagagtgaacaggcaacctacaaaatgggagaaaattttcacaacctactcatctgacaaagggctaatatccagaatctacaatgaactcaaacaaatttacaggaaaaaaaacaaacaaccccatggaaaagtgggcaaaggatatgaacagacacttctcaaaagaagacatttatgcaaccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggaccaagaactagaaataccatttgacccagccatcccattactgggtatatacccaaaggactataaatcatgctgctataaagacacatgcacacgtatgtttattgcggcactattcacaatagcaaagacttggaactaacccaaatgtccaacaatgatagacaggattaagaaaatgtggcacatatataccatggaatactatgcagccataaaaaatgatgagttcatgtcctttgtagggacatggatgaaattggaaatcatctttctcagcaaactatcgcaaggacaaaaaacaaaacaccgcatgttctcactcatagatgggaattgaacaatgaaaacacatggacacaggaaggggaacatcacactctggggactgttgtggggtggggggaggggggagggatagcattaggaaatataactaatgctaaatgacgagttaatgggtgcagcacaccagcatggcacatgtatacatatataactaacctgcacattgtgcatatgtaccctaaaacttaaagtataataataataataataataaaaagaaatttctaattgagttgcctaagcctgcccacctgtcattctcatatgcctaacacgatgtgagattttatatatacagtcctctgtatatatattcacaggttccccatccacagattcaaccacccatggattcaaaaagcaaagcaaacaaacaaaataacaacaacaaaaatacaaattttaaaacacagtataacagccatttacacagcagttatattgttttaggtattatacctaatttagagatgatttaaagtacatgggagagtactttaaaaaaaaagtacacaggcatgggggcagtggctcatgcctgtaatcccagcactttgggaggccgaggcaggtggatcacgtaaggttgggagttcaagaccagcctggccaacatggtgaaacccctgtctctactaaaagaagaaaaaacaaaaacaaaaacaaaaattattcaggtgtggtggcacatggctgtaatcccagctgctcgggaggctgaggcataagaatcacttaaaccagggagaggcagaatttgcagtgagttgagattgcatcacttcactctggcctggacgacagagcgagactccatctcaaaaacataaataaataaagtacagggaggatgtgtatagattatatgcaaatactgtgccattagggacttgaacatctccagattttgtatccacaggggtcctggaatcaatccccttgatggatacagagggaagactcactctcactctctcttgatatatatatatatatatatatatatatatatatatatatatatatatatatatatatatgcacacatacacacacacacacacacatatatatacacacacatacacacacacgtatgtatatttacatgtatttataaactgatattttattcaaatgtttcaactggcccctaggaagaaagatccactctgatgtgttctggctctgtgtgcccacccaaatctcatcttgaattatcatctgaattgtaatccctgtttgttgtgggagggacctctcgggaggtgattggattatggaacggtttccgcatgctgttcttgtggtagtgggtgagttctcacaagatctgatggtttcataagaggctcttcccccttcgctctgctcttcccttctttaagctgccatgcgaagaaggtctttgctttcccttcatcttctgccataattgtaagtttcctgaggccttcccagccatgcagaactgtgagtcaattatgcctttttcctttataaattactcagtctcaggtatatctttatagaagtgtgagaatggtttaatacactctgtaaaagcaaaataatcactcttcagaagcagaaaaaaactttttataagtgactcaaagtcaagatgacccatttctcatttatatgatataaacctatacatatcctctcacgtactttaaatcatctctagattagttataatacctaaaacaatgtaaatgctatgtaaatgcctgttatactatgttttaaaatttgtatattttgttgtattatttatatttttgttttttgaatctacggtttatatgaatatcattctctctccctctgcatctatctgtatctacatatgtatatttgtttttttcttagaacataacctagattcctctacagtgtaaatcccttgctttctggttttctgcctaataaaaggctctcatttctatcttggtctggaaatacccccacttccattttttatgaagtaaaaataccgaagatttttttttttttttgctagaagtagtttactgtctttctctacaactcattctaatatttttcttttcaactccctaccattcttattgtcttccagcaatgtctctatgatcatagagagacaaactgcagccacacttagccaggatcatttacatttacttgcatggctctgtgtagcttgctttttatgctaggcaggttcctgaatagtcagataggaattgaattcttggaaatcatgccattgtttaaggatgaggaagaacttactattttaatgaactttattataaaccttttttctaagcaaataatcaccccttactttatcttatctcctatgcaaatcctgattttcacatttaagctttacttaacagtgtcaatttgtatagttatctttaaacaatggtcagtccccactcttataattgaaaagtaagtaattttcatttactttctggcttctacctccagaaaatctcttacctctatctttattttggtaattctcttgtagggactttaatagcccctggaaaatcatcatagctctgcttcaatctgaaaacataactggcaggcatgagtctggaacacatacgagggaacgaagtacccagagccaagttaaatgaactgttgatgacttttctgaaaatcatagtaaaccatgatttcctcacaaaatatagaagtgtctgatttttggcatttaattctcaaacatactcagatacactttccttcttcctctcccactctgggttcatatcatcatataaatcagaaatgggtcatcttgcctttgagtcatttataaaaagtttttcttttctagctctgaagcgtgattattttgcttttagagaggatctttctttctggggccagttgaaacatctgaacaaaataaaaatcaattgaatatggatatgaaacttaacttgtctttttaccattaaatatatatttgaaaaatgtgctcttcttttatagcttttgtcacatcagcatgtaccaattccaaccagagaacgaaatattaatattctgccccaaagtgctgttttccagcctgtgccaaagcagataatgccagtaacagggagttttccaatctaactttcttataccagtcaaattatccatttcaaaaaagcatccagtcaaagtgctcccaataagtgaatattttgcctagagaattttgggcttgagttatccatccctctgaccaaaatctataagcccactcacccaggagatctgagaatgaaactaaatataaaaactggctttactactgggaacccgaaagttcagctagtgagggaaggaaaacaaagaatagaatgttttccgacaatccttgcttttgtgagtggtcagcagatgttttgtgcctctgctgtattccttagctaagggttcacatgaaatgtaccctctgaaggctgtggccttgttggaacgccaaattagtagttattcctcatgctctgaggtctagcttcaccttcagaaccaggtgagcttggtccccacaaagccctactggtacttaagcttcccatttcaagaggacatttgggttcactacacctctccaagccgtctgattaattgcagctgtgtgcaaattagttttcttcaggggctctctcctgctctcagattagcaacaacgtattcagatggaaagcaaataaagatagttgtaaaatgaggacacaaaagagatgcaacatgtttgctcttgatgggtgcattgatgtcagaacaactagggggaaataagaccaccttggtactgttatcatcgtcctgatgatggtcccgtcttgcagaaaagcccaaacagaagcagggcgttgtctaatcactgatgggtttcctgatattattgagaagaccaagcaaaattaatggtgatattatatctggtgaaattattataaattctccctgcagttttaattagctctgctctttttctcctcctgttttaatccaaagcatatgtgtatgtttgtatcagcaatttcaaaattctgtgaagcatttggtgtcatccatctagtttcaaaataggtacagcatgatgcagtgggaagaatgctagcctagaagttaggactcctgagttcctgcctaggtctgccgctaagctgtagtatgaccttggacatgacctttcaggaccttgatttcttcttatgtgagatgaaggattaaaatccaacagtttgttaaatcactctcaactttttagatactattaagtttaggatcccgtggagaggcctatcatccgagagaccatcctatcatcaaaaggtgaatatcaggtcaaagcaaaagaaaccacattaatttttttctgttgtcagctcacaaagctattttaagcctttggacaataagaaatatactttttttcccctccaataaatatacattatccattaaagtagagtgtgttgtgaactgaccttaagggaatttgctagtttttttgtttatttttgttttttacaggaaactaagtcctgtggaacaaaatagaattaccttcatggagcaagtttaacaaattgtcttcatttttggtcagcaggttgatttctaattccctcttattccctttatatgtatttttggcttcctgtctttgttttgcgttgctataaagaaacatgtgagactgagtaatttacaaagaaaagaggtttattagggctcatagttttgcagcctgtgcaagaagcatggcaccagcatctccttctggtgctgcccctaggaagctttcactcatggcagaaggggaaggagagctatgtgtagagatctcatggagagagagggagagcaagagagaggataggaggttcaggcagtttttaacaatcagatttcatgaaaataaaagaactcactcattacctcgaggaaggcaccaagccattcatgcgggatctgccccatgaccaaacacctcctactaggccctacctccaacattggggatcacatttcaacatgggatctggaggggacaaatatccaaactattaaattcctaaaggacataaaagggtgaactgcacaaggatactatatctccaaacaaatgcccagttaggtccaggacgtgttcaacagtgtccaaaatccaaagagaaccagagatagtgtggcttagtagaaggtaaactgattatacacactcagcattgcaagaaaccttaacgggactgttgtccaaccacacaagcattattcaaaaacctttttacctctcaaggtttggttttctagcatgggttgccaagctacaactgcccagagaagtcatttaaactgcaagagactcagctttctcatccttggaagagagaaattggacaaaattatctttaattttttgtttgccttaatatcctcttattctactaaacattttcagtattacagaaatcagctcttggaggaaaagacattgcagggggtgggagacaaagttggtgataccatgtaataagatttttttagatagtggcaagataaaatgttttgaggtttggcaaaaccatctagtagtttcagttctccctgacagtaagaagttaaggaggccaatttctctttcaagtcagaacttcttgttataactgggtagtaaacatactttttaataagaagtggctaaggcttaagaagaccaactgctgatacccagaaatagccaaagaatacttcattactgacagtgcacactttgatagacctgtcttttactattgacagtattctttctctgctgtttttacaagaaaaaaagcccaatgaaatgtaaaccttgttttcttcagttattggtcctaggagtattcagagtaaataaaaaaaaaataccttacgtatacttctataaaatcttttatttgagcaattaaaaaaagctatcttctttcagtcttatcaaggagagcaaattcctcctagaagtcttatttctacttctaatgacaattgctttattatgtgacattcaaaggaaaaacttgaagtcatatttctagtaaagtatttaatttcagaaataatttaaactgttacttcaaagcaaatatctgctattcctgacataaagtttttacccaagcttggtaataaagttatcataagaataatatggattattctcaggatggaatagaatgtcttgattaggaagaaacacacataagaaattcatttttttggaagaaagaaaatctgtgctgtttatctggcaatggaagtcagatcaaaatatatctatatgacatttgaatggggtcacgtgggaagacaagatctgtctgtatgaatatttttagcttctgaatttgacataagaataggatcaggaaaatgaattctgtgttacatgactaagatgcatattagaactcaggcaagatgattcctgtagttggtctactgggaaattaccctctgcctacagctttcaaatacatatatatactatgtgtgtgcatgtgtgtaaatttccaactgagtacatcagcacataaaatacacttgtccaaggtaaaaaagacaaacagttattaatagggcaaaaataaaatggggttatatccaaccatggcataatacttctcattagaaaaaagtgtggcgagctaattaagacccagtgatagttagaaagtctgagaacatttatctttaaaaatggagtggtaactaactaaaagaaggacccagaacctcctaatacaaatatcagttatattccctgagatttaaaaatataataattcttatttctaattcaaaggcctagagtgtaagtagggataacttaacctttttttttttttttaagcctctgtgagaaataacgcagctgtttggcccgtggtattctctttaaaggaaagaagttacaaagacaagaagaaaaaagtggaagagaaaaataaggagaaaaaatattcaaacagtacataactaaaaaaaaaatttttcacaaacagcaaggggaatcttgaaacaaaatagatttgttttaaaatgcaaagaaagagccttacccgggatgaattgctcagttctcttttgttggttgagttcacttccttccatttctgctaactttgaccagctgctaacaagcaaaagagcttcatagaggccatctacacgtgttctcttctgggttatcgcgatgctgacaaagtgcacctaccgcaaattagaagagcacaaagatttctgtgggtatgcctgcaaaactctggctgcgaggcatcacctcagctcagtagccttggatttacatgtgcctgcccccctgcccatggttactgagggtggcctgaggatggattcacttcataacccttttccataattatgtgaataacaaatgagctctatccaatagagaaaaagaacacattttaatactttgtgaagtgatcatgaggaaggggacagaggagttgagatggccaagagagatcccgccctctggagatgtaatagaacagtgacagataatgcaaaaaaagatttaatatatttttatatatttaatatttgtcttctgttgttgaccttagcttttgagtcaacagtaactaagaagcattttgtcatccgacggctcctcttcctttggccttctgtattgtattatctgataaggaagcagcgaacttaaagctcagttcaacgcaatgatccttcatcatagctgggtgtgaagaatgttgttccctcaaatatgacacaaattgtttggtcaatagagaagagaactgcattctatttttttccaaacatctgttatactccaaaacctttctccttaggccatggctgtctgaccaacagtaggtggatttctttgaaatcttatcttctgtagaactggatctcatcctggccaacatggtgaacccagtatctactaaaaatacaaaaattagctgggcgtggtggcaggcgcctgtagtctcagctactcgggaggctgaggcaggagaatggcgtgaacccgggaggcggagcttgccaagatggcaccactgcactccagcctggcaacaaagcgagactctgtctcaaaaaaaaaaaaaaaaaaaaaaaaatagatctcactagaagtattctcaattcagcagtagtgtccagttttgaatcaaataatttatattttgattatgtgtattaagaagctaaatctactcatatacaaaaggaaaatctttagcttttcatgtgttctggctaaaggccagaattaaaaggaagaggatgtcttatctatcagacatttttgtgcctttgaagccataaacttgagagaaacattagcttgttcctgaccctgcactcagcataagcatttgcttgtagcagtcactcttgggtgactataaattcacaaagtcaagaatttgcatcctgaattgatttgtgtaagatgtctaggggaatgctgattttatattggaaacaaggttagggggaagcctcaaaactgcctttatggagttctgtatctcagcatattataattcttacttctaccatactccagaggaatcagtctgggtgacttcataaaacagtattagaaaaattgctagcactacgaaatcaagcaggttatggcagtatattccttgtaagaaaattagtgcattaactctttccaataagtgattgaattagttttgcacataatctgatttatgaaatgctgcactcgcatgctcaagtagttagaaagtgtgtcgaagcagatgttgaactgaagaaagaaggttgcttgaaatgtaaaggtattataaaatggctaatctgtgggtatgacccaaagctttcagagatttcctggcttcactttttttttttcaatttaataaattttttttcttaaaaggtaaaattgccaatgagttaaatgttgatgctctgatgttagcaagactgagttcatatgtccatcgcttattaactccattttcttatcaatatgtttggcttctgtaagtcttattttcttgtttgtgaaaggaagatctaataatagaactggccttatagaattgttgtgaggattaaatgtggcaacccatggttattggtttcgtgcgatgcctgtcacaaagaaaaaacccaataagttgtagtggctatttttcatcttctcattatcaccattacttaagagagaggcaaagtgatagtatcatacaaacattttcatggagagttaaatgaacatctgttttttcttttcttcaattttttaaaaattatactttaagtcctgggggacatgtgcagaatatgcaggtttgttacataggtatacacgtgccatggtagtttgctgcactcaccaacctgtcatctacattaggtatttttcctaatgctatccctcccctagcctcccaccccctgacaggccctggtatgtgatgttcccccctccctgtgtccatgcgttctcattgttcaactcccacttatgagtgagaacatacggtgtttggttttctgttcctgtgttagtttgctgaaaatgatggtttccagcttcatccatgtccctgcaaaggatatgaactcatccttttttatggttgcatagtattccatggtgtatacgtgccacattttctttatccagtctatcactgattggcatttggattggttccaagtctttgctgttgtgaatagtgctgcaatagacatacatgtgcatgtgtctttatagcagaatgatttatacatacgtgtgcatgtgtctttatagtagaatgatttataatcctttgggtatacacccagtaatgggattgctggatcaattgtttttaaggacaggttgcataaaactgactaatgccattcatgacagtgagtttcaaaggcagatagctatcttagtccatttagggtgctctaacaaaatgccacaaagttaggtacattataaacaacagaaatgtatttgtcacggatctggaggctggggagtctgagatcaagaccctggcagatgtgatgtctggtgagagcttcttcctggttcatagatggcgacttccagttatgtccttacatggtggaaaggacaaggggtctttctgcgaccagtttttcaagagaattaatcccacttatgaggtctctgccatcatgacctaatcacttccccaaaactccacctcctgataccattacactggtgattagctttcaatatataaatttgggtggcggggtggggcacacacattcagatcatagcaatggcagctaggaggaagtaaattttgaatcctcatttccatgtaaagacttcatttgctttaaacaatttatttaacttttattgtgctttttctgaaaatgaaataacatttagctacacacagggagggtatgttgtttctaaagtaaaaattaactcttttgtaaatgtggcattgtttaataatagttcaccctgtccaatgatacttagcttttttatatatgtaaataaattattaggttactggtttttctttttcttttggtgggtggggggggtgttaagatcttattctcagtcctcaaaactctgttgaacagggaacatctgccctcattttcaaccttatttctttagtaccaattgcagccatgttataatctttgttttcatccaggtaaagctgagggaagggaaggagaatccactgagaaaaagattttccccaaagagtgactcagcctttgaaaagaaaatcagctatatgaaaagggaagagtatttaatcattcggagcaataattgcattgtaaatattagctcagctgataaggagtagagaaccaagagaatgagggagccgttacattgttttatcttgtttgatgcctttactcagtgctctagcatgggggccatgtctagggagggaatccactgcagctacatttaaggtcacctaataaaccgtgctgttttctttcttttcttctagactctattccttcattttttttttctgaactttaagcaaggaaactgccagtcatagagcatttccttatacacttccatgttactgttatgcagagaaatctgactggcaggctgatggccaggctgctctggaggaaagtaattagctatgtgactttatctaggccaaaaaaatgggataaaaaacatgcaaaaccattcacctatacagacctgttctcaaggcagtgtttaccctagtgcatctgctaattcctttcaagtctggaaaactgttttgtttgacatttttggaatgctgtgatctgaaccattagactatttttttctcctttaaggtactaatattctgatttttaaacaattaaatatgctctaaatttgtctcgcccacttctacatcttcttccaacatttacatagacatccatgcacattcatgcacaccacacaactacaagtcatttcagacaaatggtcttatctaattctttttagtgtttccattttattatttgtcaaattgaatggaacttccatgttttgccctgctgacatttaggcagacttgcataaaatacaagattatttctagctggataagaagctcagctatcagatagtgttgctgatttatacagtaggaggaaggagaaaagaccaatgggtgagtataataaatagaaacgtcctgaagcaattcacttgtagcctatccaaatcttgcaaactctgcataaaacatcctcccagttctctttcaatggaacaatttttcttttctttttctactcttcactgaacatttcctgtattctacatgcaacagtgcaccttttacattcgtttggcttatgtgctcttgcaataaccctttgctgtgtggtaatatctcatttgtgggaacttctgtgacactattaggggacagatacaatggctatgtgcctagcaatgccttcaccgtgctctatttaaatagattgctcatttatttgctactttgctcatcaccctgtctctcattcactataatatctttagcaaatcacatagtgccaggtaaataaatggtactcattcaatattgaccatatggatgaatctctgcttatgaaatatgagagccccgtgcagggtcattctgtccaggaactcatcttctctggcggtgtgagaccatatgtttaacatgaccagtaaggaagtagaaggaatcttccactactttttacattcttttttctttcaaaaagttttgtaaacttcaagtatgtaaaaaaacagttcttatatgttcatacagtttgctttcaacaataactccacacatgtgcattgacatgtaaagatgtttccagtataaagtagaaaaaaatgggttttaaacatcatatataaaattaatcaattttttaacatatagcatacctgtattcaggaacatgttctttggttattctcatttaaacagtcccctattgttgaatacttgatctgtttctattgtttcattttatatataatatatcctataccaaatatcctaatataacttctctgtgtgcttgtctaattattttgtttagataaaaggtttcatatggtgtccacttcatgccattatgtgatatgatttgcctctcagcctctaggaatgggtttttctctaaggatagtggctgccactctatctagtggctgaagtaatatggcttcatgtcatgtggctaacgattcatgccaaaggttgtccgcatcttatgtatcagtgagttatctgacacccctaatagacgcttatttcttttttcaaaaagcttgttcctgagctgaatttccatgatcagatggtggcaagagccaagtcttctcacataaagagaaatcacattgaatctgctacctacgaccactggccaaggggtcttgtcatcattgcattctggggaattggattcaatttaaaaagttgaagctgcttgctggcttccttcctggtagttttgaatgtgtaatctcacaaagatcttcttagctctggcaaagctgagcctgtctaaaacatttatgttagaatttacatgagttcatttgtgctggcgtcaaacatttcttgagtatttaccatgttattggctgatcttaaagccaagctacaaaggactagtaggggttagcaggcaggcaggaagaagaagggcatggttggcagagattgccacatgcacagaatatagtggtgaacctacatggtgcatttggaattgcaagtagtctggctttgctggaagtgggtttgcaagctgaggagtaacaagaaataaggccgaatagcataccaggaagtggtagatggcagagacccctggatcaccgtgatacttatgacactacttgctcacttgttttttggtttatttcctgataagctttgagccagaacattaatgcaaattcttgttcttgtgtaaaaattactgcaatgacttcccattgctcttggagaagacaaaatccttaatatggcctacaaggtccagtacaatctgtctcctgcctctgtagtcttattcttcactaggtctgccttcttcctcccagccctactggggcccattctctgggcttcaatattacagaccttactttaatttcactaatgggaaatgttgctgccttccaacaaagggcttttgcatgtgctgtttatatgaaatcctcttttcttcctgccactcttgcctattaatgttcttatttctcagcactcacgttatttttttactcagagaaatcttccctgagttccctgaccatgtcagatttttcacttatatgctgtcataacctcatgcatttctcttttacagtgctataaattgtcagtgacacatttgtgtaattaagtgatgaatgttcctttcttcctaataagtaacatcatctataccatcattattaaatcagccagcatcagctggggtacttatcatatgtcctatactgttctaaacacattatatgtattaattcacttaattctcataacagtccctattaaatggataacactgaggaataaaaaaagtaagtcacccaaagttacacagctgataggtgatgaagttagaattagaaatcaggggggaggagccaagatggctgaacaggaacagctctggtctacagctcccagcgggagcaacgcagaagatgggtgatttctgcatttccatctgaggtaccgagttcatctcactagggagtgcaagacagtgggcgcaggtcactgggtgcatgcaccgtgcgcgagccaaagcagggtgaggaattgcctcactcgggaagcgcaaggggtcagggagttccctttcctagtcaaagaaagtggtgacagacggcacctggaaaattgggtcactcccacctgaatactgtgcttttccgacgggcttaaaaaatggcgcaccaggagattatatccctcacctggctcggagggtcctacgcccacggagtctccctgattgctagcacagcagtctgagatcaaactgcaaggcagcagccagactgggggaggggcgcctgccattgcccaggcttgcttaggtaaacaaagcagccaggaagctccaactgggtggagcccaccacagctcaaggaggcctgcctgcctctgtaggctccacctctgggggcagggcacacacaaacaaaaagacagcagtaacctctgcagacttaagtatccctgtctgacagctttgaagagagcagtggttctcccagcacgcagctggagatctgagaacgggcagactgcctcctcaagtgggtccctgacccctgacccccgagcagcctaactgggaggcaccccccagcaggggcagactgacacctcacatggcagggtactccaacggacctgccgctgagggtcctgtctgttagatggaaaactaacaaacagaaaggacatccacaccaaaaacccatctgtacatcaccatcatcaaagaccaaaagtagataaaaccacaaagatggggaaaatacagagcagaaaaactggaaactcttaaaagcagagcgcctctcctcctccaaaggaatgcagttcctcaccagcaacggaacaaagctggacagagaatgactttgacgagctgagagaagaaagcttcagacaatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaacgcagaagcctcaggagccgatgcgatcaactggaagaaagggtatcagcaatggaagatgaaatgaatgaaatgaagtgagaagggaagtttagagaaaaaagaataaaaggaaacgagcaaagcctccaagaaatatgggactatgtgaaaagaccaaatctacgtctgattggtgtacctgaaagtgaccgggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcagcagaaactctacaagccagaagagagtgggggccaatattcaacattcttaaagaaaagaactttcaacccagaatctcatatccagccaaactaagcttcataagtgaattagaaataaaatactttacagacaagcaaatgctgagagattttgtcaccaccaggcctgccctataagagctcctgaaggaagcgcttaacatggaaaggaacaaccgataccagccgctgcaaaatcatgccaaaaggtaaagaccatcgagactaggaagaaactgcatcaactaacgagcaaaataaccagctaacatcataacgacaggatcacattcacacataacaatattaactttaaatgtaaatggattaaattctccaattaaaagacacagactggcaaattggttaaagagtcaagacccatcagtgtgctgtattcaggaaacccatctcacatgcagagacacacataggctcaaaataaaaggatggaggaagatctaccaagcaaatggaaaacaaaaaaaggcaagggttgcaatcctagtctctgataaaagagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagattttaacaccccactgttaacattagacagatcaatgagacagaaagtcaacaaggatacccaggaattgaactcagctctgcaccaagcggacctaatagacatctccagaactctccaccccaaatcaacagactatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacatactagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctaccagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagagaaaaagagagaagaatcaaatagatgcaataaaaaatgataaagaagatatcaccaccgatcccacagaaatacaaactaccatcagagaatactacaaacacctctactcaaataaactagaaaatctagaagaaatggataaattccttgaaacatacactctcccaagactaaaccaggaagaaattgagtctctgaatagacgaataagaggagctgaaattgtggcaataatcaatagcttgccaaccaaaaagagtccaggaccagatggattcacagccgaattctaccagaggtacaaggaggaactggtaccattccttctgaaactattccaatcaatagaaaaagagggaatcctccctaactcattatatgaggacagcatcatcctgataccaaagccgggcagagacacaaccaaaaaagagaattttagaccagtatccttgatgaacattgatgcaagaatcctcagtaaaatactggcaaaccgactccagcagcacatcaaaaagcttatccaccatgatcaagtgggcttcatccctgggatgcaaggctggttcaatatacgcaaatcaatcaatgtaatccagcatataaacagaaccaaagacaaaaaccacatgattatctcaatagatgcagaaaaggcctttgacaaaattcaacagcccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttcagctgataagcaacttcagcaaagtctcaggatacaaaatcaatgtacaaaaatcacaagcattcttatacaccaacaacagacaaacagagagccaaatcatgagtgaactcccagtcacaattgcttcaaagagaataaaatacctaggaatccaccttacaagggatgtgaaggacctcttcaaggagaactacaaaccactgctcaagggaataaaagaggatacaaacaaatggaagaacattccatgctcatgggtaggaagaatcaatatcatgaaaatggccatactgcccaaggtaatttacagattcaatgccatccccatcaagttaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaagcaaaacagcatggtactggtaccaaaacagagatatagatcaatggaacagaacagagccctcagaaataatgccgcatatctacaactacctgatctttgacaaacctgagaaaaacaagtaatggggaaaggattccctatttaataaatggtgctgggaaaactggctagccatatgtagaaagctcaaactggatcccttccttacaccttatacaaaaatcaattcaatatggattagagtcttaaacgttagacctaaaaccataaaaaccctggaagaaaacctaggcattaccattcaggacataggcatgggcaaggacttcatgtctaaaacaccaaaagcaatggcaaccaaagccaaaattgacaaatgggatctaattaaactaaagagcttctgcacagcagaagaaactaccatcagagtgaacaggcaacctacaaaatgggagaaaattttcacaacctacttatctgacaaagggctaatatccagaatctacaatgaactcaaacaaatttacaagaaaaaaacatacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcataccagttagaatggcaatcattaaaaagtcaggaaacaacaggtgctggagaagatgtggagaaataggaacacttttacactgttggtgggactgtaaactagttcaaccattgtggaagtcagtgtggcgattcctcagggatcaagaactagaaataccatttgacccagccatcccattactgggtatatacccaaaggactataaatcatgctgctataaagacacatgcacacgtatgtttattgcggcattattcacaacagcaaagacttggaaccaacccaaatgtccaccaatgatcgaccagattaagaaaatgtggcacatatacaccatggaatactatgcagccataaaaaaggatgagttcatgtcctttgtaggcacatggatgaaattggaaatcatcattctcagtaaactatcgcaagaacaaacaaccaaacaccgcatattctcactcataggtgggaattgaacaatgagaacacatggacacaggaaggggaacatcacactctggggactgttttggggtggggggaggggggagggatagcattgggatatatacctaatgctagacgatgagttagtgggcacagcacaccagcatggcacatgtatacatacgtaactaacctgcacaatgtgcacatgtaccctaaaacttagagtataataatgataaataaaataaaaataaataaaaataaaaaataaaaataaaaatacaaaaaaaaaaaaagaaatcaggcagactggatctggaatctgttctcttaacctctctctctgctcaccggtaggttatagacctaacataaagtagttgctcaataaatatttgttgaaagtataaatgaataaactaattaataaatactttatatgtgtcccactcttaactggggaaaattgggtgggtagatacaaaagaaccctagtagactgttcgctggcaggaatgtgttctagaggattggggaaagagaaacccccgaataactgtacgtgatttatgatgaaaatctttcaagtagtggaaagttataaaatgctaaccaaaagattagttatttggtttatatgttgatcactgtgatctttcccaatattgactggggtttgttgagtgtctgtaatcccacaggtggatgttcatgatctgaagtgacaatggtatatttgctcagcatttcctgtacctgaaacaacccttgaaaactgaaatagaaagagcaagtcaatggtaatatcatccagcactctgccaggcttatggcgaccttgcttacccgaaagcaaattacttccctctcatttctatataataagtactttacggctttgtgttttcatgcattgagatttccctaggagtctgagaagatgtccaggaataaaagagggaagaacaatgattaaactatttctaggactttagacattggattatattcagaaacccataatcagaccgttaatgaatgtcttcgcattcattatcagactctgaaaaagcatatccagtctctccatggactggccttcacatatgctttgctatctggtagaaatatctgcccaaaagattattttttatggaaataatagtgcacatgcagattctagatattattttctatttatcaactgcattcaggcagtgctaagtagatgactgatgctgaaattttactagatgatctttgctctctattttgttatatgacacatggggcaaatacgtgagatgagcaattagtgaaattctggaagggacagatttatgtcatactattgaaagggacaggaagtggattaagtatgatatatatatagtatgtgtgtgtgtgtaggtgtgtgtgtgtacgtataacaagttagtttccttttcctaccactgaaattgttaaatggaatggtgacgtagacactttacttctctactcctggacttactagtaaagaagaaatatataaaagagcaagatagtattgatctggggtggtactatggtatgtattaataccataccgtaattctatgatctattaatgtcacaaccagctacatttagctggcttttatatacgaatgtgcatagtactgttttgtattaaatatcaccagaagatatttgtcacataaaaacagtgagattaatgtttatatattttggcactcatgctagagttgaatgaggttctgtctgtggggataattctaggtatcctggaaaacctccacatatacaccaaacccagaatcaattcagataggcattactgttcgcagtcatctaatttcaagttagggtagtaggatatggattggggggcgtgattcttagtgccagagaaagattaaattattcatagggaaagatattcagcctaagatggataagactgaaatcaggtgcctggactctagaggattgggctctaaccgaaaaaaaaaaaaaaaaaaaaggagaatccagtaggaattcattgagtaagccaaggttacaatctgctggacttcagaggtagagttctagatgcccattttaccaccctaggtcagaagtggggagcagagagacagaaggctataagtgaggagacagtactgagacactaagtagacattctagccaactctgtagaggattctcatgttatgagctgaagtagaaaggctatgtttgaagattctgtctgattttgggcatcttggttctagatctatcataggtgcagattaaattgtttccaggctgtacttgatagttggtaaggatcaaacaataccctcacataacttgtcctagaactggttgtgctatggcatcattgtagtcccacatcctagcatggagcctaaaaaaaagtaggttcttcataaatagccaaggaatgaattaatgagtgatgggatgagtgtgagtggagaaataagcaaaattcctagaaatatggggtgggagtatggcagacaaacgttggcatcatccttcaaggaccagatcaaaatgccacatttccactacagctttctctgagttaattacttctctccactgttactatggtgatgtatttattctgctttaatagcatttatcaatcattttgtggttatattttatgatttctctcttcctcctagactatgaaatccttgactgtagaattgttggtttgtacctacattactgcagatagtatctggcaagggctgggctctcaataaatattgaccaaattgaggctgtaaagattccaatggaccaatatggcttgtgacccatgcttcatttacctaaatgaggccacaaggctctgtgatcacgtggcagtcaaataacaaaactctccaaaatcaggatttcttcttccattccttcaggttccctcccccatgggcatggttatctcatcctttacctcctggaaattatatattggaggttgtcagtgtgtgctgttctgtattgccctatagttaatgcacttctctgacgtagaggactgagctctctatagaactatgcagtgtcaaggaccctctgccttgacatagatgcttggaccacactgttaggtaactgagaagacaaagaatgtggctagaggctaaaagggacagagcaggaaaagcatgaagggcatgaaggaaggagcttgaatttttttcccaatgtactggggagcccaggagtggcatcactttgtactccagcagtgacattttaatttacaagccaagaatgcactgatcgccaactgcaaaaattgatttggttgttcatctgattcaacccatgtcagagtttgaaagtaattatgatagtggggctgataggcaggcaattacatttttgttctcttgctttctggctccttctccctctctttcccttcccacacctccacctgcaaggttgttcttgtcaggaaggcaatgtaagcaggagacgagagagtaatctttggagatgtggtatatggactcttgtggcagaggctataataaataatagtatggctggttctttatcctaatttttgttagcctcttatgaactctaaccagataaaagatgcaaactattttgtctccttctttaaagtacaaaatagaaaaagcacatgtactgtaaggcagtttctgtttctgatttaaatttgagttgtctttgcaacatctatagattcggtgtctttctaaaaaggtttgctccaaatcataatacaaaaggaacctgggatagggagagatttaggcaaagctaaaatccatctgagttggggagcagattccatgggagactgaaaatgtgtttcaaactgtagtgcaagaaattgaacaaagtattggaatttttctaaaaaaaaaaaaaggttcctttgctgaaagtagtacctggcatgtaaacctaaagtaatatagaagatgaagtggaaaagtatatcacaaggcaaaaattactttttagactgatgaagagatggatggatggatgtgaattttttttatctatttcttattttgaaggttatttatttattcacaaacactggaaaattcagtgtttttcactgagcaaaatagcttgtctggtccaaagccagtaaaataagaattttgtgggtggggtatctactccattagtatagcaaatgttgagatatataaattattttaatatatttattttattgacaatataaaaaaaaatttaacaggctccacaccaaggtcaatagaattcagaagcacatctgtcctcccaggaaacttgtggtttaactatttactatagctacctcaagattttacagaaaaaaaaaaaaatgagaccttctcttgaaaactaccatatcccagatctaggcttttctatgcactgtaacttctctataaacctcctttctactgactgccccacttcaatttggcacatacaccctttaaccagtaagcatgtgcatgtagtcagtgtgtcagacaggtttggctgaattgatataagactggtagcataggctgggcgtggtggctcacgcctgtaatcccaacactttgggaggccgaggcaggtggatcacgaggtcaggagtttgagaccagcccggccagcatggtgaaaccctgtctctactaaaaatacaaaaaattcactgggcatggtggtgcgcgcctgtaatcccaactactcaggaggctgaggcaggagaatcacttgaacccaggaggcggaggttgcagtgagctgagatcatgccactgcactccagcctgggcaatagagtgagactctgtctcaaaacaaaaaaacaaaacaaaacaaaacaaaaaaagatgagcagcatggaacatgatgttggcatgaggccctactacccggcagcagactatcagggaataaactagataaacctggaaaatgttttaacttcagtttattttattcacattaagtaatggagtagcatgttgtttgtttgtttgtttgttttacctctaaacctcctgtatagcccccttttaaaagaagggcaggggaagaggcttaaaatatggtagtattgactcccaggcctgttcagtctatacgaattttcaggctgtatagtttaaaaaaaacattgttcaatttcttatacgtttttactagtgatattactttagaaatgggcctcgaaagactcaggttacttttagatttgttcagggtttaaagcttcttttaggcacttcttgggcttcttctacctttcactgtaatatagtggtgaagagaaagactttggaatctgatagatttgggtcagaattgtagttttgccactcattacctttgggtaaccaagctctgtgaacctcagtctcttctgcaaaacagaaatggtgacatatttcctaagtctcttggcaggattaaatggaatacagtgcacaaaatactcagcacagtgcttggcacatagtaaatgccgaattaatggcaatgaattgttgttgttgttgttttctttttgagacagagttttgcttttgttgcccaggctagagtgcaatggctcaatcttggctcaccgcaacctctacctcctgggttcaagtgattctcctgcctcagcctctcgagtagctgggattacaaacatgggccacccatgcccggcttttttgtatttttagtagagacagggtttctccatgttggtcaggctggtctcgaactcccgacctcaggtgatccgcccacctcggcctcccaaagtgctgggattacaggcgtgagccaccatgcccggccaatcaattgttattgatttattactgagattgctttaaataaattcatccttatttctgttgtagtctttaccttgtctccagatctttggaagtctcaggttcatttgtctggactttgggggttttgtttaaaactgcctagtctctgcagccacatcctccaccactgtagcacatgatcaaaaaacttttctctgaggatactgagtatttcttagacctatgtcactagctccctgggaactctctctacccccatcccatcaactctctgaccacaagttttcaaggaatcttcctcattatactcatctatcattcttgcagttttctgtctcatcttgagctgttggtcaagagtagaccagagtatccatttctcaactcatttcttaataaggcaacaccatgttcaatgggcattcattgggccagttgaggctcctctgtaattttattttattttttgagacagagtcttgctctgttgtccaggctggagtgcagtggtgcaatctcagcttacagcaacttccgcctcctaggctcaagcaattctcctgcctcagcctcccaaagttctgggattacatgtgtgagccaccacgcccacccttctctataatttaaatgttatctctctttataacattttcataagaggatccacaattctattttcccattcacttataaagaacaaaaatatatccctaaggttccacaagtacctctggcctttggggaaaaaaaaaaaattcacagatgcttttttgaggaggtaattatttgtttgttgtgtccttgctattcattttgagatagatactcaagctctacacctcttagcttatataccagtttcaaatttatgtctttattatttattataaaatcttttaccagctgggcatggtggctcatgcctgtaatcccagcactttgagaggccgaggcaggcagatcacaaggtcaggagatcgagaccatcctggctaacacagtgaaacccggtctctactaaaaatacaaaaaaaaaacaaaattagccaggcgtggtggtgggtgcctgtaatcccagctacttaggaggctgaggcaggagaatggtgtgaacccgggaggcggagcttgcagtgagtcgagactgcgccactgcactccagcctgggcgacagagcgagactctgtccctaaataaataaataaataatctttaccttgaatattgagatgggttcaatacaatctcaatttagaatacttaaaagatgaaaagttccataaaataaattttctaatcaacagaaaacattttgttaagatgttgctgatgcaaataattctagcatgtatcactgttagttttctatctttgaaaactatcattcaactaccatcgtagttactagacttccattcaggatcttgcatgcctaagagtcatttcactgccaaaaatgaggaaatatagaaaactgagctgtgtttttatcatctaccatttcaaaaaaccctgtggaaaaaatatttcttttagcaaatctcagacattatcttgacttatatgtaagatgtacctctctctttaaatccaagtgcattgaaacttctggctcataaggtaatttttttttttaaataattaactaaacccttaaaactacatagaagtctactttgttttataaattaaccccattattttaggaattaatatagctttgtcttgtgagatgctgaagttatttttcctggttcttaatattcagtctttccgcttatctatttaattcctgatcactagccaaactatatactacagtttggttcatccaatttaaatagctggcctgtaactaagaaaagaaaaatatattttgtgaagaataggtatgaggtagagaaattagtggtagtatgatacgggaaaagagtaatgtcaaaatgcatggtaatttatgtgatatgccgaggactgcaagaagtcaagaaagaaacataacaagctaacagctgtcaccaacaaatagcaattaatttcagcattcattcccttgctcatgcttcatgaaagtatataggtaaacaggattcgtatcatgttctattttcttctctgggcctcaggcttccagccctctgagctactgtcttataacattctgaggatgtaagaaagaacttgatcctgttttctttttcagtctggagcagagacacggtgaagttcagtaaggtctgacacccattagcattttgtgtgactcaggatacgaatcaaacctactgttgtggaagcagctttccatataaatctaattcccaccaactcctgccaccaccaaagctaatagtcaagtgcttgtattgctgatagcaaaggtccaagattattcttattgttttactggggctacttatcaaaatctatttacttgtctattctatggatggggaggtggtaaagaaaaggcttaagtgtcctacagagattcattctatgctgcctcaaatgctttgaagcagtacaatttctcttttaactgcctcgatgtaggtgaagagtcttgcaggatatgttcactgctgaagagcaagcctgcctcattcataaccactagtagctgacaacctttggattctttccacagcttgaaaattcctccattccttgaaagcaccctgcactaatgctcgaagtattaagtgtgtttttatttcctagaaggatgcattttacacaagtcacttaaaagcttctggaagctttaattacaggttgactaatatttagaagaattgaaatacccctctctctcctctgtggtatgcatgagccagattctggttcattaaccagaagtctattacttttcccctatagtttcatggagtaaaatggtagatgcaaaccaagagaggtcaagggacctgagcttggttctgtctttgtcacaactaagagtctgaccttggatgagtcatggtaagactctgtgtcatatataaagagtattctgagagtaaaacacgcatacaaatgaaaagtatggttattatggtctcttgaatattcttagatcaatttcacccattggatggggctagtatatggttgatggatggtatttgtttcatttatctggcatgcatttaaatcttcaggtgcattaaacgaacaacacaaatttggtatatgattttcatgctctcttgcatgatagatataaaatcttaatcagtgattgtctggaaaccacagtctccaaaatgctgcctaggagtgctaaagagctgtcagatctaacttatatgagttgacaacatagagaagagaaagaagttgaattcagttaaacctggaaggagaaacccatagggtggaattatctgaatttgaatttttctgagttttattcccccctacattatgacacactaataagtggtctaccttgacccagagatacgaattttggcctcatttgtagaatagcacctggattcaggaataactccttgaagtgtcccccttaaatctctatgtggcattcaatgttcacttactcatagaccaaggagataaggacatttatcttctcaggtaaggtccctctgttgaacactgaaacaaaggggttacattaccactgcctatctttcagaaaaatgactgctgtgatagcataaatgtcccgagagctttgctttgatagaagtgtgtttttaatgatatgattttggtgtctggccctctgtggatagcttggcatgtgtcttgttctatttaaacagcactgactgataaagtggacgttaattggcagttagtgacgaggctgcaggtctttgttacccagcctttcagctaactgatcattaactaggaggaaatgtgtgacccagaaggtcattactgttattacgtgggaaaatacatttaaatgttacagattgcttttttatgaatcaggtgagcatttttagaaaagagagagcttgatttacaatggagtctgttttcagtcctgctcttttcctgtccctttgaagactaaacggtatatttctagattcccattgctgtattgcctagaacctcacaatgttgatattgactaaaaaacagaaatttcttcaactccattaagagcttttccaaaatcttaaaatttccaaataaaatcctttcgtctggatgccactcactttaacaagctttgagtaactttttttaatgaaaatgtgatagaaagtaatgtaactgcatatgttttattatgtaaaattctgatagtatcatgtatgtctttagaatttccgttgtcacacattgtctgtgctttgtaggattttgcagattaagccttagcactcattttgtgaggacagtgaatcctaattcctcttcttcattctttctgtgacctttttgattttgcctctttagtaatctcctcactgcccttgtaatgcaaaaaataagaataaaaatggtctgtttgggtgctgtgagtcttggcaattaaaacttcacatgaaatttgtctcctgagagaaaatattattctcccttttaataaaaggatacaattaaatactccctgaaacctctctccttcaaatatattgtcttatgtaaaagatggaaatggagccttgtttagctgaaaaactgaagagccaaaaacatttctaactataaattagtttatgcatattaaatatcccagccttagctctaataaaaacaaaaaaaatgtgaagcatggtgtgctctgtggttattaacctgttgttgaaaccctgacttcagttctaggcccttagcatgattacttctttccttctttgggttgcatgatgcttcaaggtctagaaatgccaatgtctttcccaaggggttttaccttttacctctgaagattgaagaaagcaactgagttgttcagaaatctctttaaattagatttaaaaggtactgggtttatttttgcatgtcttctttattttttcctccaaagattaagattgtattttagaaggctcttttggctcctttaaaaagaaagtttatccttgtatcatataggactgaaggagataggctgcagtttgaaggcaagagcatctgatctccaaagaatcagaaaatctcttcttttgttgcatttgtaggtactttttgttgtgttgcttttttttttttttttttttttttaatacaggtaaagttcaaacgagcacagcatggtccaaatggtgtttaaagctgtctaagtttcctttatgtaactttcacttcaacaagtatgttccagctgggagtctatcgggctgttaaaattaactttattcttcttttgttattctcatgcacacacacatacacacatgcctacatgcacatgtgcacacagacacacaggtgtgaacatgaccatttaatcacatccagcagggctgaatgtcactctgcggggctttattgactgttgtacaggctaaacatttcattcagttgcaagacagaaaaactctgcaggatgaatttcaaaacagagagcagaattgttacccacagataagaattctttgtaaggctttcaccttctcataaaagtgttagttaagaagaggtgaaaacaggtattccattcatctctgaagtgtatgcagtaatggcctcattcggctgagatttcccagcagcaaaaaatgtgcttggcagaacagttgctctaaatacctgggacatacattctttctaggattaaacaaataatacttgctgccctttgtataaaaagatcacttttctggtgcaccattagtgtacatttgatttgatttgtttgttaagcagcaaaggtgggtttccctggagccacttacacctcctctcggtcctctttgcctctggctgtatatgcatgttcattctaccacctgatgacttcatgcttactctgtgttctaactaaatcgaatgagtctcttattcccattccttcctttttactttcctgcctctaggcattaatttgtgccatttacctggactatctgctcccacctttgactattaatatcctatttattattctatcaaagccaaagaccatcatccccatgaattcctctgacatcccactcagaatctatctctctttcctcagagcacagttttttttctttttactatcatttaaggacagttaggccaaacacttacctacttaattataagcttcttgaggatttgggccacttcatatggcttttggttttccccaaagcattagctccaaaaagaaaggttgaatgaatgattggtgagtcatcaaccttggcatagttgggactaccctttgagaccactaaccagaatttttctcaatgaaatgaaatttattccccgacaaattgactgcaccatgttagtctccttaacatcatctgctgaaccatctcttaagaaacactttgatactagatggtaaataaccactgtgtcaagacctccaagtgccctttacctccaggtcacctgtgttcctgcagcaagacacacctctgtccccaccatgaggcagaatgaggcttgggacagataagacttccagaacccagctccagcactgtggccactgtctgattaatcagttcttcttctgcactgataattaaatactcactgttaaattttatattacccttgctagtatcattgttataaccaatgtgacagccacaaaagagaattaaagctatagactgtttatggactgtcttcacttcagcacagcagggaagaaaccagggatctgaataagtactagggatccttgctcattttcccaatttggctacaaaagttaatgaaattggggccaacgcttaaaatgcagatattgttatggatacattttatgatataaatagagatacacttgtttcatggaggggtaactagggacttagatttcatttggacctatgtgtgccgagcaattggaagcatattaaaactgttttatgtgtaagcatttattgcttttgcctataagatgttgcttatgtgggaaattaagagtccagtccaatgtattcctgggtatacagcttatgaaggcatttaaaacctaaagcatatttattctgcatttaaaagtgtttagagactgccttgtgtgttaatgtgtgctgtgcgactagcactatttaaatcctatccccctgcatgcattaatgtgtgcgtcgaagggaagaagagcaagggatgataaactctgttaactgcccaatgttcaactaagatttatgtaagaaagaacagtctagtgcattaatgtgaatattctaagatagatgtttatcttaatggactcagaggtacttacaaacagcataattgctgaagtcattttacagggcatttattcagagtgattacactactcttacttttctttacataaagaattccacttaagggtttaagtgagacaggctagtgtggccaaagaatcataggttcctcctatctgctgctcagcgctaaggctatttgaaaggaggagaagcaaaaccccaaatctccattttggcactttgcaagaaattggtccaaatgttcaatcactccagttttcagatctacatgatatttgacttactttaaacctatagtcctgcaaataagaaatttatctctctggtacatggttgtagaattcaaacattagttgtttatggacttttatggaccactgaggcattttctgtcttgaaagcaaatgtactcttccagagaaactcctgttctttttttaaagttttatttttaactgacaaattaataattgtatatataggtacgacgtgatgtttcaatgtctatattcattgtggaatgatcaacccaggataattaacatactcatcacctcaaattctttgtagcaagaacatttacaatttattcttttacatgaatgaattttaaaatatataattttgaaataggcaattcattattaactctagtcaccatgctgtgtaatagatcagaatctacttctcctgtctgaaactttgtagtcttcaaccaacatctcctcattccccattgacctttcctttctcagcctctgataaccaccactctactctctatttctgtgagtttgactttttagatttctacatacaggtgagatcatacgggatttgtctctctgtgcctggcttatttcacttagcataatgtcctttagctccatccacattgttccaagtagcagaatttcctgctttttaaaggctgaatattattccattgtgtgtgtgtatatatatatcacatttaaaaaattttattcatccattaatggaaaaccttcattcttgaaaaaatagcttataaagctatttatgtccctgatacctccaaagatcagaatgagtaataatctcacaaggatgggaaatacttcctctcttccaccttttgcatgtccatcctttgaacatgactcctggtgtgttagtctagtctgttctcatgctgctaataaagacatacctgagactggctaatttataaaggaaagaggtttaatggacttcacagctccacatgactgggggggcctcacaatcatggtggaagacagaagaagagcaaaggcacatcttacatggtggcaggcaagggagcatgttcaggggaactcccctttataaaaccatccgatctcatgaaacttattcactaccacaagaacagcatgggaaaaacccacccccatgattcaattacttcccaccgggttccctcccatgacacgtggggattatcgcaattcaaggtgagatttgggcaggacacagagccaaaccatatcacccgtcttacccaattctgttgaaataaacagacatttcctgagtacctgctatccattcaagttttttctatgagctaggctctggtccaggagtatagtaaccctacgggtgatttcagaccaataataagtaacactattaagaacacatcacagaagagtaacatctctgactcgctgatatccatttcaaaccacataacaatagcatgaagtagatgtcactgactcaaattaacagaagagaaaactagggtgcagtgtttgtgattaccttggactctcaccataatagactgagctcatgttttctgactcaaaacacaaaacttttcccttgatatagttgcctctagaagaagtcccttgtctccctcaaatagcaatcaagtagaagggaaaatagtgtaagtcaatatatattaagtactttcagtgtgattccaagaaactattgagttgcgatgctaaagggagcattttatttttcagccttgggatcagaaaaacattacataaagaagtgtttgggttggaccttaaaaaaaggtataccatttcagcaggtataaatggaatgaaatgcaaatagagttgggtaaggagcagtataagccaaaacataaagttatgaacttaatacccttgttcagagaattgaaaacatttaatagtcagtatgtggaggcatttatagggacaaatggtaatggaagatgatactacaaaattacactggagtccagaggtggaggatcttgaattttaattttttttaagtctagacttttgatagtgagataaatttgaaccaacagagtgaaacatgaaaactatatttttatcctggaagtactttctagagttcattaacaggaggaggtaagggtagacagggagtctgggtagggaattttaggattcatccacataagcaaccagggaagtaggaatgaaaactggagtaacattttagagatggctttgcaggacttggtgcctggaggtgtgacggggagcaggaaggatttgttacaggaaagaggtcccgacttagaccccaagagagggttcttggatctcacgcaagaaagaattcagggtgagttcacagggtacagtgaaagcaagtttcttaagaaagtaaaggaataaaagattggctacttcatagacagagcatccccaagggctgctagttgctcatttgtatggttcttgatgatatgctaaacaaggggtggattactcatgcctcccctttttagaccttatagggtaactactcttgtcccttgatgatatgctaaacaggccatggcatttgtgaactgttatgtcgctaatgagagtgtagcagtgaggatgaccagaggtcactctcatcgccatcttggttttgatagattttggctagcttctttactgcaacccgctttatcagcagggtctttatgacctgcatcttgtgctgacctcctatctcatcctgtgactcagaataccttaactatctgggaatgcagcccagtaggtctcagcctcattttacccagctcctattcaagatggagttgctctggttcaagcacctctgacagatttaaagatgaccctgagagtttgggcttgttcctagagagtaaggacaccatagacagaggccaggaaggcagcagagggaggagttaatcaattcagtctgggatatgctgactgctcatgtttccaagatatttaatcaaaaatattgtcccttatgtgttagtctatgttctattactataaaataaacttctgagactaaataatttatagagaaaagaggtttatttggctcacagtctgtaggctgtacaagcagtgccagcatctgcttggcttctggtaaggcctcaagaagctttcactcatggtgaatggcaaacagggagcaggcatgtcacatggtgagagagggagagagggagcaagggagacaggaggaggaggcgccacccttttttttattatttaattttttgagagggtggcacgatcatggctcactggagcctcaacctcccatgctcgagcaatcctgctgccttagcttcctgagtggctgggactacgggcctgcaccaccacacctaatgtttaatttttttttaattttttgttgagatgggatttcattattttccccaggctggtctcaaacttctgagttcaagtaatcctccctccttcatccccaaaagttctgtaattacaggcgtgggccactgtgtctggcccaggctctttttttttttttttttttttttgagacagagtctcgctctgtcacctaggctagagtgcagtggtgtgatctcagctcactgcaacctccgcctcccaggttcaagcgattctcctgcctcagccacccgagtatctgggattatagatgcatgccaccacacctggctaatttttgtgtttttagtagaggcagggtttcaccatcttggccaggtgggtcttgaactcctgacctcatgatccacccgccttggcctcccgatcttgtgatccacccgccttgacctcccaaagtgctgggattacaggcatgagccacctcacccggtccagctcagactcttttaaacaaccagatctcatgtgaactcattactatggggagggcaccaagccattcatgagggatccacccctctgagccaaacacctcccaccagccccacctccaacattagggattatatttcaatatgagatttggaggggacacacatccaagctgtggtgggcattgtaatcacggtggagctttcctcatcaggctgatacccaagtcccacccctgggtattgctagaatgtcacctggtgactaatgagtgccaaaggaggagaccaatcccgtggcgcccttgcatcctctctgcttgtggttgctctctctgtattgttctctctgttatgattggctctaacttccattaagagaaaacttgacctgcagtgactgaagacaggatacattttcttaaacaagaattccgaagtttagagaacataaaactgcttaatttggctcctataataggagccaaatttttattttataataaataattataataataattatatattgtaataattataattaattatatattgtaattataattaattatatattataataattataattaattatatataataaattattttattctaatttattttataattgtcaagtttaatatttgacaatatctgagtcagcttcccagttcttttcttggctttccccccaacttgccaccttatgggcacaagctgattgctgcagctccacatgtcccgtgcaaacccaaggaagaagggaaagcagtcagaccagccaagtctttttcgttttatcaagaatagaacaagcatttctagagcctctagaggatttccttgtttagctctttgtccagagctaccacatggccacttttagttgcaaaggaggcttggttaggccggtcacattgccagctctcgcaaggaggaagaggggaatggatattgacaatgtctgcaatagtcatcttccctgctacgctgaaagcactttaaaggcaaggaccaagctccgtcaggccatacttatgtccgtgctatgccacacttctcacctggcactttgctggacatatgaagacctgagatgagaagggtttgaggagacacttcctgcccactgtgctaagcactttcttgtgtcttttgggttctctgagcagctgtaggagtatagaagcctccagatatacgttaaactctttttcagcacctctcaaaacagaaaaaaaaagcaagaaaaagactacaagctgggaggaaatctatgctgctgtaaaaatagaatagggctggagtgcattcttcagtaatgaatgcatgaaaagcagcctcttcaattataaatgtggcttctcttgtttgttgcccagtaattctgttttattgatttctgtttacttccaatcacctcaaatgagactgtgttgcttagagatcttgatccctaaaagtttgtcattaaagctactctgctgtatttagttattttttgctcaaagcatttgaatcaatatgtatacaaacgaaacactttttcctttgctccctagaagactacaagaaaaaagaatctagaaaaactaaataaagatgcttagatttttttaaaaaaagtcccagcaaatgacatattgatttctttcaaagaggcagagtgtaaattaaaaatatttttctgacacagtttttaaagatgccactgactcagcagagtttgtgcttattgactttctcttcctagagggccagggtggaaaggccgcccacttttcctaagatcagctggctttcaaaatcctttgagggaagttagccttaaagccaatgcgagcaaaggttcttgattccctgtgatcaggtctgagttccggttttgtcatctaccacatcacttctgtgtataaaaaggtgttgtaatttttttttccagaaaattatatggtcatcattctttttcaaagtggttgcattaaaacccagaattctcagaggtggaaataaacaaaagctgcgcccttattagagaatactctctggaatgttattaaatgggtctgggcagatagagaggggagttagagtgggagcatgtgcattaaaagagccacaccaatacaggaatactagtgctgtttcctcctggtacctttgagagaataaagctagtttagacccacagtcggccgggcgcggtggctcaagcctgtaatcccagcactttgggaggccgaggcgggcggatcacgaggtcaggagatcgagaccatcctggctaacccggtgaaacaccatctctactaaaaatacaaaaaaaaatcagccgggcgccccagctattcgggagcctgaggcaggagaatggcgtgaacccgggaggcggagcttgcagtgagccgagatcaagccactgctctccagcctgggcgacagagcgagactccgtctcaaaaaaacaaaaacaaaaacaaaaacaaagacccacagtcatgaggctaggagggaagcacgagggacctggtttcaggaacataatctatttgtcataatttgagtttctgaaaccatgtcacactcctttggcctgttcaaaatcatttttcagaactgttctcagggttagctatataatttgtggaaaccaatgcaaaataaaactaagggcccccttgcccaaaaatccagaaaaaaaagtgttaaaagtgctagaatagaatttcttttctctttcttcaatagtctatttgttatgttttttatttgctattgaatgacatttaagtaaataaaaatgtaaattagcatgaatattaccattcgtccttatattgtgtgcaatgccagttttaaatccagatataagagcattcagctcaaatgcagaatcattgaaataacacaatttgtatgtcatagcccatatatgcatgtgtcttttgttcttattggaagagtggaaatgccatccaaaagtaacttactgctttttgtttcacttcttgatgcatgcacattctaccaacgctttttaacttcagcctaccgatgcatcaggtagaaccaaaaacaagaggtctcttgccctgtgcaagccaagcctttctgattagcaatcctagagagaacaggtggctcacgcctgtaatcccagcactttgggaggatgaggcaggtgaattacgaggtcaggagtttgagaccagcctagccaacatggtgaaaccccgtctctacaaaaaatacaaaaaattagcagggcgtggtggcaggcacctgtaatcccagctacttgggaggctgaggcagaagaattgcttgaacctgggaggcggaggttgcagtgagccaagatggtaccgctgcactccagcctgggcgacagagtgagactctgtctcaaaaacaaaaacaaacaaacaaacaaaaaaacaaaaaaaaaacaagaagaggtctccgggttgccctatctttccctttcatgtcatcgtctttactgtaaatggttggttgatacagagacttaagaaaggatgtgataggttctcctgaatgccattgccttctctctgtcttctaagcaacttctggttcaaagggagagcatgagctcctggggatgtcagtgttcctactcagcctgtagatataacatccttacctattatacagaggacacgatatagaatccggagagaggaaaagcaaaggaggccagctttggcctgagaacttaccctagtcactcttgcctagaagacagtaccaacctcccaaggagaaacattgggggataaattcaaataaagctgtttgattcagattactcctatatgtaagtgaatccacaggatcctgtgccattggggcatcaggaacactatatgaggatgagcagcaaggaatggaagtggacacacacattgcatgtatctcctctgcttgctttcatgccgcactgttccactgaacttcacttacaaaacacaagtgcaaagataaatgattaggaatttcaagatggtaagagcagagcatacaacctaacaaagggtctttgtgagcaaaaaaccctgtggatgacctcatggatctcatgcctgtgattacacctgctacatttccaacacccattttgacagcaaatgagtgttgctgtttatgaactggaacggggaaaattattagcctcactgtctatcagaaatgagaaacaattcatctcatctctttccacatagaagttctgttgtgtttgcttttgtaaattattttgaatcaatatctaagatgggtttatctatttactactaattgcagcctgggaataaggatgtgacttctggggttgagtgggcccatctgggtttctgaacttctcaatttaatagcacctgaagacattccctacctagagattttttatataaatcatagagctttatgggaacccatcctcccacatttctctgtgggaggttggtatttccttctaggcatgaatagggataaattctcaatcgaaagctgacctcctctgcatttttcctctactgggacttcataccatgttctcaaattgactctcatttttccttcatagttctgtctcaaacttactggccacagatcacttgtaactccctattttattaagtccagtttcaaataccaaaacttgctttaacttctgctattgctgtaacacctgtctctgacttttctaacattatattacatggctgagtgggatatactttttttttcacagtgtaataaggaaaagatagccttgtatttctagaagttgtattttatattcacttcattgcatttgattgttctggataagttttctgtgccacatactaagttttgggatgtactaacatgcactcttttcttgtgtttacatcttcttgagcttgcatctctttcttagagggaaggcatgagggaggaaaataagaagaaagaaagggaaaaagggagggaaaaaagtagatttggtctttggagcttcagttaaatttcccttataatggttagaccctaaatactcaaaatgagtatttgtggtgaaaacaaaagagctgacagtggaaacacagccaagcctttctaattagcaatcctagagaggacagcaccaataagaaagaagagcagccatcaaagccaggcctttatatgtatgtaatcaacaggcatctgatctagattcttaaagatggtgtggtttgggtgggtgattttatttattttatttttctgtctcctaaataatatgtaatttcttcaggccaagaaataaattgaaaggatttagagggatttgcttatcagtggaacaccacgtagcattacattcctcctgcttttgggaaggtacattgaagtttggttaatcttctgtggttcaatactcctcttccctctgtcagcctgccttgaacaacagattaatcccttttccacccactctcttctccttcctccctcccctctctcttgatctacccttccctttttgagcaaatagaagaaaaatcttaaaagtggggggaaaaaaaaattaaactgctgcactacatttatttatataatcctagaagacctcaagggtagaaataaaggatcccaatcctcggcacaaaatttggccaagcttagcttggtttttctactgttaattaaatcttgagtctgcaaagggatttccttaaagactaattcattagcaaaagttattataagtcacgtcattctttatcctgctctagtatatgcattgtggaaaagaagaaaaagaatatgctggctattgaggatgggtagaggttttagggagtgggtgatacgatttgcttgaattcctatgtagtctgctgtctttagtgacaatgaataattactgttgggtgacgcttatgagcccaacactaattttaagattttatagctaatgatttggcaactaatcagtgttttctggtttgacttggcttaaatctcagtagtctataaagtccatgaggacaaggaccaggtcagcctggtcccaagcacagtgattgactggcacatcataggcaattaataaacacttgtcaaggaaattagtgagtgaatgagtcaatgcaaatgtcagtacaaatgtaaataaaatcatatattcagaatatttttttaattcagttttagagagctctgttccaataacctaattttggtcagacagaatgcaatatctttagctcagggtgattctctttaaagctatctcatttcatggctatatgagcaagtaagttatgcatgtagtcatatcttggcaagtgattatcttcaggagtaggtagagggaagaggggaaagtaatagctggaagaacccatggcataaaccttgtaagacagttttaaaattcacagggtgttgttccaatcgaaatacttaagctcatagacataggatacaagggtcaccttagatagtatcttaacaagactagaattctgtcccttcacctccaacattcaggacctgcttcatgagatgcccccatctttcacacctgagtatgacaagttagagtcatttatgtttcatttgatcataacaatgtcagtggctttcaaaggtaactataaatgggatgtttaatcagaataaaataagagtataggtatgacagtcatacaatcttaccacactgtgaggttgtttctgtattgggcttaaattgagtgagtgagagggatgggggagagagggagataatggcttctaacaagcttgcccaagctctatgttttttctagttttgattacatataaaaatcattggcaagacatagtggctcatgcctgtagtcccagcactttgggagcccaaggtgggtgactcgcttcagcccaggggttagagaccagcctcggcaacatggcaaaaccctgtctctacaaaaaaataaaaataaataaattattcaggtgtggtggcgtgtacctatagtcctagatacctaggaggctgaggcaagaggatcacttaagcccaaggaggtcaaggctgcagtgagccatgattacgcccctgcactccagcctaggtgactgagagagaccctgtctcaaggaaaaaaaaaaaaaatcatccagttgtatgtgtgggtattagcactgatcaaagatgagactgtgatggccacaatttagtaaagaaaatcttaatagatacatttaaaaaaaaggtcaaacttttcaaatctcattaaaggttataggtttacttagagtcaataggtattaggtaattgaaaaactcaggcagcttgtatttaaatagagaatgaacattcataatgaagctagatgggtcctctctcatctgagatattcagagctccaactccatctcagaatgaaggtatagaggggaaagaactaaaacagcaaacatttaaaggaatttaattctttttagcgtggagcagctgcagagatgtatggctgttttctgtggggcttcagaatatttatgggcctttcccttttcctttttcaccggaagaaaggagatcatcattcttgagtgtgttatttataatttcataaagctgttctgtggcaggacttattttatctcatactaaatctcaaataactgtgcttccaaggagatgggtggggaaaattgattatccctcaaaatgattagcctattaccagtgtaagataaagagctgaagggtggaatttgaagttacaaaaggcagttgggcagtaaggaggggacagagtgaaacggtcttgagcagttctgatcacagctcacagcagtagacacttttctcatgcccaataatggattaataacgaagaacagtgtagaaccattgccaagaaagggtaaaacccttctgagtacataattagaagccaatgattatagaagcaataactcactggaggaaaatacgtcagatttgtgaaacttagggaattggaaggtaaatatacccataaatttacttgggtggacagagttctgagctttcttctgtcccagctttattctaaggtaatttcaataaacaatgttaggaggaaaaaaagaacataaatgcaataaaaaatcttccaggaaaggaatacatagggctcctgccagacagatattttattgaaagttattataatacctatctttagttttatgagtcctaacacagaacaaagtaatttcaacacgtggattaaaaatatgaaatacatattttaacatgtagtagtatgaattattgttttaaatataggacttggctaatatataggggcagaggaatatttttctccccttgagaaagcaagttaaggtgcttaatatgcattgtgaaactgcattgcagtcatactcatgcactatgttctataaaccatgtgtagtagcttccaaccaaatgggacagatgacactggtgagatgcagggagtggagaaaggagagaagtctgatagggcaggacatgaaattcatgctcagtatctaagttttcaagaacaacatagctcaagtagtggtcacactgtcattctagtccatcccttccctccagtcatcctctactactagtgggtgtataaataaaccgtgttttagacctctaagcctttgcaaatactatttcacctgaaatgcccttctccttctccagcccacccgtcctcacttccttcccctgtctcaccactgcctgtccctgagggctcatttcccacatgctctctgccttcttgctatttccttccttcacacattaatgcttcctcttgtcagagcattcggtttactacatcaagtttgcctgtttacttgcctgtctcatcagactgtgaattcccagagcagaggaactgtgtcttatctatagctttatcccttataactgttaaagtgcttgacatataggtgtttgaaaaagattcattaaagtaatgaatgaatgaaaaaagcaccttgatgacatataccactgacagtaaatctaacagcccagccactgtgaaaattatttggtgggtggtcatagagtttttaaaaaatgcttccttgaataacttatagagaatattggtatttgacataggggaaccatcatacgtcagcactttaagcatagccattgaaagttatgagagctttagacaatcattgtgaggggaaaaaatgtgaagatgacattgaacgcaacttgataaacattcccaacgtaactatgaatagaagagtttcctaaagcaacactgtttcctggaggagcgtggatggtggacagttaaaaataacaattcactacaagtgtttatacccttggttacagtgaatactaaattaatgtgaattaacagctcagcacaaagcctaaatgtagccagtgtttattaagtggtaaatgttattagtaggcatgagtctagatagtctagatatccatttctttgcaggcatactaactgctctttcttctaagtaattaaaagtaattacagacaatggttgtgattataggaaaatacacagacatgcagcctaaggctaccacattttattaaaaggcagagatccaccaatttgttctacttatagcaattctattctgagtctgagtctatctgcaacatgaaacctgttttacaagccatggaaagcaatcaaagaagtgtgccttttctttcaaggttcaacatcagatcctgcatttgcttacatctgaaaaagaacacagactgaaaaagccaaaacaacaacaacaacaaaaaactgctaaaagaaagccctgggttttctgaaagtatctttgaatccaattgccattaatttaggatatgatcttaagccgctcatatcatccaaaagccttggtttgtaatgtttggattttctagatgttagggacaaaagtagtttcaaaaaagtctaagtgtagcattcctaattctaagcctttttgcaaattaaggcctctggcagaggaagtctttccatactacacagtgttctgtggcaggtgtggccaatgttgcatgccaggttcttgaggaaaacattggttaccaaaacaggcaaagagggactgagatgtttgtaactgctttgggagtttcagttggctgtacctctaagtggtaacgatgaggtctgaaagacacaaaggaaggaactgaattcatataagacccacacagattgtctagattcacagccactgagaacagatcacctttgaatgattgtttaagctctttatgagtacatttttctttatcactcctcatggcaggtgcaaccagaaatagtatgtgtaccataaaatggaagtaatgaattgtcagcaacaaagaacacttctaatgtggggtaaatcgtaacaaatagagcacataggcagataccaaatttatttaaattaggagtggctatcaggcttggaattactttgattgagaggctgatgttgattaattgtgaagttaaactatgatgttgattaatagtgaagtaactaagtgacgtgtgtgcacgcacacacacacatcccaggtcactttctgaatctacgtagaggagttgggattcacagttgtgctatgtctagggccaggcccattcttacgacacactgctggatcatttccccttcaaactcctttgagtctgggcaccattgctaggagctactggtaaaatgtggttctgttgcctgggaagaacactgtattcacatgtactcatatagaagatcaacagaaaacaaatctttgggcaaagtggagcgcagagagggttaaaggtggaaaaagggggtcagaaggtgaaagatgatgtgtggggtctgcaatggggattaggggcccattcatgggatggaattggaggtagagaaggggtgggagagtggggctggggatggtgtcacctaaaccacaggggagagaaacttagtagtatgagaggaagccaaggaagctgagaggaagacagtatcttttcaacctcagagtctactcctttttctgaaaaaaaaaaaaaaaattacatttcttcttttggcccatgcaaatgaagaagtctcctctgagttaaagattcaactaatattatgttaatgtatgttttggtttctactgaagttatgcattgttttttaaacatttgttcaatggcctttaaactttattgccaggctttcagttcttgaaaggagctcattagattttcattaactcaccagctttcactcaatactagggaccaaagtcctaccgggccattctgcaaggcccttacagtcaaatcattaataatttccagttgaacacacttcagcagtgtattctcagcctctttattaccaccatcctaaggagttttttcagataagttttccccctaattgcccttttcccacaacatttcaattccaaagatatactacatattcatttatgtaactgtggccttttggagggtcacaaaccattgtaatatttaagattgtccctcagcccaaaccaaactttcctgcctttggtgggagacattgcccctataaagaatgcatgcttaaaaactactaaacaatgattgtggtccttccaaaatagtgttttcctcttataattgccgtatttatttcaacagttaactcttttcccacttaccagctcctttccctaagtaactagaagtagagctattatagggccccctctcagcaggaaacaccaagggaatatgcttaccatgtctctaacacaaataacagccccccaggatgtaactaccagtttcagttgctggaactgaaatgaacaattcagtagtgtgtgttttttttaagtatgtttaaaaattcttttttcggtgtggagaaggagagcatcaggataaacagctgatacacgcggggcttaatacctaggtgatgggctgataggcgcagcaaaccaccatcgcacccatttacctatgtaacaaacctgcacgttttgcacatgtatcctggaactttaataaaattaaaaaaataaaaattctttttttctgctagccttgaggagcaaggtttgaattatacccctttcagatgtagaataaagatcaatattgttgtgtagggcacttctctgccattgttaattaaatcaatgaattatctaatgtggtttttccagttctttgctgtgtccagtaattccatacctaggatgtctatttaaaaaaaggatgttttctggaactcctaagtagaaaggctgtcatatatattcatttattagggttgtcataacaaaatatcccagaccaggtggcttagacaatagaaatttatttcctcgaaattctggaggctagaagcctgaaatcaaggtgtcagcagaattagtgtcttctgagaactctccccttggcttgcagatgactatctgccagcgtctttatatggccttcctcccactgggtatgtctgcgtcctactgtcctctttttagagggacacaagtcatattggattagggctcatcctaatgcttcattttaacttcattacctctttaaggctttgtatcaaatacagtcacattctgaggggctggggagtaggacttcaacatatgaattttgaggggacataattctgtccataatgtaagaccaggtataaagaagcctattgcaagccacaaacacagaatttgactaagatgtatttattcaaattcccactatgtgttttactagctgtatgtctttcagcagctcacttaacctaactgcaattctaattagtcatgtaatagtcatccctgtcccaaaagacggttgtgagaatcacgtctaattaataactgtaactaaaaagtgtgtgtgtatatatatatatgtatatatatatatgtgtgtgtatatatatatgtatatatatatacatatatatgtatgtatgtatgtgtatatatatatgtatgtatgtatgtatatgtatgtctaggacagcatctggcttgtagtaattgctcaatagaaggggagtggtttattacctcttcctcttgaatttggatccagactttagtacatttgggaattggaagatcaacaagtcagtaaatattggtcacatgaagaaggggaaataaatgagcattattgaactataatatattgagtcttcttatgcacatagtaggccaaaagttttgttttttgcataagatctgtagattcattcattcaatatttattgtgcatgcaatatgtaccaaatacagaaagcagtcatctcacctactgtatggagggctcttctcacagctgatactcagtctcctatatttcttgtaatagattccctgggactggggagtttctgcgagactcagaatttaaaaggtgcctcaagtcgaactactattattgcagtcagaactgtttttgctctcttcaggaacagccttacctgtgttcagggactattgtgtggtatcatgctactggtctacattaccaattcagctattgcagcaattacatgaaggaattcttgctaatgataaaagccattatgcagttcctaaagagaatgcattccacagcattcattaattatgccagcctgtagatgcacaactaccacggcatacacttgagaccacacaccataaggattgaaactctctcaaagccacaatgtatgtctgtgttgctttgcactcttacattgcccatcctttacaacagcccttctcctgtccttctgattcctaaaactcaaaaccagaatgaagtaaggctacaaaatgtcatttatggggatgggtgaggcttaagtctcctggaaccatcttgggtcactcagctctacggaagacccccctaagacggtctagacccagagtcattctcagtcacacagtagttaagaattcttcatcctacggtatgccctctctagaaaaataatcgtaatgatgggagatgggacacagtgataaatctttgatgtctttgttcattagtttccttatctctctctcttctctctcttcccctaccccattattttctctttgacataaacagccaacatcagatgatcttgtttcatctgctgaatgttcaagtgatgatgaagactttgttgaatgtgagccgagtacaggtaggtcaggtcagtcttattttgcttgctttcttttttcttttgcaaaaaacaatacatacatatatgtgattatacatgtgttttatatatagattatagtgtgttaatgtgtgtatatttttatatctatatatgtataagtatacatatataaatattatatcaatgaaagcatcaaatcccatggaaagagcaataagatcctacaaaaattaagtcagtctcttgatagctaacaaaaaatcatggtatatgacttaacattgggcaagcagatgcccagacttaccactggagcagcaaatgtgtaggagccagtggcagctatgaaattcacagagggtgggaacatgaggaaatatatgttggaatgacatcaagaaaggatgaacccatggaggagcttaaagattggtaagtggagccataaagattggtaaatgacttaaaactcatgaattattctgagctaagagaaccaaaaatatatgtatatatatattttccatgggatttcaacagcagttaacatggtattatctttgtactaattttgttaactgtgtgtctagaaaacttgtgcaacaatatagtaaacacaaaattagtgctgtaccatgccgtgtcaacagctgtgatgcttcaaaatgtatctactgtgctgaagttgagaagactttagcaatcagaagcttcaatgtgttccccatttggacccagatacattttgatgttttatggtctttctttatagtgagctacatatgacctaatgtccagcaggcaattgcagtccctgattatttcctatcaacttttcccagttgtctgttttgagacttactataagttaaacgtttatatgtatataatagagaacagatatcatcgaatttctgtgtatgtttaatagaattaatagctggagttgggccaggatcttatttctgtgaagactaaaataaatagaattttctagttattttttgcattgctttcagatttttttccttttaagaaaaggaaagccattaaaaattctcttttgctaattctagaaaatttaagcttcatgaaaaaataatctaataaaaataaaaaccttccatttctgacccctaaatgatttacaagatttcaaatctgttgaagcctgactgctttggtttcttgcaagtggaattggatccaggaagttctgtgggttcatacccttagtatgacacagggacacatcattaatatgatagggcttccattctggagtgtaatctgttccattgggagctcagctgtgtggagggaaagtaaatgtgatctggtcagggctttctttttcatatttttaggtaataatctgtatgtgctatgtgaggttttaaccctaaaagggcagatacatccgaactataccagaacttgggtgccatgttttcattaatttattcattcattcattcaataaatatttttgagcactcaggcaggatacaatatatctctagatttgagtccttcctattctgttttttttttttaagaaattagctgtcagagaatagaatagttttgctatctaactcctcgcgtaattcaattcaacagatatttttgagagtcaactgtatatgttaagcatgtgctagatattaagggttcatatattaataggtcacaatcctcaatacgtacattaaattagcttgttttgtggcaaaccctttaagaaatctaggctttaattttatatatatatatatatatatatatttttttttttttttttttttttttttttttttgagatagggtctcactctgtcacctaggctggagtgcagtggcgtgtttatagctcgctgcagccttaaactcccgggctcaagtggtcctcctgcctgagcttcccaagtagctagaactacatgcaccactatgccagctaatttgttttattttgtgtacaaatgcggttctcaccatgttgctcaggctggtctcgagttccaggcctcaagaaatcctctcgctttgacctcccaaatgtttttcttcctttcttagcagtgatatctctatatgcagcaatgtttatcaaatctgtagattttaaggcttatcaaaattgaggcttggtcattctgaaatattatcaccatctttcctcaactactcaccctgcctcagaaagtcatctccacagcaacattcataataaggcagtgggcttttccagatctcagcttcagattctctagctctgtagctccccagtttatgggtatatattgctatttgttatgagacttgaatagcgtaaacctgaatggccccaaactaaatccatttgttttctagaggccacgcaggtattttctctgattcagaagcagaggacagaaattcaacaccaacatttcttgaataacatggggtgggtggggagatacagtttttagaacaatctgttgtgttctgtaagggagcatgagaggagataaagtgagtgacagaacccctacctttaaagagtgaacatgtagctctaggaggctgatattgatttcctccacctgtgattattcaactcatcacatttgaagaatgagcattgcatttttctaattttatttactccataaagtattcctggtgagtgatttggatatacagggaaatacgtcagtggtatatttaatacaagaagtaggtagatattcctagtaatgcagagagagaagaggtttgcccagaggacctgatttccactaatggggattacctgcttagagctatcaagccctctttttcattacataagaaatatctcctcagaagttcaagaccagcctggccaagagggtgaaaccccgtctctactaataatacaaaaaattagccaggcgtggtggcaggcgcctgtagtcccagctactcgggaggctgaggtagagaagtgcttgaacccgggaggcagaggttgcagggagccaagatcatgccactgctctccagcttgggcaacagagtgagactctctctcaattaaaaaaaaaaaaaaaatatatatatatatatatatgtatgtatgtatgtatgtatctcaggcttcacattttccaaaaacaatacagattaaaatcagaaatcagtttcttgggcaagatttgcactgcctaaagagaagggacctactgcccatgcagcaacagataatggtgacatttacacatctttgacataaattgccaatcttgcaattctacattaccactaagattaaaattctggttttgaacaccctaattcactgcctccatttctaaaacatttttccaggccttttgcttgatggaaatacactaaatttggctaacttccttggccttgttctatcatacttactactttatcttctttcactttgccagcgagtttattattttctagctgtctccgtttatgaggcatttaacttctacaggttatttcctgattaatttacatccatttgaagctctcacttttcataaatttgggtagtttagtgtgtgctataattcaatttttattttcatatgagcatcaaattttaaatgaaataatttattttttcttcaaatcacattggatttttaaactgctggttttgagttagttataagcaatcgcctttcactctcagaacttacttttgtgcttaagggtcaccacggtttggtatagcttaatcttattatatttaggaacaaggtaaatatttttggagtttggtcaataggagtctagaaaccttgcaaatccaatggaagtcaagttttcacggtatatttttgctggtaaatatgtagagaaatttaaagaaatcccaaatcatgagagcaaggcataaagtaaaagctcaattaggatttgtcgactaaattagtttgaaacagaactttatatctctaacttcatttcccctttaacagctaaaattaaacctattgactcatttaaaatttatgatttcatataatagggctgccctgacaaaatctatatttttaacaaatttgttttagaatttttatttctttattttgagactgggtaacaagactggctaacttttgtatttttggtagagacagggtttcgccatgttggccaggctggtctcaaactcctgggctcaagtgatccatccacttcagtctcccaaagtgctgggattacaagcataagccactgtgcctggccaaaacctacatttttttttaacaaagttattctctgctttttcctatccctacctttttctgggaactagattattttataagtcacagatacaatcacattttctgaatatttgcttcaagaacccagaattgaacctttaaacaataaagttataataaaaccatctgcatcaaatgaagatattcagaagtgtatctgaatagctatctagaggcgagggtctggattttaactcgatttgtaaatgttaattgtgttcttcacaaaacaaatcagtatctaatactttagattcgttctttgcatataaactgtttcattcccaactgcacttctattaatcttaaattgtgcagtaaattcatatttcattgtcctttttctctttgaatccaagaagaaaaacggatgagctggagagcattcaaataacccctaggaaaaggataccctcatgagattatggaagccaaatagcaattaagatcattagtaaattcacatttgtaatctaaaatgtgggaatgaattctgaaattcagagaaaataatacaattcacttcccatttcttctctttcccttacccctgctgctatccctagaattcccatctttggaaatagagtaatagtgaaaacaaatgtattcttggatgagcttttgtataattagatatgatcaacttcctggattttacatttttatagtttcaagattctaaaagtcttgggggcaggaggccacagagcagagcgaaaaaaaaaagtaatacttttatacctaataagtgggcatggcaatacttaaccacattgattcatccagtcgttatccaggggtatatttttcagtttgtcaagtagctagtttttctgccttcacttttcttaaatgtcctttgatcaaatctcaagggacagcacttccaccagagggcagacagtaaaaggaagtgaagatgaaacacatccatccatcaataagactgtgctaagcagctttcataatggttgggaaggagatgtttaaactaatggcagtaatatgagatgacaaaataattgctattcccagagtggttctcaggtatatttttactcctcaaatctacaatattcacatttgcatttcggtgttactgctacttagttcctctttgttagccctactataatatacaacccaagctgagtgaaatttaaatttggcataacaccaagatcacatctagtattttccaggtggaactggattcttaatctttatcagtctgagatgcctcgggaaagtatcatctgaaaatctggcactgagttactaaaagctcaccaaatcattttactttttatttgctggaacatggtagaaaatgcagctgaaatgttaatagataataataattttccagtgaaggatcaagagaagtttataccagaatttatagataacaagtaaatgtgctgattgttggccttaaatatgatgtttgaaatcttatagagatacgttttgtcatttgtgtctttgtcaagtttgaagttagcaacctgtatgtttttattacaaataagtcaattttatttaactatttattcactttagatttttctatatgaaaactcattagcaaatagaatcatgttaaaatttcattagtcaatggctattcagaatatagtacaaaaataaatgtccaagtaaaatctcataggaatgttggagtatgacagatctataaattcaatggtctgtaaatgctataaattctgataaaaggctcagatccacttaaacactttgaccaaagagataatggaaataatctaagataagcattttagctttggaaagagaactgtatatcgatagaaaattacttaatttaattcattattattggctgtggacatcagtcattttaaaatttgagttacaatacatgtctaatgctcacaaaagcaaatagttgttcacatacttaggtctaggctaaatcatatccatttttcaaccgccttcattgatctataaatgaatatagtatgttcatgggagtataatgttccagattaatgatacagtttttgtctttgttaacccaccaagttatttcactttcttttcttttttcttttttcttttttttttttttttttgagatggagtgtcactctgtcgcccaggctggagtgcaatggcatgatctcggctcactgcaagctccgcctcgtgggttcacgccattgtcctgcctcagtctcctgagtagctgggactacagacgcccgccaccacgcccggctaatttttttctatttttagtagagacgggttttcaccatgttagccaggatggtctcaatctcctgacctcgtgatccacccacctcagcctcccacagtgctgggattacagccgtgagccaccgcgcccggccagttatgtcacttttttataacagccccaacccaacccaagttattttttaaaccattgcagtaactatgtgcttttaaaatccttaatggtgaaatgctttgaaaattagggtaagaacagaaatataagaataggaaagatctactaattagctcttgcactttaggctgaggaatagtgtgcataatatatgtggcccatagatcgactattgtggatttcataacaaatatatttaataataaaaaaatgaaaaaaattctatccaactccattacccaagattttttagtaggttggagagcgaggcaggggaatccataaaatcaatgtatgagtgtatatacttctatctgaaagtttgataaatctcttctatatgtaacacttttgagtaactattacatgtaggcactagaataggtgctgggaaaacaaaagtattttgcttcagaaatatcgcttccagaagttcagtttattaggaaaggcagatataataagaggaataaaaggaagggaagaaacaatgaggacaatgaatggaaatgcccacgatattatcagcaccctaaggatgttggagcactccaattcagtgaacagcataccttatcagggatatgcaagaaaaaaaaaatcacacaagatgatgccaagcagtgacagattcaactaaccccaaggagcattcttctgtattttagtttggtgacacagaattctcatttattacgattgaagaattagtacagttcagtaaagtaaaaaagcaacactcttttggaattagtacagctcagtaaagaaaaaaagcaacactcttttggggacttcacatatacagtatggtcaaaggccacaccgtttttaggtaatagggtaaaggatggacatgttgaagggagaatttcaatctgaactcatgagaacttcctgattccaaatgccaatgcaagtggtacataaggagtgagcttaatgacatcattaagcaagtcccccaaaaataaataaagagggattgggttttaaaagagaagtttttatgggatttattctttttattctacatttttcttccataagccccaagtatatgtactgtgtgtatatatatatatatgatatgcacatatgcaaataatatactgcctgtcactccatatatatgtagacacagtataagtgatattagactaatgtaaccagagattaacagcccctaccatcagtcatgtgtttacacagaaattcacaccatcattcttaaccagcatcagccaacatagacatgcatgatactgttttaacttggcaaacaaagcatgttgatttttctttaagatttctttatcataattataatgctgactccataattcagttatccttgggaggggtggaaagaaaaaattatacagatatatctatccgtatatgcacattcctgtgtatatatataaatagatatataccttgtatatatttgaagaacattttgttgtttcacctcatcttgtgccgcatgaatttttggtggttcaatttattttgttttcatatttactattttgatcattatggctatttttaactcattgctatacttttatgagtaactataatcattattttcaaatactgagagatatatagatatacaaatcaaacaaggcaaaaaaatcttttcttgccatcctaatctcaaattcctcccctttcagcatatccctccagtatttatctcaaaacaaaacaaaccccaacgaaatccaagaaagttgtgtacaaaagaatgaatactgtgttttcctcttcctccttctatgcatatttttccttttaatttccgtttctttccttttgatttacccccatatctgcatggaccacttgcctttactttcccctttatgacaatgtaattaattgaaaagataagagtcagaaaaaaataaaagaaaaacacatagaaatgacagagaaacacacccctctccacaaatttcagatggcataaaaagaattttattgcagatatagaatatttgttgtatcttttatttctgtctggacaagcccaggatcattgtgtggcatgccgtgacaagttttgtagcgcatcaactaaccatggcctccatcacaagtgcatgacaccatcttgtgtttcatccaagtgacacatctaggctaacccagcaagtccagtgtatgagttgtgggaattacattcttttgtagttataatttcatgggtccttgtttttattattatttccattggatcatgacagccctaagagctgctctcgcagcatctctgtatggttttgttcttgtgttttcttttcttggcacagcagtcaagcatgtgtctcttgtttggcacatctgtcttgccatcttgtcttgtccactgtcgtggtgttgttctgtgattctgttctctgtaagatgtgatttgaaatcctctgcctttatttctcactctcctattgtctctacttttaaccttacccctagggaacttcacaaagaagcaaaacaaactttcagtcacattataaggctgatcactggtttgcatctggaagtcataagttgtactttttacctgacttaaggaggaaaaacttacagtgggaaactactgataattatactcaaacagcaaactgatcaacgacaataagaaacccttgttgattatttttggtatgattaaatgggcttactgttaaagggacttcatgtaagatcttatttccaaagagtttttttcataaattatcagtcttctagtcagaaacttttcttcaggagcagatcaacggaagatgtttttcgggaattgttagtgagggagcatcatttctgctgtgtagaacagtgcctgttcctgaattggggaggaactttatggaaatctgcaaatgttttattacaaaatgcatttatgtttatgtattaaaatataaatgtgttcagcaaggcatctgaggatgggaaaaaaaaactttttaactcactggttccacctcatgcatattttgaggtaagattatcttttgatctttctgagtcaactgatatacattttacttttttattttttaattcatggaagcattagagagccaacacttcaactttgacctaaattcattcttttcccattccagagaacacgacatacataatagctttagttctgagaatagagtctgaatttgagacaaacgtagaaggaagtgcccagttaattatccaaatgttggactctacctgtgattatccaggcgatttgatgctttacttggaaggatttgattagttggatacgaacagcatgaaaatgacactttgtaacaactttccctctttaagggttgagcacgagaatatcaaataggtataaaaatgagtaataggtgatatattaatagattaaagattattcaataggcctaaagatttcagatgaaaaatctgtatttgtaatctgaaaaagagaaagcatatccagacctgtggttttctgatgagatctttcagtcaggccagggtagctattggtttttcttaagggtaaggggaaaaaggccaaggatgaggaactggatggctctgtggactaagaacaactttctgatgaaagaaggaagggaaacaagaaaggcgaagaaagaggaggagggaaatgtaaaagaaaggaaggaggaaaggaagagatattgattatgagccaggtaaagctgcttgctgataaatattttaaaaccagcacacacacagagctctaatttgcagttttccagtttctgtatggtgtaaaatattcccaccatggctgatttctagctaccaatatgacagccctaaactcagaattgggaagtgtccttgctcgtacacaattatatggctttttcatcatacgtacactatagacgtcaagaacctcatagataatagtaaaatttagtaaaataattaggaagtaccgagttttaagtttttaattacctgtttttaatatacttgtaactttatatatatattaacttttgaaaatggccatgttttaacaaccagcttacaaatttcctagaaattttgcaatcagttgtcataaactggctcaagcacaccactagcccaggtactatactgggtacatgaaaacatagtattttatttaaatctcattttaagttattgtgagataaaaactagcttggtcatcttacagttgagaaaattgggattttaagtttgcttgttcaaggtcacatacctgcacataaatggtagaggtaatattcaagtccaaatctgtttgaaaatagacattttctttatattacagtgtgccagtcattctttcaacacttctcaaagtactaagttatcgaattttgacacgctcctttgtggagcttagcatgactcgggtttccctattgcctcaaggaggtccttggctttaactgtcttagataaaatggagtttaaatgtattatggttgtgtcaatggcaaaatgaagacagtgaagcaaaattagaactcctgattactctgtttgtaaatgccaccaaagttatgaccatgtcttcatgagaatgtccactttgactaattttgtttcctccaaatattcctcttttactaacattgacaatgaacaggatatttcttaggttttcatattctgtcccttgagctttggaaagactatcccagatacattttctgagcacatagaatctatagcatgatcccattacatagttaggttttataacttttaaactctaatgaattttatttagttacagtatgtaatgcatgttaattaaccaactgcacagtgaaatatgtcaatgtcctttgcttccacattttctaatagagtaagctagtatattaacatttaaaacagcatgagaaccatagtactgcagaaagcaactgcagtttttaaaaagatgattttattgtaagatacttaatcattgctctgtaaaagagtttgagaggcctgggaattaaaaaggaaagtgttgcagctttttagtccttctaatttgacaagatagataatttgattgggtttctgatagtgcagtattttgctttaatttggtgtgaagtttagttgcccccataattattattatttttttttggtcactctgtcacccatgctggaatttagtggcatgatctcagctcactacaacctccacctcccggattcaagcaattctcctgcctcagcctcctgagtatctgggactacaggcgtgtgccaccatacccagctaatttttgtatttttagtagagacggggttttaccatgttggccaggctggtcttgaactcctggcctcaagtgatctgcctgccttggcctcccgaagttctgggattacaggtatgagccaccgttccgggcctccctatatagtaaactttcgatggcagcatacacaacattgaataaagtcctttgaagtgacttctaggctttctcctataggtttgccactgctacaactttgtttcatcattcagtgaatattagcacttcctttagtgaaatatagtcttaagtacttcacattgttaactactttaatcctcacagcaatcatgtgagagtctattcttattatctccattttaaagataagtaaatggaggcacagaggagctaagcaaattatcaaggtcacacagcaaggaagtagaagaaatgggatctgaacccaagccaactgcccccagcgtggacacccatcactatgctatcctgtctcttacgtagcgcttattttccattaacctaaatatacgaaatagctgccggcctccttgataataaaagaaagtctgtgtattgaatgtattacatggttgggaagtagttgataaatgggttagttattatgtatcaaaaaggctttaacaatcttggttgatgggggttataaaattgttccattatgatttattcaaataaccgtggttaaaacaagttaccctggtttcccataaggaggaatgactccaatattggagagaaataccaacacttatgtgaggtgagtctcccttgatgtcacctatgcaataatatgtgcacttgggtttttttttttttttttttttttttttgagacggagtctcgctgtcacccaggctggagtgcagtggcgcgatctcggctcactgcaagctccgcctcccgggttcacgccattctcctgcctcagcctcccgagtagctgggactacaggtgcccgccaccacgcctggctaattttttgtgtttttagtagagacggggtttcaccgtggtagccaggatggtcatgatctcctgacctcgtgatccgcccgcctcggcctcccaaagtgctgggattacaggcgtgagccaccgcgcccggccgcacttggggtttctagctcattattcatgatcaattctgttcaaaacatatgcccagacaacagccacctttaactgatgttaggaatctaaggatagaggctcttagcgagagcttgggttaagatactgcattttctttatttcagaaataaatatgttccttagaacacagtgatttaggtgttacagctaaaagaaagcaaaaaacaacaacaacaacaaaacgaacttgtatttcttatcttagaccctttctgacacccacatgctcttgacatctcttaaagttgtaactatttgtttatcctccctttttcctcacttccttgcattatgcatccaaaactattttaaaagccaaaacacacacacactttttgtgggtctttgagtttcctatgcaagaaaagaatcttaaaatgagttataaagaactaaaaatcacaattaaaaaggaaacataattttaaaactgtgtttgcttgtattataatccttattccaaggcaagtatggcctgcacaaacatctgaggattccattacaaattatatcagtctcaacccatcccgaatccagatcataaactcataaactggaaaatgtgtatagttgaaaatgtttgcataccctctgtcctagagcagtgcttccatcttagctttgaagcacagagacctcctcttactaaaagatcatgaaaactggcaatactgtattgcccagtgttaaaatttgtcagattaattacccagagccaaagttagcaaactttttttctgtaagggctggggtgtaagtattttacactttgagcgtcttacagtccctgccctatctcctcaatcagctcttataatgacacatagcagccatggaaacaaataaatgagcagggctgtgttttcatgaaagttgatttccaaaagcagagatggagctggatttggctcagaggtcatagtttaccccaatctagagaagtcccataggttaaaaatgtgtagtctttttttttgtttttaatagataagaccttcttgcccattttatagtcgttcccaacatttgttgagttctccactaagtacatgagaccacataggatacaacaggacattaaaagcttttttttttttttttttttgagacggagtctttttctgtcacccaagctggagggcagtggcacaatctcggctcactacaacctccgcctcccaggttcaggcaattctcctgcctcaaccgcctgagtagctgggactaaaggcgtgagccaccacgcccagctaatttttgtgtttttagtagagacggggtttcaccatgttggccagactggtctcgaactcctgacctcgtgatttgcccccctcggcctcccaaagtgctgggattacaggcatcagccaccgcacccggccctaaaagttcatctttaaggacatttcccacctttgttttagatatgccactatctcagacatgaaacacaataacaaactaaaccagggtcatctccacccagcttgtacactacatatttgggtaggagcttaacgtcttgcccttcgctttgccagtgtgtcttctgagctccccacctctgctaggtgtgggctgcattcacccccaattttagacctctttggcagtagcttccttgatctcccgcccacatactgtgtcatatcccagtaattcttccccaaaccttggctatgggttattgagctgacaaatgtctaaatgactgagatacgatttcacaacctgctgagagcctcttctttccctgtactctttgatttgtagctttgtaagttttgtgaggaaagtgggaaaaacattcttggtgacacaggcagtgaatgaggaggacacaatggagtgggcaccatatctaggactcctgcctgcattgcgagcaaaagcatgtatttatatcttagccctctgaatgttagaggtagcagattatacagtatggtgcaggaaggagcatcctatgtcctgaggtgaataacgtgttctaccacctggcagcagattagaccagatcaggctatgagaatacaggttcacagccagatttagtactaccagccagatttagtactactgcaaaaatggcttttccttaagaagtttttgtttctaacttttattttaggtttatgggtacatgtgaaggtttgttacctatgtaaacatatcatgcggttttgttgtacatatcatttgatcatctaggtattaagcccagtatcaaaaaattatcttttctgctccctccatcctctcaccctccctgctcaagtagactccattgtctgtcgtttccttgtgttcctaagtcatcatttagctccaacttgttgagaacatgcagtataagttaatgcttactctctttaacatctttcacattagaaatctatggagaagaaatatgaaagactcatatataaacatggggcaaaccatgaagctaaatcttaatgtatcccaaaccccagagggagcataaggttaactttgggtggccagggtgcttagtgataacattatgagctttctacattagcagggccccctggtgtggttttgtgcctggagatgtaaggttctgaactacaaaggaagcaaacaaaatgaagagatgatgcaaggaggcaaaaaagatggaggcattaggaaaggctttgagggcaggaggcacggggtcatcttctaaaataacctattggaatgcatgttttaataagctttgaagatcaaagagattaacaagaacaagaggaaaacaagggtaaattaggcactattgatggcctgacaaggacttttttctccctttctgcttacaataacctctcattttaccatgtggctagttggtttgtttacttgtttgtttacacttactcattactagctttccctataaagcaagggaaaacactctgtccccaggggccagctgcataacatgaatagatgaaatagaccagaccagatgcaatctgcagtcatgggaactctgaactgaagagaacatgccctcatttaaaggcatccaaatgaaacattttaaaaacactaaaataaagagaccccatgaaggtcaaacaaggcataatgagacacacagtgttttttattcttttgtttcttaaattcctttaaatatagccctttcataaatttggcaggatgtgctctcagtaaaatttctggtttagtaaactcttggtgacattatcaaattaaacagcaatcccttccaaattcccctaaagctaagacctttttttttttttttttgcatgtctttttttctctgataatcccagagtttatataacctcaaactataagcttgatgaattttagagttcattgtaatgcttttggtttaggtgacaaaactgatgcctacaaagataaactgatttgctgaaggtcatggacctagtctttattggagttgtaattcaatcccaggtgtcctaaatctttaatccatgccattttattgatattatatattaagattttttttattgtatatccaaagatttctattttaaactgagataacatccaacagagaattcagaagtagtatgaaattgattatcttccctctactggacattgttgccatacaagacgatatcattgacccacttagggctcaaatatacaactctgtattattttagtcacaaagggaactaagagattatagacaagttgtgaagcagttagtggggactggaagtctcctgtggcacagactcaaatatatgctctagtgatgtgttctcagtcatgttatctgcccacacagaggacagattaagcaacctagagtactggttcccaagctcgaatttaaaactagtaccagtctatgccaaagctttcagtgacccatagtgaaatgagaaaagcaaggacaatatggtgagtctgcacaaagtcaaacttacagaactgccctatatttggatactgtatcatgtttttttggatggctaaaatcaatgtcttttacaaaagcagcattttgttactatgtatagcattcttaatcagcaaaataaaggttggcaatggtatgtcagtccttccctacagtttttctttgaagtttttttctcaggcattgaaaacaaacatccgaaaaagcaaaaaaacaagagttttaaagttttaaagtgttctctatgttgccacattagattgagtagatttcaaagactgaaggcctttttacatgtaaagttttattgtgaactaataatgatgatgttaagacccatctattttattgaggtcccaggaagttactagtttaagcatccgtcacttagataacaagcattaaggtaatttttaatttcagttaaaaaaatagattaaaggcacaaaatagatttccaaacaaacaaacaaacaaacaaacaaaaaaaccaaaaaagccaccctaggataaatataactagaaggccaagatcagtttagaagtctacttaaagaaagacagaaacttctaaggactgtgtggaaagataattcatgcctataaaaaagtctctgtgctaactctagatttttttcactgtaagccttgtaacaaaggagagagagctattttggaaagctgaattagcctacatttgagctaacatgatccatctttgtgtcaagagaaagtcaaatattatagtccccagccaaaataaggcatgtgatctacatcaaaggcaattcctgaatgtgtatctacgtcctcatcccctctcctcttttttgtctcttgggtaatctataccaataacctcctgattcatgaaatttattatctaaatattgaaaatattacactaaatttagcctaataaaaattcatgccaaatttactgagtatttattggaaatcagagacttaaggtcctgaatcaggtgtaagaattgtattatcaataacagacttaacagtgattatctctaggtggtgaccgatattttgataatcatactccaaaacatctatgtagaaattgggcatggtggcgcatgcctatagttccagctacttgggatgctgaggtgggaggattgcttgagcctgggaggtcaagggtgcagtgagccatgatcacaccactgcactccagcctgggcaacagagcaagaccctgtctcaaaaaatgaaacagaacaacaacaaaaatcgatgcagagcatgtattacatttgtaatcagagagaagggatatctgttatttcttaaaatatagaagagtatactaggagaccagcaagggaaatgttttaatatttagatacggaagcttcgccagacccgtaattttttaaaaatagtgaatcctttttcctgggttgaattatgatgtatggccctgcaaggaaagctgctggaggaattcaaagatgatgatgatgatgatatgcagggctctatatagcttaacacattagttccataaggtcagttctgttcatcaagtgacaaattgtccatggatacaccaggtggtaatgcagcagcagtgggcacaagctatcctgtaaatgacccattaccagaaagtttaaaatttctgcttggaacccaggaacacagatggaacacgaagtggctttcaccagagtcttgggaatatgcttgatcctttaaccccagcttcaggtgttgtgtacatacttaatgcctgaacagttctcatctgtacatctgctggttagatgaaaagatgcagttgcagacaagtaatttaaaactttacattcatgtctctctacctccctcttcctcttctgtctctccctcgataggatgtccagaaaattaaatcagctgcagattaattgagactctcttccatgtagggaacatctgtcactgcagctacaaagattatattaatgaattaaaacatttgattacctttaatccaagagaatgcagcagtctctttagtcatttagtttatcagggttttttgatggtttttttttccacgtgcatcttacgactatagtccacccctgaagctgtgagatctttcagcagatgttgttttccatatctttaccctttccgttgtggaagggggaaaaagccctcagaaaagcaattttggaggaggcagaaaaggtttccatcatgaacatacttttagaaacagctggtaaaacaaatggtccaagtgcaatgcctggagcatatctattcaaacaaggttgtttaaagataaaagcacccacttctaaatatcagcattagtagtgatttcctcacgtatatttaagagatggaagagcttgtgaagactttttgatttctattttgttttctgagacttctttaactcttttggttttgttagtatttgaatttatcagaagctgctcaaattgttaaaactgtatcatcatatgtaaaatatataaatttacatataacggatgcataaagatttgctttcttattctaagaatgttcttatttgataacatctatgcatagtccagaagattgacatgaaaaactgataatgtacttaggtattaccaatcctataacccaatttgtgaaaaggtcaggcactcctactaaagaacaaacgtttgtatttgtagcatttaaaaatctgattttattttgtatttgctacatttggagtcaaccttatcccttcccttctaatgacttcatttgtttaccaggctgttttgttctgcatcctctgccaaatgccattacgtaacttcctttgtcagaccaattggtgaaataattctttgtgtgcttttttttttttttttttttacggccgtccaattttcaaattatatgtggattttctgagtcaggcattgcacaaatgctgatttgttagcttgaactcgataaatgtgtgttcaccctatcagttgtcattcatgctgacttcttcctctactctcttcactctgattctgttttcatttaagaaaatttcagaagtagtgaagctaggagagttaatgagtagccacgttgaccctagtaggatcttacccattggagaaaagccctgttttaaaacgatgcacaaagaataagcttcaatgtcttcctctcctcaaccccagcatggagcacaatgcttatgtgatacacggaagtgagaaatttaagaagtgcttcactttaacttttctcaataagtaaataaaactgtcttttctagagtccaacacatcccaaagtgtgtgactttgctattttaccttaaactgactactctctgaatagattttcatgttatatagtctgagacttttctttccatcctgctggtgctggaagacatgatcataactactcacaacccagatcttaaaatatatatattgttacacttttatatacttgtattaaagcatcagttagtaagtttcatggttgtttcttctgatgtaaaagtaactgtagttatagatcctccagcacatgtcacactgaaaacctaatcacaaagtcaaaatatgtgcataaatattagcttgattatgtgtcacatgtaccccaaattacacatatatataccttcctcaaagattttttttttgtggggggacagtctcactctgtaatccaggctagagtgcagtggtgcgatctcggctcactgcaacctctgcctcctgggttcaagcaattttcctgcctcaggctcctgagtagctgagattacaggcacctgctaccatgcccagctagtttttatatttttagtagaggggtttcgccatagtggccaggctggtctcaaactcctggcctcaggtgatctgcctgccttgacctcccaaagtgctgagattacaggcatgagccgctgtgcccaacctgagattttttttttaaaccttggattttcaaataactttatagttggagaaaagttgcaagaatagtatatggaattcgttatgtccttactcaggttcaccagttgttaacatttgccacatttgctttaccattctctatatgtgtgagtgtacatgcacacatgagccatttgagagtatgcatacaaaacatatttatgtagatatgtatttcccctgaaccatttgaaactcagttgtagtcatcattccttttttaaataattcagtgtgtatttcctaacaaggactttctcttacaaaatcagagtacagtgatcaaaatcagtaaatgtaatcttgacacaaaatctcacctagagtacatattcacattgcaccagcgtctgcataatgggctttgggattatttttttcccagtctgtgatccaatccaagatcacacattgcatttagttgtcaagctcaccaacttttgaagcatcttcctgatacgttattttatttccccatttgtttactggtcacagaccagtaagagcaagtaaacttcttaaagtcctgccaggtgtgttggtgtagaagcgggaagatagagcctgtgcttcagcacaggaggaagatttcaatttttagaattaaaattatggcaaggaaggacctgtgtttcatctagtattcattccttagagagcacggatataatagtctgacaatgctttttattagtgttttcacttagctgcagattgagcatttactgtgtgctaagcactgaggatgcaagagtaagcaagaacagagatggcccttgtgggcctagtgggggacactgtcatgtaattaagtgacctccaaataaatgtgtgatgacaaacgttgatgaaggctatgaagcaaaggcacttggtgccatgagcataccatggtaggacaggtaacaaggcaggggtgggtgctaggaatgtagagaaggatgaggaaaccttctctgaaaaaaatgatatttgagcagaagagtgtgaaataagtgacagctaagaggaagaaaaaatgcattagagcttgcaaaaaattctgaacattagaaaaagtcagccatttctgggagagagttatctgggagcagcaactgtctcacaggattttgtccaaagtataaaataaggaagtgtgttaggctattcttgcattgctataaagaaatacccgagactgggtaatttataaagaaaagacgtttaattcgctcagagttctgcaggctatataagaagcatggtgctagcatctggggagcctcggggaaactacaatcatggcaaaaggtgaagggggaacaggtatgtcatatggccagagcaggaacaagcaggggtggagatgccacaaacttttttttttttttttttttgagatggattctcactcttgtcgcccaggctggagtgcaaagtcgtgatctcggctcactgcaacttccacctcctgggttccagcaattctcctgcctcagcctccccagtagctgggattacaggctcatgccaccacacccaggctaatttttctatttttagtagagacgaggtttcaccatgttggacaggctggtctcaaactcctgacctcaagtgatttgcccgccttggtcaattaaagtgttgggattacaggcgtgagccacagcacctggccgccacaaacttttatatgaccggatctcactgtcatgaggacagcaccaagccacaagagatccaccttcatgacccaaacacctcccaccaggccccacctccagctttggggattacagttcaacaagagattcaggcagagacaaatattccaaactatatcaggaattaagtaggctttgctgtccttttgcagctttgagtcaacccatatgagagtgaattctccgatcctgtactgctcctgggaggaaagggagtgggctttgtgaaaaatggagatttagtgagtaaagtgatgagttcactggaggaaggttggctagaaaaaaagtgacatggctgggcatggtggctcacgcctgtaatcccagcactttgggaggctgaggtgggcggatcacctgaggtcagaagttcaagactagcctggcaaacatggtgaaaccccatctctgctaaaaattcaaaaattagccaggcatggtggcaggcacctgtaatcccagctactcgggaggctgagccaggagaattgcttgaacccgggaggtggaggttacagtgagccgagatcacgctctgcactccagcctgggcaacagaggaagactccatctcaaaaaaaaaaaaaaaaaaaaaagtaaaattgtctttttttttttttttgcgtaccaaatcctatcaatgaaagagacaggaatagatttgactggaatagtcatgggagccatttccaggctctcatagtcttagagatgacacttggtagttcagtgtcttattgtgcttcttcaagcacatacagcctgattgagagagactcaagacagcatacaaattctaggcatttttacatctgcctagctgtagtgaattagtcatacaataattatttaaagaaagaaatgtttcctccatgttgtgctggagatacaatggtggagaggaagtggagatcaactattgatcgatttataatttacacaattccacactttggagaaaacacattccttcttcctcaccatcaccctcaccattataattattatcaattaacttgttcaatatgtaattttgaagttgccaatcatttaccagtgtgattcatcatgttaaaaggaaatggcttttacattattaatattctgcaataaaagtttgggtttgtgtgcttacagttagaataaaagaaaaatgctttgtactaagactatgttaataataatgataataataaagaaataacactttctccagaaaggaaatttcaggaaatctgtttcagaatacctgtctctaccacaagagctttctaagtcatgttttgattgctaacagcattccagtactgggttggaacatatgtattccttctatcaactgaggaacagcaggttttctgttattgcccatgcatggtcactctctgcttataaaaattcatcacttctgctgattgcattgtgtaggattcctactgattaccatttagatttgttaagtgacatagcacattttatggagtcaggagccagtaaccatcaaggtcaatagcagcaacctgaatcagttataaatgaattgtttaattacccacgcatgatcaatgtgtgcactgccataaaagattagttctagtccctgaatgtgtgtgtgtgcctgtgtgtagttctaagggattacagacttctctgaagtcttcttcattgaaagagattgcaagtgagtatcttttcagtggaatagaactgagttatggtaacaacatcatctatacatccagtctaccgtggccactgaatccaatgacttttttttttattaatatgaaggtgcctgcctatccaaagcactgcttactgtatttcattacaatgtattgcttcactcaacacactctgaatagagaagatatgctctacagcttcaaattcaggcacttcctccaagcagagcttgtttatctgtctgcaacacacttggagcatttgaaagactagtgatgaaatccattcatgctgtgaaaatgtgttgagcatcatggccgcttcctttacaatggcctggcatggaaggttggagaaggccattgttaccatataaatgactgtctatttgcctctggcatgacttgtccagacaagttgcatcattttaaaatgaatgaagttctagggagcatttttaactatagtaccttagttgtaactttgagagtttttaataagcttgcaaggaataaatttggaatctagagtagtttgttctatttctggaaaaaaaggaatgctttgtacatatgtaggatcctttacctggccacagagtttggtttgagaagtggacttgactctggatagtgaacaaaatgctttttcaatttttaaaatggaggcacctttttttctgagagcatagtcagtaactccccaaatgtgtgtctcttgtgtgatagaggaaccaagtaagagaatagcttggtgtgtgcctggttttcttccacaagtacccaattagtaaagggggcttttgctttttacaaagcatgaaaattaggggttgcctataggcctgagagccctgccagacagttgcctaatgccaccagccaggattatggaaaagaagccttggcatactattcaatggcaccgattcacccaaattgcaactgaggaaaacgtgttcatttttcaaatagagtttgagtaaccatagacacaggcaaagtaatctctccatttggtcacaatggactaaactaccttgttctattgtctaccttctctctcactgactccatcaaggcagacttgttcggtaaactattcaggtgactttgtgaacttttatttggtgcaaggctctgttaatagctgtaagtcagctgtttttggtcctccctctcattctcttcacactgattgatgaaatgggaaacaggttgaagaagctcacttttttagatgacaagtattaagttgacagataaacctttaggaggttccagttcatttcaggaacgtgttgacatgaggtctttaaagatcgacagtcctattagagatagagaccaccaggaaatcataaggaaaagaaaaatgaaggaaatatctagattcagtaggaaattgggggtgatgagagaattttaagaaaaacgcttgctttatcaccagctgtgtcattttgttcaaagggacaggaaacataatactctctctgaagcttaacagaactgcagacctattgccacagttttctcttttgcataatcttgtttagtcacttaagagctagtgagtgacagatttcacatgagaattggtcacgtacaagaatgttaatgcagaactaggtcagattatggcatttcacacatgcaagatgggaacacgcttcctctggttagacaaaggcttgacgattgcccatgcatctggtcctgctttaaaggaagctcatgtaatcatgagaactcacaatgtatccatagatttcttagatatcaagtttctatgagccttggcattgtgtatggttttattgttattttgccaaacgagggttttctagcttcacttagtatgcctggagaaagctattttggttcggcccagctccatcactctaagaaatgatgaggatgagcgctctcagtttgtaccgactactcatgagagactaagaactgatcatctggctgctggcaacattccactgcaacagctaatacagtgttttggaaagatgccgacaacaaccagattgcattaagcactttaccgtttaagatcagttttgcagttcagaacttgaagtcagcagcagatctaccttttagtttgcagtttactttgctccgagtttttcatgtcttctgtgagccccccacgtttatctcagggtggattctaacacacatatgcttatgtgaaaatttcataatactttagtatttaacaggcacttttatataagtcaattgatttcaggacaccccctcgccgccctgataccaaaatctgcagacgctcaaatctcttacataaaatggtgcagtgtgtacatataacttacacacatacttctatataatttaaataatttctagagtacttataatacccaatccaacatagttgttatactgtattgtttttgtgtttttaattgtaatattttcatttacctgcagttgttgaatgagtcgagggcaggtagatatggaaagctgactgttactacttcccttttacttatattacaatattatctatgttagtgatgttcatagttcaagagacacactaaaggaattacagtatggagtgtctcctaagttgcattgtggaactaaacactagagacaagagtcgagccctggctcaatagagccagtaataactcagtgtctttatgaccctgagccggtgccttaaattctctgcagcgtagtttctttaaacggtggttctaaactaaggggacttttgtccccaggggacatattgtcaattgtctggagatgtttttgattgccacaactgggaagatgctaacggcatctagtgggtagaggtcaggggtgttgccaaatagcctacagtgctcagacagcccccaccacagagaattatcccacccaaaatggcaatagtgtagaggttgaaaaatgtcactttaaaatgtaaataatgtctatcccattatcacaggattcctatggggctcaaccccacattttgtttaaaaaaagtaaaaaaaacataaattgcccttctatgtctgatgttactactatggggcattgcacatatggacaccaaacttttcccttaaaaaggaaaatggatttattcttttagattaaaagttataaataaagctatcagattaaaatatattaaatatatccactgaatcttggtttgtaattttatggttttaaatgaatgctctaaatataaagagaaacaatgaaaagttattaagtaggagaaacctactattcagtgactaatatagataaaggaaattggaatccatgcaactaatagacttttctattagggtacagccacagcacgtctttcctaatagaagcaagcctgaaatgataagttgtttggatcacattaattaacattcagctctattagatttgtacctgaggttgggttcattttactggtgctgatgaatatcaaactacacaatatctacgcacattatattagaataaaacatgttttacattgaaggcaaattttagattcgactcttaataatggtcttttatattaactcagataactagagatagtaaaagaatgaattaaaattccagtgagccaaactacaacattgataatagtaatgagaattaattctgtgttgattttatggtgcctttgcctcgtaggtatatataactctggagtttatgaggcatgtttatagatcttaacttcttaattttgtaatgctgtcctcttaaaatttttgcttgagacggacaaaacctcctgaatttcttcaatttacatgggcatttttactaggaaagagcatgcagccttcatcagattctcaatagggtttattaacaaaaaatgttgagaaatcaccttaaaaggcaggcagctcttaaatgcttgttctcactgaagtccttctaaaatgatattgcatggactctatcagtctcttagcagctcatctgtagaggtaccaactgatcaaaaattcaaagttcttaattgacatactcaggttttttaaaatttaaagatccagattggtagctcagccatatagctaaattgaataattatgcaaatgctgcacaatatttaattggaccttttggaatgaaaataacccaggtgtgcacaattctttgcaatctggagcaaccattctaatatatatctgcaagtgacaacatcttgtatgtaaacaggcagaggaaaagagttctggctgccctcccaggaaaatatacatgaaagaacgtttgtgttacagcatttgtgttacagcacatacatatttctgagttgtttgttattaaagtcccattgtatgaaaacaactatatagacagactggcaatccagagagttggtagttacataaacaggtcccacggctaccaataatattaacacggtattcttagcccttaagaaacaaaacacagaaatttctaatactgggagtttaaagtgccacaatggaaaagcaaactcaattacaaatgctggattccacctggagcctattcttttcattttcttacttctgtttctgccaccttcccttcttccgataacagattttcaagtactgctcttagaattgctaaatgtgttcagagaatgtgtgataagatctgattctcctggaaggccaggttattttaatctttccatttctcacaccaaccatttaactaggtattatttgtttctggacgtcacagctaaagacacaacattttacatgaaaatgtcagtgttgaaaatattatttatctatctatcaaaatgtagccacgcatctgttcttgtttgattctagtaaaccataaccctaaacatgacacaaaaggggctagtgaaatatttgccgagagcggtactctaagttaacagtaaataattgaaaataagtaagtcaaaaccaaaaccaggaaagtttgcattcattcccaatcatactttaacagaacttgcagctgccacagattcagacatcttcatcttcctgtggagcatttgtcttttcatagcagaggacaatctctgtgactttcttatatcactgagaccatcttgtacagtttatttcaaaagcaagagtgttctttttcgtttcatgccaccagtgacaatacgaaaccagatctaactgaaacttcactcaacacattcccgacccgccaccccaaccctaatagcctctcataaccaccgttctactctacttctgtgagttcaacttttgcagtctccaaaaagaagtcaggtcatgtgatatttgtctgtgcatggtccatttcacttagcataatagggggactaagttcaagagatctattgcacaacatggtgaccatagcaaataataacatcttgtattttgaaaatcactaagggagtagattttaagtgttcttagcagaaaagaaaatacaatgaggtaatgccggtataatttagcttgattcagccatttcacaacttgtatacatttcaaaacattatgttgcacatgataaatatgtacaatttttatttgccaatttgaaaaacagagaagtccctcttcagatcctgtcctatgcagctgtcactcacttggctttgtaagcctgcagacagtgtcatttaaaatattttcctctgtaccataacgcttttccttttaatgatatataagaataatatttctctctaaatagttatttctttaactttgaaataattcagcatctcatgattttgatttccatttctccatatatacattttttggggctctgttctgggatttagggctaacctttgtcatggagacatctgtttttggcagtctttgtttccagggagtgaaaatgtgtgtagaaagaattgaatagctacatcttaggtgacacaattgaggaactggatgaaagatatttgtggaaagcaacataattattcaaactggaatatggccattgccctgggtttcatatttatcttcataagcaaagtggtttgggattctgtgcaagtataaggatttaggatttaaacactaaaccacatccctgcacggagcacatgggctttgttgttgataatcatgatagtcgcacaggaaacttgacagtgacagcaggggaacagcacagtatcctacttggccactggtaggaggatgcaatttaaatcctggcatgcgtagaatagcctcacttatctgtggattgttattgtaatctacatagtaagtttcaatcagaactcagttttgtgcagttgatttccaattcccgactctgcatcattagggtacaatgttttctgtaagatttctttgtaatattatagagagaagagcagaacaaatgcagttattcctctcaaagttcagctgaatgctactaatagttcaagaatgtggattgtaatggttctgtgcattgaaagaacacaatggcaaatgacaaagatgacactaagtgtgagccacagctattgttttgatagcccactctgcttttctagttaactttcttacaaccatcagttccatatttaagactagaggatcagttctgatgatgctcattcaaactcttgccaactgacatttaatgcactttaaagttgttaaaaccaagagcaggaaatgttacacttgtagtatcaagcctggctcatgagaaagttccatccactattctggaaaaaaaatagaactagcctgcaggacacaaagctacctgtggtgatccgaactatgcttctcaaaaatctttcttttgtttggccacctttataataggagttctccaacagagaaagagctgcttacagcttcagagtacagatggataattgttgctgtgccatctctgaacatcttagattgagggtcccagagaacctcatgtatgtgaatgttagcacagtacaaaagatgggacagagctttccagagcagtaacagacagctgtgcccagcactttcttctaaaagttggagatgctggatggaaaatttgtcattgtttacatagcacccacacacacacaaaaaatcctgactcactagcttctgtgttgtcatttttttgtccatggttctattgctgcctaattttcatacgggaccctcacagtggttagtctgcacagtaaggagtcaactgtgacatcctcatccttgaatgctagactccccactttctcagctcaatattccatgtgtccaaagtaatactgttagtatcctacattattccaggatcttgtcatgccacttcaagaaacaaattatcaccgctttctaagacttaccaagctaggggtgttgtaaagtatgtatgcaattgacttttgacttttgattcttatgttgaaaggcaacatagaaaataagcttccattaatgtaatgatatagtgttaggaagacagtatctacagtccattcaaaatattctgaaaattatagtattgattttggaacagttttgattccattggccatagcgcttaccttaagtcatttttttttaaaaaaaccgtcttatccatttcatatgttttacaggcactaaaatggggcacagagactaagtcacttagttgagttaaccaataagtaaaattgccttcatattctgcttcctaatgttgtatcttctctagcaagttcaagagagcttactttctggaagctttgcttgttagtaggatgtataacctgtgggaaaagacccagcagcatccacttttacttatctccttgccttctctgaaaacacactgaacagaaatatccccatctctttctccatcgtgggtttttcctttgggccacaaatagtgaacgccactgctttacaaagttattcttttcaccactaatagttctttgatgtcattttttgtacaagtgtcaaagtttttctctagaggcttccacacagttaagttcttgcttttggattctttctaaaccaaataaataaatcttcgagactgcaggttaatcaaatgccttcaaacatgaaggctgtttaggagctaagctgcacagacattttccaacatttaaactcttcatgcagcatcttcctatctcaatttgtacccgttagccagttccacagggcatattgggaaataccttttattttcaatatttatatttgtcttatagatatttgtcctttcaagtaggacaaagtggtaatgacctgcctctatcaaaaaattctacctagtaatccaagataagcagtgtgttcctagtgagttgcttacataaaagccaatatattttgtactgaatagtatacagtgttaaaaactcagctttttgagggacccaagcaagcctaacctacatgattttacaaagacaatacttaaaagtcataaagtactaagtctcaactttcagacttaagactcataaacgttttaattttttatcccttaaaaatgttattttttggctaacagcattgaaataagcgttactatagattaatactatgaaacaggaacaaaactgttgagcagacattctcccagggaaggactgtgtgtgaacacattaaacttacgcataaaagtggagactgtaagtgggttccagggtttccccacgctgactttttaaattaaatgtggcagtattgctaaaaataaaatttagtgtttctcaaattttttttagatagatacctcatatggtactcacaagtagtgtgaaaacttaagtagtatatccatctaaagcagcacaagcaatatgtcagcaccttttcactattaccacagagaaatagtgttggagaccatattgaaaatgactgtagtctggctgaggagatattaagtgaccagatggcctctggcacttctgttttcaaagctgccttatagtgcctttctcactttgtgataccaagctgctgccatgctagtgtccaccctcgaacaccatgccactcagacatggtgggattcgtgtttctgaaggggcacagtaggaagctcattcttgggccttctggcctgcctgagactgtgctagcaatacagtctcattgtgcacaaaagaagccatttttcttaacacctttgagccattaatgaaacctaccagttagaggtggtcaaaagacaaaattacaacaaatttagcttaaagatgtattggttttacttgcaattgtagaattgggcaacaccttgttctataaaatagtatgttctgatgagctgggcaaggtgttgtctgactttatggacagaaaaggactgaagaaagcagaaacaaaatgagaagtagacaggttgtttcaacatttccttctttctaggctttaagcagagggtactttcttatgctggatcaggtaaagggccccttctgcttggttgctatgaatctcctgtttaaaaagaaaacaaaaacaccacacaaaaaaacctgacccattatggtttggtctggttggctgaggcctagggccggagtctagtctaaaacaatggcctcccctaaacttgaacagggttacattgtagaataacataacaggaaatgaaaagagaaatgtgatgctcttcaacaattggtttatggggccttttaaaaagtgtgtatagagtcaatgatgaattaagatgcagtgtgaaagaaaatgacacaggacagatattcagagatcatttgttcagttttaaaatcagattattagtattgctgttgagtcatttcagttccttgtgtattctggttattaatcccttgttaaatgaatagtagaaaatattttctcccactttttggttgtctcttcactttgtagattgtttcctttagtgtgcagaaggtttttaacttgatgtaatcatgtgtctatttttgcttttgttgcttatgcctttaaggtcttatccccccaaaaatctttgcccataccaatgtcttatagcatttccccaatgttctcttctagtagttgcagaaagcacttgtaatttaacagctcaggaagggaatcaaatcattcagaccaactgaagctttcaaaatgttactgcttgaatgggcagaatatccaaaaacatttattgtgtgatcctaacatctacatattagaaactgatagaaaacttctgatgtatcagtaagatgataattacccttgtaacatttctggaagcatgtatgtatgtatgtatgtatgtatttaaacgaatgcttgtatatctagcatctctttcaattgactcaatacccaaggaattttatctccattttacaaataagagagattatgacttatttcaggtcacagaagttggatcacagctggaactttagtccagttgggtctagaaattcaattttctttttactttcatgactaaggaccactctataactctgaggtaaaaagagcaaacataatgaagttatttagagtagtgtttctaaatctaattttgcatgagtcccttggggaacttttaaaacatgtagataaccaggcacttcctgttatcctttttccactgcccctagcagacagacttagtatgtctagcttaggtaacctgggattgtgcaaaaaagtaaatcttcagagtccctctgaatatcaattctcattatgcaattatgactcctaaggcttaaaagtatgaaataaatctgtagagatcttaggatctcctgtggaagttgtttttgtgcctaaagattagcttgtttgtaagttcccatactcagtgagaactgaatattttaaaaaactggtgaagggtggcactgtattttaacgtaaaacatgcaggactagatacagtcacggccattcaattttttaagttgtatatctttgggtgagttacttagcttatttcagcccagatttactgctatgtaaggtgtaattataattattgagtaaaataaactaaagcatttaacacgatgtctggcagagactaagtttttaatactcttaaaaacatcttctggaggtaggcttctagttaattagtgttttaattatgtaattataatttttgtttcctttctctgtcctcatatttgctagaaaaacactatgtcaaccatttgatcatactcatttgtttctaagcatatatcttaactaatctagagacccatattcattgagcttttggaatgactggaaaatttctcaaagcttcctcccttatctacggtttagtttacaaaaattaaataagcttatgatgtgtgtctcatccacccaagtacatctgcagggctcctctattgtaaatcagctgcctaaggctcaagttagacacagtcaaagccgtgtatatttagggtacataatcttgatgtcaagtgctggagtcttgggcaaacttttcatctttttatgtaaaactgatttccattaagtatgaaaacaccttggtggtattgattttatgaaccctgtacattccctgcaatgaagacagattttagggtaaaagaggatgtttgcaagaaatggtgagttttattgtaagagaacttaccggccctatagagaggagaaaacaggttggaatgtccagctgctaccacccaacgggatcccagcacaaagaaaacagtcaaaattatgttcatcatgacagagcaaatgagcttttggggaaaacagaagcaaaataaacctttttgaataatttattattctataaacacaatcataaagcgtaatggtatcagttcaggagaaaggtcccactgctcctgtgttctacgtcagtggctgcagggccacagcaggcagagataaccaagcatgctttcactgccctgatcaccattcccccattaataatttgcttggccctttccttcctactgcctgaagaaaatcaatgtttggcagctctaggttgaattactgtttattttatctttagcctacacaactgcaaaaggaaagcctgagttttccagtgcatattccaatacctgtttatggaagtgagaacgagtcagatagtgatgtattttttcagagagtttcttaagccagctgtggataagaaggtccaatttgcattggaactgctaactaggactcagggaaatcccatctggtttagagaagagtaaatgaaaataaaacagaattgtgaatgcaatgcttcaataattagtttgcaaaacatgtatccactgccttgtgtgggcaaagcaccatattaggaactatagaggactgcaagaaaaacagaaaaacagagtgggctccttttgcaaggtattcgtggctattccaggcatcctttcttctttcagcagtgatctcctgagttattactatgtgcctggcgctgttctgtggactgcggacaaagacaaagtctctgctctcttggagcttatattccagtgaagtgggggaggactaaatgtaaatacatgggcaaaagtcagctaataaatactgtgcagagaatcatgaggagttgatgttcagttagtgagcaggctggttcgttactagggaagatgtgaagggcctctgagaagtaaaattgtagcagagacctaaataacgagaaagacctagccaagcactgagcaaggcaagggatgttcctggaagggaagccagagagtatggccagagcccgagatatcctgggtctggtgagtcatagatgagactggagtactggagtaggcagctggcaggtcacagtggactttcccagtgagtcagggattttgatttggggaaacctttggggattttaaagaggaaagtgacttgatctgatttttattggatactttaagaaataaattttgttttgtatacttaaggaatacaacatgattctatgagatatatatatatagtaaaatagtcaccatagagaaacaaattaacatatctatcatctcacatagttatacattttccccttatgtcaagagtagccataatctgatttagcaaaaatcatgaatacaatacactattactaactacagtcctctgcacattagatctttagacttgttcatcctaaacacctgttacttggtattctctcacctacatgtcatttcctctcccacctctagtaaccactgttttattctctatctctgtgggtattagacattgtttttttagattccacatataaatgagatcatgtaatatctttctttctatgcctggcttatttctcttagcataaaaccctgcaagttatgtatattgtagcaaatggcaggatctccttatttaaggctgaataatattccacttaatattttataatgtgtccatcccttgacagatacttcgattgctttctatcttggctaatgtgaatataggtcgggtttggttccaaaccatttcaacaaagtgaatattacaacaaagcaagtcacatgaatttcttggtttcccagtgcatataaaagtatgtttataccatactgtgctttgttatatgtgaaacagcactatatcttttaaaaaaatactttgataaaaaatactttactgctaacaaaaatgctagtgatcaacagtattcagcgaatgtttttgctggtagagggtcccgtcttgatgttgatggctgctgacagatcaggatgtgggtgctgaaggttgggatggctgtggtaacttcctaagacaaaaatgatgtttgctgcactgactgatttttcttatcacaaaagatttctctgtagcatgcaatgctgtttcatagcattttaatcagagtacaacctctttcaaaattggagtcagtcctctcaaactgtgcctctatcaattaagtttatgtgatattaatatttaaatattttgtcatttcagcagtgttcacagcatcttcaccaggagattacttcttatgaagtcattttactaatccataagaagcaactccttaaccattaaagttttttaagaaaaattaattttaatagttttggggttataggtggtttttggttgcatggataagttctgtagtggtgattctgagattttagtgcacccatcacctgagcagtgtacattgtacccaatatatagtcttttatcccttgccccctcccaaccttcaagtccccaaagaccattatatcattcttgtacctttgtgtcctcatagcttatctcccacctataagagagagcatacaatatttacttttccattcctgagttacttcacttagtataaatggcctcgcactccatccaagttgctgcaaaagacattattttgttcccttttatggctgaatagtattccatggtggatatatataccactattaaagttttatcataacattacagcaattcagtcacatcttcaggtcttacttctaattatcttgctatttccaccatatcttcagttacttcctccactggtcttaaacccctcaaaactctccatgaggttttgcattaaacttcctcccacctcctgctaatgttgatattttgacttttctcatgaatcacaaatgttcttaatggtatctagaatggcggatccttctaacaattttttcaatttatttttcccagatccattagaagaatcactatctatggcagctattgccttacaaaacgtgtttcttaagtaagatgttaaagtcaaaattgctttttgatccatgcacagcagaatggatgttgtgttagcaggcacgaaaacaatgttagtctccttgtatatctccatcagagctcttggatgaccaggtgcactgtcaatgaacagtactattttgaaaggaatcttttattccaagcactaggtctcaacaatggacttaaaatatttagtaaaccatgctgtaaacaactgtcatctaggctttgctagtccacttaaagactacaggcatagtacatttagcataattcttaagaaccctaggaattttgaagtggcaaataagtattgactttaagtcaccagctacattagcccttaactagagaatctgcctgttctttgaagctttgaagccaagcactgactcctcttctctagctgtggaagtcctagatggcatctttttccaatataagaccattttgtctacattaaaaacctgttgtttagtgtagccactttgatcagttatcttagctagattttctggataacctgctgcagcttctacattagaactcgctgcttcactttgtgcttttatattatgaagatggcttttttttttcttaaacctcatgaaccaacccctggtagcttccaactttacttctgtagcttcctcacctgcctcagccttcatagaattgaagagttagggcctttctctgcattagggtttggttaacaggaatgttgtggctagtttgatctatctagaccactaaaatattttccatatcagcaataaggctgttttactttcttatcattcgggtatttactggaacaacaattttaatctctttcaagaacttttcctttgcattcacaactcagccaactgtttggcccaaaaggcctagtttttggcctatttcagctttcaacatgccttcctcactaagctcaatcatttctagctttaaagtgagaggtgggtgactctttctttcacttgaacacttagaggccactgcagtgttattaatttgtctaatttctatattgctgtgtctcaggaaatagggagatgggggtggggggctggagagagacaaggatagacagagagagagagagaccgacccagagagacagagagagagagagacagagagagagacggagacggggagagagacggagacggggagagagacggagacggggagagagacggagacggggagagagacggagacggggagagagacggagacggggagagagagggagacggggagagagagggagacggggagagagagggagacggggagagagagggagacggggagagagagggagacggggagagagagggagacggggagagagagggagacggggagagagagggagacggggagagagagagatggagagagagagagatggagagaaagacagagagagagacggagacagagagagatggagacagacagagacagacagggagagagatggaggaagggcaggttggtgaagaagaacacagacaatattaagttcactatcttatgagtgtggttcatggcaccccaaaatagttataatagtaacatcaaagatcacagatcaccataacagatacagtaagaaaaaaagtagaaatgtgagaattaccaaaatgtaacacagagttgcaaagtgagcacaggcaggtagaaaaatggtgccaacagagttcctggatgccgagttgccagaaacgttcaatttattaaaaatgtatctgtgaagcacagtaaagcaaagcacaataaaacaagatatacctgtatttgtttttaaatataaaaataatttgctttaatgctgaacaaaaatgtcccatgtaaaaaattcatgtgctatctgttcccaaactcagtttccacacctaattacagtaaatagaaaggagagaaaaaccaaactttcaagatggaaaggagaacccaggacagcctcaaacccaacacttagaatggtatttctgcatgcccaatctacagcaaactttcagacttaagaaggaagagagaatggataaaacgttacagaagacagtattacattttaaaaattggtaagatagtagaatgtttagatctggaaggactttaaattaatcttttttccttacattcagataagctttaatgtgtactaaattctatcccaaaatctctattctttgtgaccctactgtaccctacgcagatttttgttgactcaatactccactgcacttaatttgttttttagtctcagctagacctgaaacaactttaggaaagggatagtgtcttcttgcttacttttatttttcctaccaactagaatactaataatcattcaaatgtttattgaatgaattaatggataagcaaatgaattaatataattagttgcttatattttaccccccacactagcctatagctttaaagttgtggtgactacaatgtctagtcacttaacctcacagggcagatttgctcaactaataagattttgaatgagaaagtgcttaaaaattctaaaagtgcttctctaatatttgttactattgtgttcaaagactgttagctaccaaatgaaggtttcatagtcaacagaggaggctgaatcccagacaattacaactgaggcccgggctactccaagtgtgatctttggagtatctgactcagcaaacaaacaagaatcacctcaacccaaaaccctaacccaaatagccatcattactacttccttccaatctccatctccacaccctccaataatgatgaattcttaaagcttgaatacatgttttaattgtaaatttgggttatttctgcatgtaattttacagttattttatttcacccttgtgagttggagttaagctctgaaaaggtcttattttgatgtctttccataagattgtattccttttttggcaagagaacagatctggagttgagctcctgccctctaccaaactgtgaaatttgagacaagtcacttgtcccccatgccaacccctggggcctcacttttcttattcaaaaagatcaaagattttgtcctaactcatgaaatcatgagcattacatgtaaaattaccttagaaactataaaatattcatttcaaatgcatcaagatgttattagctatattttatgagctcagcactccttgatggtcctgaagagaccaaaggggctgaggccaaagggagaattctccttaaatctcttggaaacaatctgacagaccttagaattgtgtagtaagatgaggacataaaggaacagagggtcaaggtagtatcttagctcctttctcccaacgtgttgatactggttaagatacacaaaagggaaaacccacctaagaaactgccaggaattcttttttttttttttcattttgttttaatgctaacttaataatcatgtcttagtgtaactaagcttttcttcatcaagaacattataagctcattgatgcacaggctaaatctttatgcttatttggtgctttttaatctgtctagcacagaatagggcacaacacaggtcttcagtgtgcctttgctgaattgaaatacaaaaaaatagcacatctttcaatacttgaagctcatttttataaagtatatgtgtgtagtagggaattctaaaaactattttttgctggtactagtttatttaatcaagaggaaatatcttcataaagtcaaacaaccagaaaggacagtgcaaatggccctcaaagcttgagcttagcaactgctcccctgttcttagtcttgccactgtgtggaatttaggacttctatatgcagatagtttgttacttgcaaaccattagaccaagcttgtcctacccacagcacacagggcgcatgcagcccaggacagctttgagtgtggcccaacacaaatttgtaaactttcttaaaacattgagtttttgcaatgttttttggtctcataagctattgttagtgttagtgtttttttatgtgtggcccaagacaattcttcttccactgtggcccagggaagccaaaagattgaacacctctgcattagacccttttaatactattataggtaatatattttacaacataaaaaaatcatctgtgtaccagtcagaaatgaaggttttgtatgaaacattttcattcttcagtatcaacagcccaagattctcctgactttatttctccagccctggcccctcacctcaccatctcttagctggccccagatatggcccaggtgttttaatcttctgggtgatctgatccagcctcttgactttaaatggcatctatatgatgataattttcagtttaagcctcccttcagaattccagtttctcaaatccatctggctattcaacctttccactttgatatttaagagacactttgggttcagaagagctaaaacagaactttggattccccaaacttgcatgtcctccaaattttctcatctcttaaatttgattcaggtgtacaaactccacatttgtcatcattcttgggcccctgtcccaactctcttccccacacccagtcaagaagtcctgttgactctgcctcgataacaaattgctcacacatttcctttgctccagctacccatgctgtagtgtaagtcaccatcatttcttgcttgaattctgcaacggcttcccaattgatctccccaattctacttttgcttcccaaaagtccattctccataccgaagccaaagtaatctttaagaagtatacatctaaacaaaacacttcttcacagcaaagaaatcaatacaatgaaaaggtagcccacaggttgaggaaaacatatttgcaaaccatatatctagtaaggggctaacttccaaaatttataaacaactcatacagctcaataacaagaaaacttataacccgattttaaaaatagacaaagtaacccgaatagacattcctctaaaggagacaaaagtggccaacatgtatgtgaaaagatgcttagcataactaatcaccagggacatgccaataaaaatcaccatgagatatcacctcatacatggtagggtaggtattatcaaaaagacaagggacaacatgtgtcgatgagagtgtggagaaaagggaaccgttgtacactgtgggtgggaatttggattggtccagccattacagaaaacagtatggaagttcctaaattaaaaatggaattgccatataacccagcaatgccttttctgagtatatacccaagggaaaggaaattaccatcttgtagaggtatctgcactccatgttcattgcagcattactgtaccgcattatgaaatgggttccttcaccccttttctgagcaccctccatgtctacagaagaagttatgaggaacaaaggtatatgcagggctcgttttgtaatgctgacaacagcaatcctcacatccagacttccatgtccatgtacagggttctctactttcgttctaagtcaaactgtgattcagaaatgagccatccattctcccagaattcctccattcaccccacagacacaaaaatcaaatctatgaaaatgtttttgtatatttcataggagaaacagatgtggaggcttaactcatgtatccaatgccaaaagtcttcaaaatcttcattaggtatttgttatgccaacttctttctcagccctcccggtttgtaactttttaaatctttacccagtgttgcacgaagactgttgagatggttccctctgccttcctctctctagtattctccctgggaagtttaaaatatataatgttatgtaaagtaactcactggggccttcctcttgggcctcacctctatacactgaagacaatgctttctagcaaggaggacccatgcttccagagaggagggtttgcaactggagtaacttgagtatgtctttgggattcttgagctcaacccaaagcagttcagaaacatttctttgaaacaagttcccaagatgaattctaacaactgtaatatcgcatttggcattttaaaaattttgattttacatttagacagagctattaggacatggtgggataaaaatggtagtatcgaaatatactgtttcaaatcaaattattgtattatttgttctcaatgacagacataacccaaacacattcttagtacccagaataaaggcacagccatgaaatcaggcagttattaataaaaacctagtgtagatagctaatgaaagatgaaaatgaagctgtgacatgattatgaactgctattagcaagcaatgtcattttgtatcttagagaccaaacaaggtttgtgtatgtgaactaatggttgacttatatggtaaagatatacatgcattatattcaggctatgttggcttcatttgaaactacagcttccatgggtttaaaaaatacacatatgatttgcaaagtgacaaccctaaattttcgtatattcaattgttcaaaccagtgatttctagaatgtaagtggtgtcctacttgtaagagttttaaaacaggcaattttggaataggtaaattactcagtagaagccttagagaacccaaattgctgatgtatctttttcgaaatgcctctcattatccaggagaatgtgtgtattggaagtatcttattctttaagtctcacacttagaccggttatgtttcctacttttaaaaattgtagaactttattctacagatgtcatttgatgccttttgagaccgaccatatatgcatttatacaatcttaattcaatgttaaaagtataattagtccaaaaaaatcaactaaatggcaacaagggtttttctttttctatattattaatttttttttcctccatctaaaactttccagctgctctttgtgaagttcccagaataatgattaacattattaaaccagagactaaaaatcttggtacggactgacccatggggacacattgctataattattttaaagtaaaataataaaaggggcgtcccatagcgggcaaaagttggactcatcctcaaaatttactctatttgtcaaagtcccctaaaagagttcttaggagtggttggaattggttgtcagaaccaggtgctctcaagtgtcttgcctttgtggttcgcctacctgggtttcccagtccttggttgaacattaatgttctcaacgagatataatactgaatataactcttgtgatctcttccagtggaggctgaggccatttctaaaaattccttccctctgtttcttctacagtatcttcctctccgtgtgcatacatgtgagaggcatagttttccccaacgtacttcagataaaccttattggcatagttttcctcaaagcacttccaataaactttattcctttcatgattgtcctgtagtttacagacactgatattgtactctttggagtggagaggggttttgccattcttacaaaaaaaaaattggctattcctccatttatcaggctcattttattaacattctactgtcatcattgtgctctgtcactttgactaagcccaagaaccctcccacagagcaatgttaattataacccctctatgcccgtaaaatatgccatctaaaggctttgaataaatttgggataaatttcctgaagcagaactcatgaacccatatgtattttgattccaattcctgtcaatacaggttctagttcaactcccaacacacacacacacacacacacacacacacacacacacacacacacctctcacatgctttccttctaattggcaagaagccttcagatgtccttcacccctactggaaaggcatgaaacaaaacccagtaccttcctcctacccctaaactggttttgtcttgctgcccctaatcctagcttgctgttctgtttttctattttcccctaaatgcaacttactttaagcatgtgttaactggattaacattcctacaattgaaggatagtatatgataacccatttgtcagtctagctactttcttctcttttaaatgtctacttacgacgtacatccagactgcacgccctttttattttttcaaagcaaagccaaaaaataaagaaaacgtaaaattagtttttaaagaaaatgcacaatctgtttttaattttggctatcacgaaaaggggaattaaccagccaaaaaagcaaagcaaaaaaaacgtgtcccctgactgctctgtctgtgcctttcaagcctgtgcgtctggttgttcatctctgaaagtgtgtgaaatacttttttctttaaactttttgtttttttctcccttcttgtttgggaattaagtgctttttatattatatatatctatatatatatatcaatgtgtttcttttaattgctagatctttatcttagatttgattttatctaaaattatgagaaaaaaagttatgaattgttttctgcagtttttccccactccctctttaaatgtggaacaacttcagctgcagaatcctcacatccacatctttcaaattagcctggtctcattgccaattgcgtgcaacatgggtggcataaggaagatggatgatgtcgtttggaaaatgccatttctctatagagaagtaattagcaacccagtgcgtgggccccctgcttagtagtgcgtctcaatcacctctgtagatttctgaacctcccccactctagatggggctgtgtggctgccgatgaagttgttcaacttgaatgcataaatctagtcttcttgtttttgctttaaactttttgatcatgactactagtattttatgtattttggctatttttagtaggaaaaagtttaactgtttttattatttgaaaatctttaatgaaactgtaataatttttggagtaattgcatgttgaagaagttgcagcttagggtgtgtgagattgtcagtgttagagttctgttctttatttccatagatgggcatgtgtaggctcatttgtttttgtatattgcccatcccttccttacagccagaagctctaatgcagctagatcactccgtgccgcccttacatggacatggcgactcacttacacatttactcctatcatcttcatctcctgtgtagttcactcatagatatgaccctccccttcctgcatctttccttcccattctccccctttctttagcattgttaaaatttatgtgctgtcatccatctccctaaattaaagaaagcctaaaatttgtcaaaaagacaaaaaaatatatatatctgaaaacttataaatgcagaaattcattcaaaacccgttagagtcatagaattttttgaaaggcaaattataaaagtaaacaggtttttttgtttggtttttcaatcatagcaatcggaattattttaaattcaaaaattgatgccctcccaaaccccccaaagtaaaaatttgttaaagtgcagattttttttttctttttatgttatgtggtgtggatgtatgtgttgttgcctccctgtatcatcctctgttgtaaattattatatttgaaaaattagacattttgctcaaaagtttttaagaaatgacaacaaaaaaagcaagttacaagaatgtggcaattctatttgtccaagagcattcttacacaactttcttttgtaaatttttctttcatgccaaaaaacatgcgggcaatttgttgatgtaagttgactataaattaatatggtatgcttttttagtttaaattattttgcctatatggaaatgatttctttttttcccagaacagcttctatttttaatttgcttttactttttctttccattcttattatattgtgaatgcctcaatgttatttgctctccttctcccagcttactttggctacgaagttgattttattttctactatataattttgaagactatattttttatttcatttgtgtcgatttgctgaattttcactgttatgttttgtgctgaattgcttctaataatcaatgtgaattctactctcagtagaagggggttaatacattgttcttaccacccaaagaaagcctggcctctttgcctgaactttttcaccaccgtgtttaaagccttgaaagtattggtaggctctatttggtatcttaaaattgtttccagccagtgggaggcctgtaccctagaagaaaatgagttgagttagctccaagtagtaccagtggtatttgcatctttttaaaattccttaaaaagcatttaggaaattagttcttttccttcagcaaaggggaaataaggtactctcaagtgactatggtagagtttggttatccaggatcatactctcacttttgcttcaggctacaaaatcaattatactgaaaatgcagatatcaagaatcccaggtgtttcgagtattgttctatgatactgacgccttccagtgtatggaactaacaactggcaaaaacacagacacacacagaaggcacacacacattctctctctccctctttcctttgtctcttctccttttccctttttcatttctctcaaggatttaatcaggtaagctttcagggatcttaagattctaccaagaaaacatgatgattttcatatctaaagttatacttagaaaatatttcaggtgggtaccatcatcgtgtaactacagggtaagactattccttcaccttaagattatttgaaccaatgctgccttatgtacttcaacatacataagattggtaagaagcactatataattttttcatcaagaagttacttgttttgctttacagatatttgtgttatttgaactgttatagaaatatcaaactgaatggtggataagagtgtttccaagccagcagcttaatatttgggctctctctacctcagtttatgcgattttgtgttgtttgacatgctggataatattttaggtctaaaacttagaacttcctaaatgggatgttgttttatcttgatgcattaaaatattttctttctatgaaaaagatatccaaaggtaaatttaataaaatgttatttttaaaaaatacaagctatttgaattataaattatttcttatattctattatttaaaatagcctcaatatataattatacttctactttagcatgaagccactaaataaaaaagggttagaagaaagtgattatgtaagtgtttatagctcagatacattagtagaaataataacattagtaactagcatttctgaatagtagtaggtactgtgttaaccatctaacatataaaaaatacttgatatgcattattttaatatttgcattgatggtttgaggtagggtattttattattctcattttccagagtttaagaaatttgaccaaattcctagcactagtaggaactcctagagagttccgatgttaagagtctgagttacttcagaagcaaagctcttaataagcaaatgaaacactccacttgacatttcctgttttgtaatacataatgatatcaaggggctgtggctcatcttattgttgaaaaatataatctgtagcctttccaaatcaaacctatttcagacaaaccctttgctggggtggaagggtggtggggaagcgagggagaatgccctacctagaaattctcatcctgttaaaatacaagttaagcctctttgagacacttgagtttttctactgtcttctccccaggtacttgccctgtttgtccatgactattttttcccgaaggttgatagagagcaatttcatggttacaagctttatgatatttatgtgttacaaatacacacttctatgtcaccaaagagctaaatatctttgaaaaattaattcttggggggaaaagaattatttccccttatcatgtgaattttcaggaagaaatttggaataatgcaaataagagatgaagtaaaatacccaaatatataaaaagaattcaaggaattcaagcatggtgtcctgtcccagagtctcactgttcagcatcactgttttggtattttcgtgaactctcaaaacccaaatatctccagagaggcaagtgttgaaacttcatgcttgtttttttgttctttttttttttttttccaaagataacccactgcattcactatcacccacaacattctcacagttcagaagaattctattaaattttttatacactgtcttttttgatggcagtgagccccttttgctggatatcagccctagaggcatgaattatatatctacaaatacactcataaagcaaaaaagccgggaagccttcagggctaaaatagaccttttatatctctaatgatctctctagtttaaagaaaagcacaatcctgccaaaaaggggtatgtatgcctgattttaaaatgctaactttaaagaatatagatagcttttatcccaaactaaagaaaaattctggggatagcataggaaattaggattttgatggattacaggttttgtattactctgctcataaccctttatgactttgggttatttgcttccatgaatacttttgtaggcatgggacacatagttgatcactgacttcatgatctctgggaagtgaagaaaatattatcagctacttgaacatttctcagggtagtcacttttgattaaaataaacaagaagctttgaatagcttcccaccaaactacttttttgtttgtttgtttgctttttgagacagagtctcgctctgtcgcccaggctggagtgcagtggcgtgatctcggctcactgcaagctctgcctcccaggttcacgccattctcctgcctcagcctccccagtagctgggactacaggtgccagccactatgcctggctaatttttttgtatttttagtagagatggggtttcaccgtgttagccaggatggtttcgatctcctgacctcatgatccgcctgcctcggcctcccaaagtgctgggattacaggcgtgagccaccgtgcctggccaaactaagttatttctattaatgatcttatagtaggagaaatacatcactttctcctctcaaatgatgtgtgcctttgatcccccaggacactattatcatctgcaatcttaaacatggaatttaatattaaaattaattacaccaacatatacacttgtcccaggcatttttcatgtttacagttatctaaaatgttctacctattttcattagaattgctatttgtcataaggacccccgtgtactgcagttgacttcattttaaactaaaggcaatcttcccacttcttgagaagccaggaaagaggggttaggaaagcttctaccactttgttgtctaaaaatcagcataatttgggctcagattttcccaacagagggtatcatttatcatttttatcgctgctaccgagattaataacaaaatggcaaagaaaactagagatcagtagttctgaaagattttgttttctaaactctgagatggcatacccatcattttagttttaaaataagctcttatcatttcactttgggactcaccaggcttttagaagctctttataaattaacaagcttcagaaccctcttactgtagagttataaaaaatgtggttactcttttttttttttttttaaatctaagatacttgcattagtgtgttaaatgagagggagatagcaaagtaaagtaattcaactgcagagtgaacagtttgtagattttgaaacaacaagtacactgtggaaactttagctggtattgaaaggagaaaaaacaaaccgaaaaaacaaaaaggcaaatttaagactccggttgggtgtcacagatggtacactaaaattgcaaatgaatgccactctgtaatcatgaagatggtgatcttaatcccacttaaagggacactagcctcttacccaacagtttgcctttatattcaaactatttgtaccagggctttgcctcctaagatatcagttattccttgtcctttaacctagtttcctctttgcttactctacatggggtagatttgtcattgccataaggaacaaatgactcggtgtttgtgccagaaaagaacacacatgttaaacctgtgttacagataagttaaaaaaaaaaatcctgccttgtcctctgaaggtaagtaaaactgtgcctgagaaatccttacggaagctttagacagagtccatgggccttcacttcctctctctcatcactgctctcctattactcaaaccttgccctctttcatatatcaccttaaatctaccacttgggaccccctagcagaagaataataaaaaagtttgctcagagttagttttaggactggcttacctttagggaactgcactccaaatcccatttgtaaaaactagcaaaagtgtgtaaattatgcattaaataagttgtaaggcatatgaattatatatgttcacaatgtaaaaaaaagaaaaaaaaaaaaaacaggtgtctgctggtctagtacagtaagtgtgaatctttggcaaatctgcacagatcattttgctcaatagtttcaaactctgagcaccagaatagaggcttaggtttagagcacatactacaagatcatcttgagaatctcaaaaaggtatttttttaaatttcatagtaaaattatcacataggccagagatgacactgcaacattctgttgtcccttcccttctaaatggtacacattatatgctttctcggttccctcagaaactcagtttctttctgcagaacacaattgttattggctaaacagggagagaataaaggcttctgacatgggcaccaacagtttctcagtgcttgaaggtaggtattagctttcttctcaggaagcccttctcttagcacacctgaaacctggacaatttggatgcatgggaaaggtttcaggatgcaaggtgtggaaaggttgcatcttgaagcatttcctatgcattcaaaaggagagttttaatttgtgaatcaatcttcataggaaaaaccctggaagactgtgtaggctccaaggcttattcacttggagtcccctagaactctggtactgaatcacctccttgtctggctttgttactgatgaggtgggtacctcagctacagtcttatctgttaacagctactcaaacactgattatactatcacagcaaagttattaccaagtgtaagagacacacgtacgtggtaccagttgacagctcaatgggtcagctcagaaagaggccttcaacaataacgtcacattagtacctcaaccttctaaataactggggcagggaaacattcgcagcatccctgcgagtggattttttttaagtgatagtgggaatacatttttctggaatatattcaataaagagacatggactatgacttcttaagattcttcctttgcttggaaaacaacattataaagacactgaagagagatcagttatcctgctgacatagatgcatagcaatcttggccttacagtagggtaagcaaccactactgcagaatatttgtggtacccatgatctgcaaggccctgttatttaatgaactattctgagctttctttcccaacttagtctgtatgattctaagtgcaataacgagggtctatgggtaaacagatatgtttttgccacactagttagcaatcaccaatttaaaaaactcactttgctaagtcaacatttctgagtctaacagtttcaagtcatggatatctaggctgagtattttgaaaatctagcttccagctcagcatatattgcatacagcatgaaagcaatgcatacaaatattagactaatgcaaggcaagctgtcatttaatagtcagggggatttctggaaaagcatggtcaaaatggatttgttagatgaatatttttaactttttaaaaatccctattgctcagcttatagtaaacaaggactgtgattaataagtgtgaaataaaaggaagtaacttaagaaaacacaaaagacacaatcttttatgtttcttgatcttggtctcaataagatggtgaatcggtcattctcatcctcctgggagcaaatgagcagaatcccaagaaggcaataaagaaatcttaaacgcatgttaataaattcttaagttaagcacacaatgtgtgcgtgtacccacacatgccaattttgatagccagccagtatttataacagtatcattgactgaatgtcatcagcccataagcagatcctggaaagaacatatatagttgaattttatctaaataattacttgagagtatctttaaaaaatctaagcccctgatctagggatttcaggtttgggtggcaagaggcatacagaaggctccaaatctgcctagaatgattagactccatccagaaaagatccagatctttttattataatttctgaggcataatctgtgaatgacgttggttgagtgagagttgtttacaaatatactaattgtttttctttttcttttccatcccaggaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcagatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttcccaa

SEQ ID NO: 793 - DNA, 585108 bp, Homo sapiens
tgatttgctctcgggagtgcgctatttgcatatgacttgcccatttgtgaatttggctccccaactcctcgcttcacttcacctgtgcctccctggtccgcgcacttcgcaggcgcccgcccgcctctcggccacctctgcagcctgccaggcacctcctcttgcgctctcgctgatttcgcccacccacctccctccaccccgtgccacgttggtttgggtggctgctccgcaccgggttcctcctcctctcctctttccctccagtccttcttattctcttcctctggctgcggtggctgctgctgctgctggttttcatccagttgggaaacccaggaagccggcggctgctccgtggcgctagtccagcacgcccagggttaaaagcctcgcgcccttccgcggagactcccaggaacacccgaagaactcttccacctgcagcccccttttgcctggcagttctgcattgcatctcatggaagtggaaacaggaaaataaaaatgttcaaactccttggatgttgggataaactcacctgaacccacttgggttcgggctgcctccttctcttccttcattgccacctttcctctgtgtggctcccgggagtgtgcggttaagtcatcagactcgaagtgcctagagatccggaggaagccgcgccggtcttcccctgacatgcgtggcatgccggggctccgtaggaggtttgctatacctgggaggaccctggcattctaaatttcagctccgggaaagagaaggggctttttgccttttatcttttttttttctttctttaagtagtaattttttaactgattcattgtttggaaagcgcatattgcttccctcttccccgaattctggcaactcttcctcctgctatgatgggcccttgggcatcatgaacttcattactcctcactggctggaattcaaactgcccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacggtaggtctctctgctctttatccttttaatggggcatagcaattcgctaacccactagccttgcaggtagtgtcaaaggtgggaagggaatttaaaaaaaatgaatttaaaatgatgaaaagcatcgtatgtccatgagggaagcaaatttctactttctcataaaggttagtgttttctgcccctagcctccgacaaccatctccacttttctctaaagggttcttttccccttagctccctcattcatagctgcacagacaccacactctctcttttgcaaccttctactctctccacccccacggagacaggcaacttatcaggtgagtcccagtgctgtacttggagaaatattcattcaccttgctttcacccttctttgctgtggtcttgcttgggagctagtgggggtggggtgggaatagctgacaacaggaatcaggttttcagcctgaagttgattgaactgttataaagtagcctgtgtggtaatggtcagggaaaagtagccgaacataagaaggcagaaaatataattaacaacctgtggccatttgtgttgaatttggcagctttatgtttgtccacatatctagtggaaaaagcagctatctctaaaactacacatctactattgctatcagaaaggaagcaatatgtaagataaggctaagttcatttataatttacccaagtgtaaatgacagtaacttggattccccgtgtatgcaaatgttatttcatctttaggtagcagagatgggcttgttcacacaatacaggtacgatgggttttactccaaacaaccctccttacatggctattgagggaagagatctatggctctgaaaatgatactcagctgttagccggctgcctctaaaagggcgatgtctgcagctaaggtaggagcttgctgtggtaaactgttctaaagaaaggagcttcttaatttgtttactatgcactccactctgatggtaaggagagtaggacacacagaaatggagactggtcttgcttgggagctagtgggggtggggtgggaatagctgacaacaggaatcaggttttcagcctgaagttgattgaactgttataaagtagcctgtgtggtaatggtcagggaaaagtagccaaatataagaaggcagaaaatataattaacaacccgtggccatttgtgttggttttggcagctttatgtttgcaggaacagccctccagggaacatgagcgtgaaccatactagggggttcctgcccttgtattttgaagactgataacatccagaccctatttggaaagttgattcttcctgctgcctcctagccctgagctttggctttatgctgtctgtagtgtaagtggaagcacattgagaaaatgccagcacatactctggctctttttgactctgtctttaaattttatttgatggagttgtcaagcagctcacagcttgtaaggttggtggagggggatggtgaaaagaagggattgcttgatcttgatctggtggctcttttctctgtgactcctgctgggtctggtgttggctcccttaaaaaagaaagaagcaaacaaacctaggagaaaaaagagccacaaccaccaaaaaagcaatttcattgacatggaaacttagctcctaagggggagagggactggggggagcgggtaagacaggaaaaaaagagggagtgggagataggggaagccagagagactgttactaatagccataattaaacacggaaatgctcagagattagctaaattttgctaattactgtaaatgatcagcagggagaggaagattatgcattacaggttatgggtggcagggtcttgatatcttttgttcgggttgtaaacagttacagcagatactagtaagtgatggaatttgcagagcagtacttccctagggtccctaagtcagagtcagtctctctctctctctctctctcataaaggggttgagccttgcacaggttaaacatgaccctttatttagtttatttcttcaacgattggttgctcagtctcctttaaatctttttgactggtccccagtctagtttctcattaacctacatctgataaggttcagtgtgatggaaaataagaagaaagtaagtaaatggctagagaccccagaaaaggccctcagactcaccagagctgtagagtacagtgaactccatccagggtctggcatggctgagataagaaaactcatgaattcagctcttcagaatcctctttcaatcctgaagtcccaactcattgatttggggcttggagagtgaatgcatctgtattaagtagactccttgcatatttaattggtgtttttgagcataaaatcaagagaagcagcaatcaacaaaatatccctacctctggcttccatcctgcacccaagctgtgaccctttgcgtctctaactaaaaggaccagaagaccccacagagctttgctaatgcacttctcattcttacttggtgtacacttgctttttcctagtccaagacaaagacctagctaacagcaattgttttaaaaaatatttttggatggaggtggtaggaggcatggcaccaagagactgatggttgttattgatgatttactgccaatcttattccagagttaaaggcagcactctctgttgtctgtgaaaaagtaaatgcccttgattttggtatgaaagaaaactagagccttgagtccaagaatcttctttggacttaagagattgttgtttttttaactacacttgctcttcccttgcccatttcctgagaagccaaagtcctcaaagctgctgttcatcagttggtgctcccaccccctttctctactatccagacctatagagagattcatgctaagacagatggaagaaacagaaatcctccaaatagctgatattttacctacacttttgcctgtgcttggttccaagctttagaaaattggttatattatagatttgcttaaagcctttatcccaggacagcctagaggatgctgggattctttgtaaattagggagactaaggccacacttacctggggtgcccccaaaaaatctcacattaggattgtgtttcaggataggattaaccttcttcttaatgggaatctagtaggctcttccccattctgttagagtcctcaccccactttcatgctctcttctgttcaccagtcagtcaatactctttgagcacatactctgtgccaggctgtgggctactgctgaagatacagaaccgaataagacattgtggtgttcagctaggaataattgcaaaagtatatatatatatgcttccatattttaaaaagtgcaaggagtgggtggagatccaaataccaagcgaaattaatacaaaatcaaaatatcctttataaaatgaaggtttacattatcctgttatttaaaatatccctccaggttccttttcatccttggctttatttccatatgtaaatatcattttttatcaaagtgcaaggtagtttagtgattacagatatataaatagtaaaatatatttgtttaccaagctttaattacataagcaacttttgtatattttttccttctttttttccctctctctcttaaaggtcattggacctttaagaaatccaatgtgtctgggcatggtggctcacacctgtaatcctagcactttgggaggccgaggtggggggatcacctgaggtcaagagtttgagacctgcctggccaacatggggaaaccccgtctctactaaaaatacatatatatatatatatatatatatatatatatatatatatatgtatctccaatgtacatctgcctaaaaaatgcttcagtatttatagtttaaatgcaggtttctctaaggattcaaggttttatatgtaccttaaatgctattctctataaaacagcagactttcctgcctctgtagacgatttgtggggactagttgaggacatggaactcttggaaagctcagttttaaaagggaacacaccacgctatatttgcaggaagaactcttgctcagaaaccagggtgtgtgaaaagggggagtataaaagtcctattcaaaccatcttagcagaagtggtggtgatgggcccccttgtgacacatgatcctggagtctttcttggactcattccttgtcccagggatccacccccaaagttttttcagccttgggggcttgttttgctttgatctattgagtgccttcttctgctcagccagctgctttctaaccactttctttatgcctgccttcttgagattcagggagttgaataattcatagtgttggttgacagatcaaatgataagatttatatatctttggccttggtgatgaattaattagattggtttctccatctttggctcctctagatgcgttgtttttcttctttaaaattcactggtgagtggtgggtctggagattaacttgttcttgagagaccaccataggatgattataatatcctagtgtcaatttcttcaggactttcaacatggatcactgggtggtgtggagtaggggcagctatatcatagagaggagagataagatcatcagaacaaaaaacaagacgcacacacacacacaaaaacttgccgatactggctgcgggatgaaattttacagtaagaacttgattgctttcacctcagattttgaatctaaaagagaaatgtatttcattttacattttagtaaatgaacttatcagcccaaagaagtttgctttactagaactctgggtgaccagggagggaagcaaatctctgaagataaatcttgaacttactcatactttcctccttgtattagtttgctagggctgccataaagtagtaaagtactatagactgggtggtttaaacaagagaaatttgtttgctcaaggctctgtagagtaaatgtctgagaccaaggtgtcagcaggtttagttctttctgacatctctctccttggcttgcagatggctgttttctcactgtgtcctcatagggtctcaccttgatctacatgcatgcatccctggtgtctttgtgtgtccaaattctcccttcttataagaacatccatcagattggattagggtcctccctaaaagcctcattttaacttaatcatctctttaaaggccctgtcctcacatacactcacattttgaggtaccaggaataaagctttgacatatgaattttgaagagacacagttcagcccctaatgctctttctcctcaccgtgcgctgccccccaccgccccccaccatcccccgcccagttattgggaaagaagtaaaactgtactgttcagtgaatacccattggactcaaactttcacagcagaaaaataaaacttcagtgacaatggttgcaatttacaaaattcataagatagtgccctaagaggtaatgttgtgtttacagatatggggaaaaaaacagctattggttcagtgaagacttgtgttttctttcttctcagtttatcttctgtgactgagtccagatctttatttgcacatagactaattctgtctgactgcagacacatgctctaatgtccacacattaaagctttctttacctagacctgctacccttctgacccagaccctccactcctgccactgactcctttatgaactacagttgtttgctctttgcctttcctgaaacacaaattaccaactactttcacatctcagcctttggtgaaaacaagagaaaaaataggttaactaagtataaatttctcgtttttcaattttcatatttctcaattgaaaaatatgttaaataggcatcagtttaattatttttctcttcaattttattttttgaaagttcatctgaaaatataaatatgaggtaaattgtctacttcatgacatggttatgaagcttggtgagatgattgagagaataatatatatatatatatatatatatagtgtatatataagttctggttgttctaaatcctaagcaaagcattccatctttggggaaagggtatacctttctttgtctgtttgtttctgtgctcaaaatgcgtgctgatgttgataatagataaataataatggcattctggtggacagtgtggtgttaggtgaggtgggaacaactatggttggaggaaatagccttcaacctcaacctttggttctaagaaactttgtctctaagaaactaagttactaagaaacattgtgaacttaagtcacaatgaataagtcacttggtttcactgagactcaatttcttcacctttaaagtgagcaataataatagttaaccatacttatatcacagaaattgtatgagagattaaacaagttgtattttgtacattctaaaccaatgtgtacaggttaaatattttatgagacatattttcatgataaggctgccctctttgaattccttgcacaaagaggagcttcaatgttgatcatttgctggttggtagatagtggttaaagaacatgcatctgctggttctcctcattttcctatctatacatacacttttttgcctcctagagattatttcatttacatagtactctgagtaaatgtagatgagaaacactttactgtattttcatgtttatggcactagaacacagcatgggacaaaagtcagcttgtgatttttggtaatggtctgcttaggtagaaagtcatgccaggcaaattttagcatggaccaacacattatagcaaatcatttagaagctcagggattcagtaaagtgaaaagagaggactccaagaaatactctgagatcattttggaaattcagaattggatcccatttgcagtaaacctgtgcagaattcaaacattcctacatggttctcagtgtccattgtaaactaagatttttaatctggtttgtgctgggaagaagcaggtgtttttagggacaactaccttcagatgtggaagtgaagtacttcttttaatgcaatttcttaggcttactagggctcaaagtttgtagagcagataggagcacaatattatgccagaactcttagaattgactttgtgaagcctgaatttgaaacagaattcttactgagagacatggtcctgatacatagattttgccccagttttctccctgaccagctctgtaactttgaattataacattatatttttaaattatattcatcttttaacttttagacattctgtgtgataccttgatttcctaacctatattcttggctttacctgtagttttctgcatggcatgtagtatgaaagctccttaataccatagctggggaaaactttccttttcatatcttcatcatttgtacaatgagagatttgagtgagatgatctctccaaatgttttccagcactggaactgcatgagtctctgatttgtatgtctttaaagacaccactgtgcatcttaaacctatctgagttccacaagtctgccagtattttataggtctattttcttgactatcataataacttatgccaaagccataagccaggttttctcttttcccctcagacagaagcagcataatgtaccagagtggcacactgtgatgttataaagcccacaatccaacttcagtgcagtcacgctgagatgggaagaatgcagctttcatttaaacacaccttaataatgctagaaaggagctctatgttatgtttaaaatattctgctgtgtttagccatatcagagcagggggcagactagcaactgggtttataaagaggaaatggtttatttctatttacagttaggattttgagagagacttgcttgagttatacaccaacacataatgtacacccactgtgtgacaggtactcttccaaatgctttacatatgtgacttcatttaatcctcactagcctttgaacctaataaagtgactattttacgattaaaaacattgagactcagagaggttaagtggcttgattaacatggtgttaaagccaggattcaaacctggttgtgaccagaaaactcttggtctttctgctgtaccacacagtctgtcaactcaggaaacagactacacaaacacatcaagctcttttgtcaggaatcaagtacacagattgatgaagcactttgattaatgcagctaacacacctttccaaagcatctacaagactttccaattcctaataagtatttgaatgttttccaatctgcctgaacccgtttcaacccaaggagatagtaaataaaaggagcagactgatgaaacactcacacttgatatgtctttttttttgaatgaatgaatcaatgaataaatgattgagtgaggttccacatgatcaaatctcttgcactaggaaaggagggatgctagtttataaaagaagcaaaggcacaggaagttatgcacccttcaaaagcacaccaatgggctcgtagaacttagagatataagagagctcaatgttccaggtaggcagggtgaggactcaactaagagcatccagttagtgtcaggactggtcaggagcacagacatcatgactctgagtccattgccttttctttcctctacttctcagtccttcaagacactttcttaaattacaaacttgttccccatctctctttcttcagagaaatctccccttatccagattatgtcctgcaggcacatattctgccagtgttggacttgccaggccttccattaaaattaattattggctgggcgcagtggctcatgcctgtaatcccaacacttgggaggccaaggtggctggatcccctgaggtcaggagtttgagaccagcctggccaacgtggtgaaaccccatctctactaaaaataaaaaaattagctgggcgtggtggcatacgcctgtaatctcagctactcaggaggctgaggcaagagaatcacttgaacctgggaggcagaggttgcagtgagccaagatcacgccattgcactccagcctgggtgatgagagagaaactctatctaaaaaaaaaaaattaatcatgagaatccttctaataggttcctggctttgtgtgccaaggtagggtttcttggtgtgttctgaaggcttcctttgtataggaaacctcagtgtgaaaaagtgctcagattcggggttctgtgaaagatgcttcctgtcctggttggatgtcacttgccagaaggcaggaaagaaatggcctgtctgttcacctgttgctgctcctcatctggaagttgtgaccaggatcttgtttgaagacctgtccccagccccagtcctgacctcttgcttaccagctattgagtggctatgaaaacataaagcccctggaaaccagcaagccacattttctgagatactgtcctgccctcccttttttattgttttgaaatattcctctcacccccccacgttaaaacataaccatgtgtattcactcctgagtgactttcccccaaactatgaatttcaactatttccgaggcagtcgttcagaatttgaatataattacactctttgggtgaaaattgtggtttttgctacataaaaaactaatggaaatgatctgcctgttcctgtagtttacagattatatgcttcagaactgacgatatatatttaggctgcttttctgtgtggcacatttaaatgaaaatgaactcggggtgagccaccatggttgctaggcaatagagcgggttgatagagcacggtattaaactgaacccacattggtgttttacttaacatctatttgcttagcacctttgtcatctgtggtgtcatagaagggaaaggaggaggagacaggcagagtctggttatctgcagagactcaaacaagtaggagaaataatcatcccaaacaccaaagtgacatgagcattttcaaaaatttgaggttgcagcacagtcaactcatttaatgaagaacatgcaagacctgaagaaatgcataagcatagcagacatattcatggatgtggtagcaagaggaactaaagagattccccaggctgggttttgctctggtggttccagaaaaaaaaaaaaaaaaaaaatagccaccacgctggttgaaaattttaaaaatgcgtctatgggtcatttaatttcctggcctaaaatcccagatttatcatgagcaagcggtgataggcagcaaaagcattgcggcttctttacaattgataactaatagaggaactccaattgctttgaaaccctggttttaataaaagctgaaagtctcttataagaaaacaactggatcacaataaagcaaaacctcgtcagactctttgggtccattctagccactttctgatacatttaaaagtttgaaaagatgattaaagggttaaaactcagctgtggggagaatttggtctcatgaataatttgggcagagagaggatcctgtgatttggatagccaaagttttattgtttattttttccaggagccaattattatatatcttttttcattgaatcaatatctctgcataatggaatggtcacctttgaatgttctcttttcttaaaacaaacttcttagataagttaaacacaagatgataggaaacctctattttcataagaatgacaataacatctactttggtttttattatagcaattgatcactttttattatgcctaacatttttgcctttcaatatgcctgacatttctataaacgttatagttcatttaattctcccatgaagtaggtggagttgttttcccattttttaagttttagttatttattttagcagagatggggtcttgcggtattgtccagaccagtctcaaactcttgggctcaagtgatcctcccaacttggtctctcaaagtgctgggattactggcatagccaccatgcccagcccattttcccactttaaagaggcagactcggaggcatggaaagtttgagtcagttgcctaaggtcttataggtaatataaggcacaatcaggttgggtatttaagcagtttgaacctgtcctgttcaaactgcttaaatacccaacctgattgtgccttatattacctataagtatatactgaaattatactgaaaacagtatactgaaaacagtacaatatttcataaatactcttaaaatttcagtatttatgaaatattacctgaatggtgggaaaaaatttcaaagtggtattcttaaatggaatactgggccatttttaaaaggacctcttagggtctacctagatacaggataaattatgaagacagaatattttctaaacaggtaaacacctacctcatatgaggtattctaacaaatactttagcttactgcatttaatctttactgaccatccttcaaggtaggcactattgttatcatgaatttacgggaacagaaactgagccccagagggttaagcaactcactctagttcttccacttactaagcagttagcctatagcatctgttgaactcttaggtcaggtaatctgtgcaaatgtagaacagttcccggatactgaaagcaactaatcagaatgcttccctagattcacaaattctattacattataggagaggcttttcaaaacagcctttggaaactcacaccagttccagaatctgctggcaatgaatagttacatctttacatcttcaatcaaggacccaagagtgagggaccccctctcctttgacagggaagcccattggtgcctcattctcctcatgtttaattcactctaagaatccgtttttttcaggaagtttcttttccagtaattacgataggctttctccccaacttatgattttaggcaagcaaccaaactttcctgattttaattctctcacctgaaagacagggaactgtgaggtggcctgccagctttgctttcaaaagtgtggcattcatctttcattaatgccaaaaggcaaaattccaatgatttctaaaatacttcctcacccttatcagatcttattagatcaccttgaatctacttttaatcttggcccttcatacatatggtagtagttctttaaatatgagggtgaaactaatgaatacgttaagaggggcagtgggtttccaacttgagtgaatatgtgtgtgtttgctttcacatgtaggtaaatgtgtgaaccaaaataaacgatgtaacagaaaaccttcatagcagcccaattagttcctagcttagaatgtaaagatcagacatgagaactaagtctgccgtgcattacagacgtagggaggtttcagtacctgcttcttactgctctggtatcatttatcagtgcagtgttgtcacaggctcatgtcaacatgtcaataataatctcaggagaggatagcttttatgtgaaataggaaggtaaacctagagtcttggccttatacagacaacccccttctttgggatgactagtgttttcatgtttcttgttttttccatgccagggagccattttatgtgtgtgtattggtaacctcatcaactgttagctattaaagactggttaaactaattattattaagaactctctttcagaaaatcctgagatagttccttttacttcccttcacaaagtaacttgatattggtccctgagaaatagatccacaacctcatcaccaagttctccaggccctgaggaatgatcatgcccctaaaataatgttctgatgaaggactttctttggactcaaaatctgctttgcatttgtggaatcatcaaatgcgaaacctgcaagaggtctttagaagcccttttcaatcaagttatttttcatgtgaaaaagctaatagaccagaagtttgtgaatagttttcccaaatcacacttttcaaattagaggcaaggcgagggcaacgtgcaagctttcagcttcgctgtttagtctctttctagtctctttctactgcatcacaatgttagcactcaggctttccaggtgtcatctgttttgctgtggactgggaaactgggattgtctccagcaccacttggataacaaatgagcacagaaggagcagagagcagcatgacaaccaagatactccaaacactcgcactgtttcctgtaattaccatccagagagcagctcccactccgtgtcaggcatgtcaccccctcacggggtctcctgctttctctctgccccagcagcctagaggggaaattcagcatgctgcatttcaatcaaactgtttgatgagagcttttgagcctaattacatggaaggttttatccagtgaaaagaaagaggaaagagaaagagagaaattaaattgaagtataaatcagtcaagagcttagatcccgcgcttgctttctttttaatcaagagtgaaatgagaggagagttttaaggatcatcacaagacaccattaactacccaaggagctcttggctgaagatggtttgtcataaaaagaaaagtgtacaatctgtccataaagaggaagtatctgagggtcgtgctgcagtttaggagcatgacactaaaaggaaggacgcttggtttttccgtgattattttatctttatttcccctagatacctagcatattttctcgcacacattaggtgttcttgttctgtattttaaatcaatgacttggtaaataacgtagtgtgttaactcaggtaattattacataggaaagggtatgttatcaactcattcaatattagatacaacacatgaaatcagtattcaaagttttggccagtttccctttgtggttgatgtagtttgggcatatccctctaatattactgttatttatagaatgctttacagtgttacagagaaaattcacggtaattatttgatccacagcacagccttgtgtggtaggaggacaggtagtatgattgttatttattccatttttttaagctgatgtaatcaaaaccaaagaagcataaatgacttgatcagagtcatccaagtattaagtgacagagcaataactgctacccagcttctattacatcaccctgtatgacctagaatcttgtacagaatttctgggttcttcagtataagaaggataggtaaacagcagagaggagtgtttgcaaaagaaatgcattggaattcatactttattattgagtacttatgatgagcaatgcaaggcactggtccatgctctgaactggaatgtgaaacatgagctttgtccccaaaggcttacagtgtggttacaattcattaaaatgatacttagatctatcctttccatctctattgcattttcaaccatatcacctaaacagttgtgacaacctcccttaacagaccttccttagcttctgtttttccctcctgtccatgtttccctcaccattggagccatccatctgaaacaccagtctgatcatgccgctcttccatgggctcttcgtgtcatttcctctgtactcagaacaaaggctggccccttatctttatgatctggcccctgtgtatccccaacttcacctcctaacatatttgactaccttggccttcatctttttctttttccttttttccccccttgaatatatcaatcttgctactaccatagtgcctttatttgatcagttccttttctctgggatgttttcatccagattgccgtatggccactccttcttcttatacgtcaggcttcaacttcaatgttatcccctcaagagcccttccttaatgacccagtctaaaaagcactcttttttagaaggatcaagattatatgaaaaaatttaaaaaaataaaaaataaaaagcactctttcaaatgtctctccagcataccaccttgttttgttttcactgtagcttgaatatctctgttacagttccttatgtgtgtattgcttccattaacccactagaatgaaagttctgagagcagagaccttgctgatcttgttcatggctggactcccagtacctaaggcagtgactggcaaagactgagttttcataaatcttgctgagtaaagggatggatgaataaatggcatagatgcttcacaaatatgggctcccacctagcattttaacctcaatactcagtaggccctttaaaaacatcagttttagtttgtacttttcccttgattgagaatctctcctatttggtagactgctactaatttttcacgttgcagctgactccataatatctggtctgcaaagttttccctatctcccactgcacagtgagtttcccagccttctgtgtttacttttttcgctatagaagttttctcattgaataacaaaaattattaaacatatattcagtcttctactgttttccaggcactgtccagggtgtcagactcttaaacatacatcagatttgggccttgcctacaagaggttcacgccttggtggaagagctcactctcattttattaaacatgtaacattgcattgctgttatttattgatggtgattgttttcctcattaggctctgcctttcttaagggtaaggaatgagtcattcatttctatattttgattggctgacatagttcttcttttacaaaaggtgcttaatggcactcattaatgaaaaaatagagtgagtgggctgaaaaggtaagaacatacagtattttaatgcacgttgtagtgtgacaaacatcatgagataagtagaaactaccgtggggatttagaggggaagatgtcacaaccaattaggtcattaaaaagtgcttcatagcagaaataaactttatatcatgttttgaagaattatttccacaggcatgcaggagatgggctgaaatatacttgggaaaaaaaaaaaaaccagatgttccagaatcagtgactccatttgctgagttatgggcttgtagagctcagttgtgagaagggctggtgaaggagtttggggctctttgatggaggacgttgagtaataactataattataatggacatctttggcatttacagtttgcagatcagtaatgtaaatactatatgacttgtccctttcaattgccctgtaattcttttatcatgatcactatttacaagagaaaaaaagggtcaaggctgagaagttgatgcttaaatcttataggatggtgctgtatcttttcaaaatgtaaaactggttttgtaaatccctggcttaaaaagataaaacaaaagcaaataaataaataaattaagcctctttcttcactgtttccagtgccctctaaatcaagataaaaatgtttaatgtggcctagcagttcctgcgtgatctggcatcactagcatagcacgtttagcctcatcactcaaaggtccttctgccttcttgattccagcgccctggccttctcccaaccattcatattcaccactacagacttgcctttgcttatcctatttaagcagaatcctcacttcttcctttgatggtcacctactcagaactaagaactcttctttagtgtagcacctcctcaaggaaatccccctgccatttctttgagaaattcaaattcccaggccataggttctcataaccttctagaactctctcctgttgctcatttcacaattcctttttatacatttggttgtgagattatttgattaatatccatttcctaagtagattccactggggttagacagggttgttagaaaataaaaatgcaagacagccaattaaatttgtattcagataaataactgactttttaaaagtacaggtatgtcccatgcaatatttggaatatacttataatttaaaaattttgttgtttatttgaaattcaaagttaactgggcatcctatattttatctggcaacctatattttatctcatcagagactatatctgtttttttcttctagcataatcactggggttgtaacaaacaggtaatcatctaatgttggatggataaataaaatgagtttaaaaaatattctggcagcgcatgtaggctgaattggaatgacaagagactgaatttggaaggactcattagcaaactttgaaaatcatcaaagggaaagttaaggacagggtggtggcattgaggctagatagatggagatgtatagaaggaacatttccaagtggggctcagaatttgcacaggtgttattgggtagcaacccagcactgcgaggaagaggccaaagggccatttcaaattattagtgatcaggattaaaaccagtaacggagagaaaaataaatataatgcctctcatttatatagtgcttcacaacttttaaagtgctgttttatgttccccattatgccccttggtaggagagtattgtttctaaaaagacagccatttaattatcacttttctttataaattcaattacatttcccagtccatgtagttcatcagttcagagatgtttgtcttcatttctgtctattttttaacaggtttcttttatttaagttcctcatttctcagtcctgaatcctttatttctgaagcaccaggtaattttgtattacgcataacaaatctgaaatttatttgtatgagcagattgattttatatccatcagattttctaaaaatgggctataactggcttataatgacatgaccagccagaggctaatttctgtggtatttcttcctgatgccagaataggtagacaagtcagaagcacccacttcagataataaagatataattccagttattcaaatttgtgttgaaagcaaatcctttcactgcttatttttcaattagtgccaagtgtggctccatggcttctagctacagaaggccaggtgatcgagcattcttaaccagatacatgaatagggagaccacggttctgcagttgacatttcttcagctgctctttcagaggtcttaacattttttctcaccagatacttgcctgtgagctgctatttgaaagataaggtgtgctgagtaaatgattaagcaagtgagacaataagaagcaacgtaatctcatcagagactacatctgtttttttcttctagcgtaatcactggggttgtaacaagcaggtaatcatctaatgttggatgaataaataaaatgagtttaaaaaatattctagaacaggggagaattctagaaggttatgagaacctatgttctgggaatttgaatttctcaaagaaatggcagggggatttccttgaggaggtgctacactaaagaagagttcttagttctgagtaggtgaccatcagaggaagaagtgaggatgctgcttaaataggatgagcaaaggcaagtctgtagtagtgaatatgagtggctgggagaaggccagggggctggaatcaagaaggcagaaggacctttgagtgatgaggctaaacgtgctatgctagtgatgccagatcacacaggaactgctaggccacattaaacatttttatcttgatttagagggcactggaaacagtgaagaaagaggcttatttatttatttatttatttgcttttgttttatctttttaagccagggatttacaaaaccagttttacattttgaaaagatacagcaccatcctataagatttaagcatcaacttctcagccttgaccctttttttctcttgtaaatagtgatcatgataaaagaatcacagccatgtagaggacgaaatgtgagcttttaactccacatacctgagtgtcactgatcactctctcagtaggtcacccagaggttagcaaacttttcctgtaaaggaagagagtaaacatttccagctttgcaagcaatatagtctctgcctcaacaactactcaacactaccactgtaatgtcaatgcaactacagacaatatgcaaacaaatgagtgtgagtatatcacagtgaaactttatttacaaaaacaagaccacctagtctgcagacccctgcccccagatttcagcttcctgttatgaaaatggccattataaaacctatatggcacagttgttgtgattaaacatttttacatacccaaaaaacttagtaaagaatcaggcatattaatgagagttcagtaaatgctaacctgtatcatgattataagttttagggctgcaaggaatcttgggtgtgacagacaattttctcctttcaaaagatacctagatggaggattcaagaagtatagggacttaaccagggttacaggatctattttcccgcaatcctatttgtataccacttccagaaaccccaagaaatatgatggcatgaagccaagctatatattgcgggatatttgagcatccattcagcatgtatgcattgaatgtcagccatgtataagacattgtgcagtatattgcaagtgacacaaagatcaataaagttcctgcgttggaaaatctaacagtttaagtcaccctagtaactataatgaggtggaaagcgacaagtatcaaaggaatgagtgacccctacgtgccaagcactatgttgaagtgcttacatgtgttgtctcatatgatcccccagcaggtggatttttagcatttcatcctcaatgacattcaaatgttaagtaatctgctctaggtcaaaagttactaagtgatagaacaaagatttaaactcgtttctctaattgcacagtgtgctttctaccagacgctggggaaatcctcatacatgaagtatggtttagttagctattgctacaaaacaaacaacactaaaaagttgtgtttaaaatgggcatgttatttgcttgtgattctgtgggtcagcagtttagacttgactcagctgggtagcttggatgatctcacatgaggtccctcatatagctccagttatctggcagatagacgggggatgatgatggtctaatatggtctcacacacatatctgccagttggttctggttattaggctgaggagcctcacgtgatatctctgtgctttgtgacctctcatttggctaatgttgactgcttcacttggtggtctcagggctgcctcccagagaggtatataacaggagcagcaactcttgagagcttggaaatcatacaagaacactttcgctgtattctgttggtcaaagcaagtctcagaatcaggctagattcaatgggcagggaaataggtgacgtgtcttagtgggaggaacagcaacatcatactacaaaagggtgagcgtgcaaggatgggagggtttcttgctgtgtttgccaacaatttaccataaagtgataactgagttggaccttcacagaaaataaagatttgggaaataaagactttgccagagcagggattataaagaagagcattacttcagattagctgagaatgaggccacacgcctatattgcattattgaggaaatttcctcttgcctttgctccacaagcacattgcttctactagttgcagggacataattaccaatttcatatatataatacttctaacttttcagaggatttttatttctcctatataacgtttaatatgctatatagttttgttgcattgttttactctgctcattcctttcctctctgtaagttggtgtcgtcattgcaacaaagcccaggttcccagctcacttcccaaaagacaatcatgtggactatctgctgtgattgactgtggctgagtgtttgccctggcagcttttttgttgctgaagatgaaagtttgatggactttaagatggaaaggaaggaagaggagaaatttgatttcatcggcagctgtcttactcatcttcattaagatgggttgtggacacttcaaggccattctgaaccagtggtcataaaactaataggtgccactcaacctgcgctgctcgtattattgcctgagacctgtcatctcggtagttattgcaaaaggagaaggaatctactgtagggaacacaatggtccttgtgtgacagaagtgaaactgaaagaaatagatttttctattagctgcaaatcaaacccttgcacatcatcccttggaggtgacagtgcctgattctctaaggcagggttcaaacaaatcatttgggcttgcagaaaataatatgagattaatatccaagtgtgtgtgtgtatgtatttgtggggtgtgtgtgtgtgtgtgcgcgcgcgtgcatatatgacaactacgtggctcctcacttgaagttttggaattagctactaatatatgtgtatgtttaagggatgcatttgtggacttgaagttgaaatagggaaactgagatgtattctgaagagggaaggagaagagggaatccagtcctgattaggggaatattgaaataagtaggtgaataatattcagtctcccaggtttgtggctatgagctcttttcttccagaagtatttgctgaagggagggaagaaaacactccttttcttctgacaatcaaacttttcaaatgtcagcatgcatgggtgtttctctctattcttgaggctcctttttgtttcagtctaacacctcacatcctgtgggttgtaataataatggtagcagttaccatttattaagcccttgtcatatgccaggtgctttacatatattacagtgtttgtaatccatacaagaattattacaagatagatatcactatgcccaggtgtgttagtccatttgtgttgctataaaggaataccggaggctgggtaatttattagaaaaagaggtttattgggctcatggttttgcagactgtacaagcatggcatcagcatctgcttggcttctggtgaggccccaggaagcttttactcatggtggaaggtaaagaaagggcaggtacgtcacatggcaagagaggaagcaagagagataggggaggagttgtcaggctctttttaacaatcagatctcatggtaactacagagtgagagctcaatatttcaaggagggcatgatatggttcgactctgtgtccccacccaaatctcatcttgaattgcaatccccatgtgcagagggagggacctagtgggaggtgattggatcatgagggcagtttcccccatcctgttctcatgatggtgagttctcaggaggtttgattgtttaaaagtgtgacccttcccctctgtctcactctcctgctgccatgtaagatatgccttggttttccctcaccttctgccatgattgtaagtttcctgaggcttcccaagacatatggaactgtgagtcaattatacctcatttctttataaattacccagtctcaggtagttctttatagcagtgtggaaacagaccacacagaccaccaagccattcatgagggatctgccctcaggatccaaacacttccctccaagccccacctccaatgttggggatcacatttcaccatgaaatttggaggggacaaacatccaaaccgtatcaacagggaactatagctcagggaggttaagtaacttacccaacaacacacagcttatatgttgcaatgtaggaatccaaacccccaaagcttgtgccctcctactgcgctaccctgcctcttccaggcttggggctttagggaatgccctttacaagcagtataaagacgcatttaggaatttttcaatcagctcttgtctagatcttctttggaaagtcttcttagttactggcaggtcaaaataccagctacttgatctaatagtgttatcagcaagaaactaaaaatcatgaagcaatgcagactttttgaatcagataggacttactaggccatcttgtgattctaatctaacatcttatctggccactttttctgccttgtgcaggaagtgaggtctggataggtcaaagggcatgactagagcattggagttaatgggaatggggaatgccttctttgcttcttgacatttctcctccacaacactgcacatcccttgtgaaataatttactattttttagacatcatgtcaaagactgaagtgaaagccaccctcttgtgatcaactgaggtcagaagttggcaaatttttttgttgggggtggggggctaaagggccagataataaatatttttggcttttcacaccagaaagatctccattgccactagtcaattctgcatttataactgagaagcaaccacagacaataagtaaagaagtgggcagcactgtatccagtataatattatttacaaaaggcaaagagggctggatttggcttcccaatctctgccttaggcctttaaagatatagcttccctggggaaatctctacactttgagatttatactccagtactaataacatagtaagagaatagtaatggtggtggtaataatagcagtagtggcatcagcagcaacaacaatggcaccttttaacatttgcttaatacgttaaggtttacaaagtctttttacaattatcatctcacataaaccttttaaattcctactcaagaactacacaagcaagggaaacgtgctagctgagcagtgtggtacaatgaaaagagaatgggatatactgcatttagtcatagagattggtggtgtgggatgaaaatgcctagagagtaggtgtgtgtctcctggccccattaggggacagttcattcagcagcagggtgagtgtcggagttcccaaatacatggctgctaatcagttccctcactctgtaggcattttgcatttaaagctgtccagaaaagagaggcttggtctaagaggttgtggtgtaagaaaatctctacatttccacccattgccttttgggatccctgtatgttagtgagcaacagtaaaaagtgacctgtgttaaaaaggtaatggaagcatggtacaattttagagttcatttgagcaaacagagattcatgaattgggcagctccaaaccagaagtggtatggggattccaatgaagaagtatgagaactaagctattataaagagaatgcagacctaatacaaataaaatatttgattgattacagttataaagctgtctttgctgggaaattcctagttatgtaattataagtgtgattggttgagcttaagttctgtttgtcattattataggcatttacaagaaatagctcaagttaagttctgctgatgtttgcaattcaagcaagtctaaggccacttatgaggcctaactggctctgtctgctcaggaattcttgcaccattgaagcattcttcaaggtctccattttaatttagtttaacacctcttaacaccacgccttcaataacatttatttaacacaggtctttgcttcgtgctaaaggcaaacatgtatatgagactctgtccctaaagcatctgtaactctccaaagacatacccctaggaacatcctgaagattctgaatcttgcagcctgccagaagcacagcagtgctgttggcatctctagaccactgtctgtgattgacttctggctctgctacttgtcagctatgtaaccttgggcaagtttctttttctagtctctttgtcatgttcttcatctgtaaaatgggtattttttaaactacccatttatgtagtctgtgatgatttaagagctaatatggtatgtgtagtggttatttatgagctaatatgtgtatattagcttaatgcctagcattcgtaaatactcagataaatgccagtcattattattatcataattgctggtgaaattaacatacaaagtcctgtgcaaaccttaattttctcactatggacttcatacattttcagaatcctagctacttggttctcagaacattcttctaacacctagagattccacagccaatgtatctttgggaacttattgactaacacagagctaaatgaagtaagcagcatttgtaccctgacattttacagatggaaggaatcatagaggtcatctcagccagaaacacattttcaagatagggaactgaggttcatagaaagtaaatgactttgccaaagtaatacactcaggacagaatgagggctagaaccccggggattagtttttttcctctggcctcaaaactcttccttctgccatttttaacttaccaatttcacctaataccttccacatatttttgtgactgtttcaaagattccactagctaccatagaagaagtaatgaactaaccttataattccatcccagtggcttcacctcacctgccctcagtttcctcacctgtccagtgaggcaaacttacattggaagatccctaaggtggttcccagttcagataagatacaatcctaacaaataaagtggggtcggagtggaatgttcttgaaatcctggtatcaatgggactgggatattactctaaatctatggaaacttcaagaacaatatatttgttttaacctgaaaagacagttgcgttccagtgtgaaatagccaccaggctggatgaaaatgtgtgatgtgattccatcattgaaatgagcatgtgttgaccgtaagttcttctctttctctctggggacatttgcagtgctgcagagcttctctgtgagctgggatgctctgtcagcttaaatcctttccagagtgataaatatacattgattttatttgatttggcccataggtgggggataaaaaacaagacatcacagccacactatactgtatattcattccccctgaagacaacgcacacatccttgttgaagtctcctcatttagacaactcttcctttttatgcttcattataatgccactttcatgtcccttcccctcaacatcgtgcaccttgttccacatccagcactctgtgtttttaaattaagggaaatgccatttaaatatggtttttctctttgtaatatactcacctataaaaagtctttaaaggtaatgctaactgctttggcagaaattcaggcatatatatagttattttaatacaaggctatttgtttgcttgactgtttttaatgactactcattaacaccatgatcttatcctcatttcctctgcacagagcttgagaggtgctgttcacagcccctgctgcctgctttctgaggtctccaagatgctagctttctacttttccactcagccctgacacctagttcatcatttgagataagccccagttgtcggcaaattgcaatctcatcaggtctgcaagatagcatcttgtttgactcttttcaacaccttccattaacactttgggactaggtctttgggaagagccaggcctcaccacatgggcgattgtggttgatgaacagattctagttttccccattattgacttcattaaacttgacagcctttttagtctccagatagggtgaaccttttttcactgacccttattaagagctgtctccttaagaagggtcattcgagaagggatagtgggggccactccttctacttccaggaaatagctgattttggtaaacaactttgatttagtttttagagttctttcacctccctaattaggacagccacaatttatcaaatgttagcaatgcaccaaagcctaagaatgatcttatttcttcctccttattcatgggttttattactactatcctaatttcctcatatggaaatgagcctcaaaaacattaaataagttactctaggtcccatatcaataaattgacagagctggaattggaatcaacttaagtctgacttcagagcttaaggttttaaccatcatattctaccaccttcataatacctttagttactttattatattttaggtttaccccttgttattggtcttcaaaatccatgagttcattctgattttatgaggtgtattggtaatctattgtttcatgaaaacttaccccaaaacttagcagattaaagcaataaacacctattatctcattcaggctttgtgggtcaaaaattcaggagcagcctagctgggctcagggtctcttatgaaattgtagtcaagatattggcccaggctgcagtcagtcacctgaagccttgactgggctggaagatgtacttccaagtttcactcacatgcctggcaagttactactcattattggtagaaggctttcgttctccagcaatgtctgatcctaattttattttaccatagattagtgcagtcttcacatgaggtttcatttcacctctctttctctctctctctctttctctctttctttattttttttctctctctctctcttttcccctggcagtcttcttttggtcaagccatttgtattagtttgctaggtttgccatatgaaagtaccagtggcttaaacaacagaaatttattacagttgtggaaactaaaagtccgagatcaaggtgtcatggagcattgttttctctgaggcctctgtctttggtttataaatggtgatcttgtctctctgtcttcacatggactttcttctgtctctgtgtcctaatcacctcttcatataaggatactagtcatgattgaggctcatgcatctgagctcattttcacttactcacctctttaaaggccctgtcttctaatacagtcacattctgaggggtgttaggacttagggggttaggacttcaacatatgaatgttgaaatgaagtaatttggctcataataccatctttgtcctttgtatgtcttgagaatttccttttacactgtcttacctattacttatgtcatttctccattcttaacctctctttgcctcaagttcccaaagctattgtgcagccaactttaagagttaactgcctgcctttctgattgctcgttacacttgaaggacttaggatgctatacctgaaggtcttagagagttagactggtcctccaagcttatgaattttctagaaactttttaacttgcatatggtattctcctgaagaagctgtggctaaagtcagatatatttttataaactattctttgatcatgtatgagtgccaaaaaaaggagtctttaattactttgagggaggggtctgtgcatctttcttaacccttttcctggctgccctgtagatattccagaaagatttgatgtcttgtggaatggtctgagaaccagatggaagctagatgaagaacaaaatcaaaagtgtctctcttgtcttgcatgatagaaactaatatcactaagaacgcaattgagagcaaattattaagaatatgcactgaatgtgtacaacagccagtgtttgttcctcatcagcacagggaagcattcttttttttttttttttttgtgagtaattttattttattttattttatttttttttattttatttatttatttatttatttattttttaattttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtggctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccattgatgatgagcatttcttcatgtgttttttggctgcataaatgtcttcttttgagaagtgtctgttcatgtccttcacccactttttgatggggttgtttgattttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctaaggtttttatggttttaggtctaacgtttaaatctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcattatttctgagggctctgttctgttccattgatctatatctctgttttggtatcagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagctgaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgacagagggcatccctgtcttgtaccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgatattggtctcttcagaaattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatctctgttcttttacatttgctgaggagagctttacttccaactatgtggtcaattttggaataggtgtggtgtggtgctgaaaaaaatgtatattctgttgatttggggtggtgagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgttggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttttcctggataatatcctgcagagtgttttccaacttggttccattctccacatcactttcaggtacaccaatcagatgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctggagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgcgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgaggacgggcagactgcctcctcaagtgggtccctgacccctgacccccaagcagcctaactgggaggcaccccccagcaggggtacactgacacctcacacggcagggtattccaacagacctgcagctgagggtcctgtctgttagaaggaaaactaacaaccagaaaggacatctacactgaaaacccatctgtacatcaccatcatcaaagaccaaaagtagcacagggaagcattctaagcttttgccaggacgcctgcttattatatgctatggtctgtccaaatcttctgtggctgccactacagcctgatttcccttggaaacttggcagcccgtgagttacgatggaattcccaggtgataatgtatctaatttccctcattgtacttcttttatcctgtaatgtgctgttgattcccacggctgagctgtgatggagaatagccattattattgtaatggcattattcagtccattaagacttaaaacatacctggtaaaaatagtgaaagcttacaagtcttcatagcaatctcaaagactaataacttagttgttagtcttttcctcaagtaaactttgacaggtgtttgggaataattctttcctgggctgatagtatttgatttgtactatatattgttctaagtaaatgcaggaccaatgctccatcctattcgaaaaaagaaaaggggtctctgtagagaaactattaaaaaagtttaaacagcctttacagaaacgtggtttggtggcaaagaaagggaaaccaccaccccttccaaagctcaccaggagaaaagtgagaaataaaatatcaaaatgaaattgactccacacaaagatatctgatcaccagacaaaacaagtaccaaagtgcagaaaaatattacaataaataacatcagattctttattcaagccaggcaaaacttatgtagtttttcctaaccaggttaattattttcctcatcttcttttcctttaatataaaaaagggatataagaaagcaagcctgagtatattcttggttgctctgtttcttgtgttagcctagccagaacgagctacaatagaaagaagttatactttagaaaacaatctatttaatataattcaatgctacacaaagctttatttcttaatatggacaattatttgctactggaaagaaagcagagcgagatatggccctttggggagatggttaaataagaaatacatttccagatgatgtcacatgtaaatagcactccgaaatcactaggcatcaaaattaatcaggctgaatccattgctttgtaaggtgtaaatcgctagccttacttaaccttacttcagtgctgggactcccgaatcgcgaggaaggtatgattcttatttcttcacacacacacagactgagtgttctcaagacaggaacatgattgagaatgctggaaaaaacattacattaatctacattgtaagagtaccatgcaaacatttgcttgtttccaacaccttgtaaatgtatctcgttgttgactcaaaatgaacatttggtgcagatactgagaaaaaagaatgtacttagaacagggatttcattacttctcttataggtctcagctgtggagattgtttagccaacaagaaacccaatctctgttaggtatcttgtctgagatgatattaaaaatattcaacaaccagtaggaaatggaaccaatgaaaatgactcaggtcccctgctgagactggcattgacctgttagttgttgaattgtggaaagaggggaaagggaccggatgatcggtggtaagggtatgtttgaagcagtgacattcatcatctatttatgcaagtattttaacattttaataattgatacagttatctgggtgcatgccagttgacaacttgccctgcatattgataattttaccatgcagactccactcctcaggtaactcttgttctattacactggactttatcatcatgtaatctgtcctgtccctctctctctctctctctctctctctctctctctattgaattctgggggtgtagtagtccattgtttagagggaatttagaagttttcctatattaggaagtgtattcatttcctaggaatgccataacaaagaattacaaactgagaggcttacaacaatacaaagttatcatatcatggctctggaggtgaaaagtctgaaataaaagtgttggtggggctggacacggtggctcacacctgtaatcccagcactttgggaggctgaggcaggcagatcacttgaggtcaggagttcgagaccagcctggctgacgtggtgaaaccctgtctttactaaaagtacaaaaaattagctgggcgtggtggtgggtgcctgtaatcccagctactgaggaggctgaggcaggataattgcttgaacccgggaggtggaggttgcagtgagctgagatcgtgccactgcactccagcctgggtgacaagagcgaggctacttctcaaaaaagaaaaaaaaagtgttggcggggccaagatctctctggaggctctcagggaggatccttccttgcctctttctaacctcttttgatttgctgacaatctttggcattctttggtttgcagctgcagcactttgatcacggccttgttgtcacatggcattctcacctttagtgcctgtgtgtcttcccctcttcacataaggatgcaagtcatattggatgacttatcctactatcctactatgtctatcctactccaatatgaccttatcttagctgattacatctgtagtgaccctatttccaaataaggtcacactccgaggtactggggggttaggatttcatcatatcttttgggagagacacaattcaactcaggacaggaaggaaaagccccggcaaccgaattgtattgttctgctagatgatgacaagtcataatgtagagaagttgctccaaagtgggatacatacattggagggcagcatagaatgaaagttttagaacatctatttatatttattttaatcgtattcctttatatttttgttatagtctgtttcatagcacatttagtgtataaatataataatacatgtctacgtgttaaaaatgaatgaaaatacctacattgggagtgggctgaatccacagaaagttttactgatggtggttcagggaatgtaagcaaaaggatttcaaaccaatgtaagagcatgaaatattaatgacatgtttcagataaaaatctctgtgtaggtttttcatagccccaattcaagttagactgggcaagaaatgagattatttaggcaaaaaaagggaggagcactaaattcatccacaattttaaaagtatcttctttcaggaggcttttggacagtaacatttccaaaaaaatatagtgttttatgccacagagaatcaagttgcattgtgtatactaaatggtcaagcattttcaagaacatgacaaaataaaaacatacaaatttatatctcaaaaggaaagtatcttctttcatgtcagatcatcagcacagaagccctcgatgcatgcaaaggcaagcacaggctctgcagatgagatgtgaagaagcaattagggaaggaaggaagggacagtttggatgctgggtcctgacccagaaacaacacggagtagatctcggatttgctttttcttaggtccaatgctaggacgattactttatctgtggtgaggaatgttataaaaaaccattgttggaatgccaccaaaatacttctttcccttttagcatcatcaccaagattctagaacgaagtaataacagttgccaaccttgagccattctccagctgttgtcatgtttcagtcagacaggaagtgttggcgagtaatatgggatttattgggagtgttcctttacgtgagtccaggaaataagaactagagatgagcttgggtgcctctgcttcttttatttctatggaacattctttggggtcagttttgaataatcactgggcattatcggatttctatcactattttttgcatgttcttgtgattattcaccagggaacattttataatactcatattaaatttttatttcttaatttcttgcctcattactcccatttgcattggctgcagactctctaagtattactttcccttccttgtggttcataccctaatcattgaatattgatgttctatttatttctatgcactcactttgtttttgaccaagttatatagttatttggttttcaggtaatgctttcttacagttactcaagaatgtatgctagaaaatgttgcccataactgcttaaacataaaagaggatatgttttcttgttttccatctatgttacagtctgtttctgaaatatcctttattatgagtagaataaaatctactggacttggaatccacattcccttttaaattaaaagtattcccagactttcaaattttacattccttagcatgatctcttctctataaagacagaagaggggacagaaaattctgactgatcatttcttgagctagaagcagctataatattcctgttctccatcctttataattactttctcataaatactaaactacacccccctgagcatctagaagatttaaacactgatcaaaggcaggtttagctgtatcctcaggacaagctgattcaatgaagaaaagctcaggctcttggagagcttttagaaagagaaataaattaacaattagcatttaacagcagtaaaaactgcttagcggaagcagacttgatgttttaggggatttgagatattcggagtgatgagatgaataggaaaaactgtgttccaattaggaagacagagtgaaaaggtgtgagatgtggtcttctagttcattccactggtgatatagagcctttcctggacagatttttatcttttttgagtaattattatccacgttataatttcatgcctgttgcttttaggtaagctcagaattatagtcatggcttgagtaaagatctcattgcagttgagtactagcagtaccactactcttgcatgagttgcattctctcttgaccagctctgttaatgggtgtccttatgtatgaaactgattttcttactaatggcaggattctgtctggttaggatattccctgaaatgcccaagggtgtattttgcttaaaagcaaggctggccagagaggtttggtttatgtatttatttttaaatttcttttgtacctaggataataaatatattcctctagtcttggataataatataaaattacagccatactgacaaaattaaagaagacattaacaaaaaattcagattaaaatataaagttcatgtctttggcaagtacacacaggattgtggttttgcccaaggtgtctaattaattactataatttttcaattccctgtgttcaataaaaacacgtctatgaaatgctattcataaaagcagaactcactggtcattaaacatgcaaatatccacgaataaatacacaattctctcttgcaggaaatgctatcagtagactaaataagtggtggacatttttctacagtaagtatttacttttcctacagtttgatcttaaaataccacagttggccagggcctcatgtgttgctggtgcaatctccgcattgttaatgggtatatgaagctcatgatgatgtccacaagatgataccgctattggaaaacttcctcattcttcctgtctaaccagtagcataatggatatgtgaatagtgcctgttttgtacattttccctcaggtaaactgtgataggcctttgggaataattcttttcaaggcctgaagcatttaaagtgcactgtatattgttctaaatgcaagaccaatgccccattctatcagagaaaagaaaaagggtatctgtgggaaactatttaaaagattaaaggagctttgactgaaatgtggtttggtggcaaagaaagggaaaccaccatcccttggtacagtattaaggctatatctgggaaaaccaacaaaacgtgtcatatgtggatagatcatgacactgacaccattagcaaggactttttttttttttttaacagcatttcttgtgctagtttcccagtgccaagaatggcttctttatttattcttgaactccaatacctatcacagtacttggtccttacttggtactcaataaatgtttgttgaatgaatctattttttatacttttgtatcaaactatcacatctgagcgattttgtaattttattcagctgatgatattctttataccagtgcaattttccatatgctcatgtgtgttttatttctcatgatatcagtttttctttctttgaactttgtagttccctgaattgcttagtattgtttatatatgactaaaggcccaggtggataagatggtatctttctttgtttattgtttatatatgactaaaggtccagtgaaaggtaaaaaatgagtttgttagatttcaaaatcagtcaaaaggtaaaatcagtgtgaagataagataccatcttatctaactggacctttagtccagtgaaaggtgaaaaatgagtttgttagatttcaaaatcagtcctaactaaaaaccatttcccctactggatgttgtaactcacatcattacaatttatggcttaatgaaacatttatttttctgaacaacttggatttcagtgagcagatttcttaaaataaggacattctatttttcattatagtactaagaatgctggaacaaatattttttctacttacatacttgagttcagttgaattattttatcaggtatttgcaagatgacctggaatatcttggaagttattatatgtaaattatacatacacatatatgtgtatagttcctggcattgggcaactagtataaggaatgctgcaaaaaaaatccttgctaatggtttcagcatcatgatatatatatacatatatatgcatatgtgtaattacacatatctatatgtataaataactatattaatatacttatataagctactacatattaataaatgatcaacatacctatattatttatatataaactatatataaatataactatatatatacacacacacacatatatatatgtagttgtagaaagggtcttttttagtgaattaagacttcatgaaaggccagttatagtggctcatcatgcctgtaatcccagcattctgggaggctagaggatcacttgagcctagtagttcaagatcagcctgggcaacacagcaagatcccatcttaaaataaaaaagatctcatggtaactaatatttgatatgtatgatatatgactttaagcaatattacgtgacatcacctttctcacattctaggttgctgtttacattttttgttcagtaatgaaacaaactcacgaggaagtaaaccaatcaacattttatgcatggagttttctaaatccttcatgtggctttggtagcattttgattagaagcccttgaattctgtcctgagtgcttacccattatctagtgatttacagagtttacaggaggacaccgaaatcacaggcttgaccgcatttacggatggcacagataccagatccaaaaagtttttaatgatctggaaccatgaagtgaaataaacaaggagcccagatttcttgaagacctcctctatgccaggcattttatgtctctcaattctttgagagaacctatggcatgaagttattaatttttttctagatggcaaaactgaaaataaagtatattcaattaatttctcaaggtcatgggattgaaaatactgtgactgaaaaaaatattttaagtcttcctgatcctagagtctatcttcttacattaaaataaacatattaaataaataagcacaatcagtttaggaaagatttgttttgatagaaatccatgcaaagcaggtcagggaatttcagttgaccacagattcaatggggaacatcagctaatgagagaaatgtacagtgcaaattatttcattgtacttagtgctagtcaggcttaataaagggtatgatactttggcacctcattgctttcacaaacaagaaggcattctgagtaagaaaacatgaagacaaagatcctaaacctttatcttgtggatgacagctaagaatgctcaggtaagaaatgactgtagtgacggcaggggatggatgagggctataacatctgttgcaatacatacactgaatggtgactttttcttttttaaattgacacggggtctagctctgttgccctgccagagggcagtggcgcaatcatagctcactgcagccttgaactcctgggctcaggtgaccctcctgcctcagcctcccaagtagcttggactgcaggtgcatgcaaccatgccccactaatttttttatatatttatttttagtagcaacaagctctcactatgttgcccaggatggtcttgaacttctgggctcaagtaatcctcttgtcttagtcttccaaagtgctggcattacaggcatgagccaccatgcctgccctaatggtgtttttaaaggaggaattagctgtggtcagtacagatttatttggaagaaatggaatctgtgcttagaagccaaaaggcccattattattcaataaaaggaagctctttagaacactttgaacctgaaagagttaatgaagcatgagacattagggttcccatatttagtttagatctatgtggcactatttttagaaggttacattgtttttaatattttatatagtaggccgggcgtggtggctcacgcctgtaatcccagcactttgggaggccgaggcaggcagatcacaaggccaagagatcgagaccatcctggccaatgtggtgaaaccccatctctactaaaaaatacaaaacgtagccgggcgtggcggtgtgcgcctgtaatcccagctacttgggaggctgaggcaggagaatcacttgaaccaggaggcagaggttgcagtgagcctagattgcgccactgcactacagcctgggcaacagagtgagacttcatctcaaaaaaaaaaaattatatagtataattctaataatgggatgctccacttcacttgcaagtacttgcatatggaggtgtttttttccccagtatgaggagagatcaacagtaaatacctatattatttctattgctggtcaatgcagaaaatatttgttaagcacgaagagtgtggatgtgtttgatgactacagaactaaggatttctcaaagaaacaaagagagaagtctaagttcaggtgtggaagcccttgcctaatttgcttcttcacttttgcccagaaataatttggccagggattgtgttactattgttgaattaaaccagacagaatcaggcctataagaagagccgtttagtaaaggaaatgattctgtgaaaattttagatttgataactgacatgggaggtgtttaccttcttttgaaaagcagatttaaaaaattgaattaaatatacacacagacttttacactcattttcagggaagcaagaactctatcataataatcaccaaatatcaattaatcagaaggaaaaataggcttgcaggaagagaaaatcagttcctttagacaaatggtattgacatagagattccaggtatgtttagttatataccatgcattctggatcaaatagagaggcttgtgacttgtatcagtattacctggcttcacagcagcaggagcagagaaaatatgcactatgtttagagatgaattaggagagtatgtctgaaagaaccagggatgcgtgggcaggtagatttggtcaggcatatttataataatgagccattggatttgggattgggtggagggaataaagtcagaaaaccattgggtcatcttccctaataaaagagaacgtctgtggagttataaatagaattgcctaatatttcatctaatagctttattcaatcattagaacctaagctttcttgtatcaatgtaaagtatgtgtgtgtatatatgtatatatattcatatgtgtgtgtattatatgcatatgtgcatatacatgtgtgtaatgaaaaaagaaaacagccctgaagaatcctcaagaaactgtcagacgtccttgtcctttaaaagctccagttgcccttcttgtctaaacacatcagtgcagtgtgaatcctgcattattcatgaacacataaggtctgtatttgtatacatttatctcttggctatttatttctataatctctgccccaaaccctcgccatgctttgtctttctcttttcctacttttcttttttttctggtagtttgaaaaataaacattagaaatagctattttattgcttacttctttcctttaacatatggcatttgcttaacctcttggagagttgtggttttctgaccctggagttctgatgggaaagataatgagaagtgtttacttagcatctaggccagcaagctaagaaaaacattgtgccatgctagtattgacaaggtgacagagagcccacacttgcctcacatgttggccactcccgatgctacatcccactttactcttgctggaggactgacattaatgcttactgttttgaggtctggacataatcctggtagattctaaaactcctagcaaacagtggtagacaagtcaagggtctataattgcgtataaacagaaaagtaaagacttacatatttaagcaacctgctaatccccatggtcatttagttccctagtggctatttttaatttgtcttgtttttagaggcactctgaaagcatgaggcaggtgaaagcgtgtctgtgtgttgcttgcatgcacatgctttttcaagaaggtcttcttcttttcttgtcaagactgcagctgtcaactgttccccaaaggtgttgcctagaatcagcatgcagcgctgtaggcaacctgtcacttagatgagacaccttgtatatatgctgtagttcactctctgacttgcctgtgtgcacaatgccatcttgtctgttagaagacagggccatcgtgagatgcagtttctctttgagatatatagtagctcttctttcttcaaaaggaaaaaataaaaaataaaaaaaagctactcttgctggaaaggtagagagaagggtctgcgggtgccctctaccattgtggtttcaatgtctaaatcttctggagaggattgctgcagtgatgagataaaagcagctgcctttccaagtactgtctatttgcattgatatttacattctttgccaaagtgacatcattaacatttgcttagtatttgtgccacagggatatgttttacataatttaagacttggaagtgatgataatgtatttcagatgggcagtagaggccacagagtgctgaatttcatcccctttcttcttaaggaccttagtgcataaataagtccctagtccgtatccctaaatcatattaacaatactgcttactgggtgccaacaatatgtctggtactggactagatatatgtgtatatattgtttagcccccatgacaacagtatgagggtaggtaccattatctccattatatagtaaagaagcaaggctagaaaaattggtgacttgcacaggtctgaattcagagacatctcaccgcaaggacttttctccttatgctgtgtcattctatctcccatcttgtagcctacttgtttcttcagatttaagaaacagaaaccctatattttctcaggacatgacacttgaaataacaagaaagaatattgtgggactctgaccttggtccgtttctgtctctttcattctcatctttactctaggtgcccagaaactcttctttgaaataaatataaaagatctgtgtttgctttgagagaaagccacataacattgtcacaagccagattattgaactctgccagatggcccttatttaccaaatatatgttttagttttatatacgaacagaggttttaaaaagataaagacgaacaaaattgtgtttaatgtcctgtatgataccttttgccttatttacaaactggtcctctctctgactgtacctgctcctgatgccccatcctcaatgtcctccatcagcataaaaaatgtgaaacctctttttcaaaaacaaatttaaaaaaaagtgctcagtctctcatcttgagatggagaattagaagcaaatttgcccttgcttttcttcttaatcttccttcttcccaccttctttccctcgctcccttctttcttctttctttcacaccatgtgccccagaatgacagctcagggaaagtaggcattataagctgagtagccttttccttgatgtcccttgaagggctccttatgttcagagaatatatcactgcatttgcagctcccccagaaatgccgtagcttggaggagcctattactcacttgaatctctttggtgtagacctataaatagattctcgtcttttccttgtaaccccctatagattcttgattcaagggtcaaaaatggagagatgagagttcaatcttcttggaacttactgacaccctagctcccttttaagaacttgtcctccttactaacaccatctacatggccatctgggtcttctcagctcagaaacaccctgcaacaatggctggcggaaataaggggagggcccatttgaattagcacattcccccacaagcacacacatccatactgccaggcctctgtttgtccagtttcctcctcttgtgctgttcttcccacccttctcctcagtgcagttcagatatcatctgtgtcccatgaagtctactctctcccaggggaaaccctttgaatttccattgcatattattctgtgcttctttttatgattaatcccatttaccttgtattatataaatatattttggtccttattagattatatatacttggaggaggacagtatctttctttggtccattggtgtggctaccacaggctcacagcatggcatttggttgcctaaaatgatatgtcttatccgttctttgatgtacagataagaaaagcctttatttagtttggctttcattttgttcaagaacagtggcacagtttggtttttcttgatatctttcccttattcatggttgcttttctcaaacagcacatgtggggcttaatacctagatgatgggttgataggtgcagcaaaccaggtggtacagggtcctgtgtgactctaccatggtgcacatttacctgtgtaacaaacctgcacatcctgcacatgtatcctgaaacttaaaatttaacagaaaaggaaaaagaaaaagaaattattataaatgtaaagtaattaaaagtatattatttaggagggacagtagatatcacaaaggtaagcatgtttcattctcaaatgaaatacacaaatttataaaagtgaattcagcaccagtggtgaatataaaaggctgttaaggaggaggagctaaagttttgattggaacttgaagaaaaggtatgttgttataggcagaaaacttgccatgcaggtgatcatgttagaatcagtgtcagacattaacaaaacattttcagtcaagggcagagagtaaatattttaggctttttggaggctgattacataatttgcacaatgaaatagtgggtccctttttcaaaaagcaataacgaagtgccatgagaagtacttaaaacataaagctctttttcctttttccatggtttctctctctaaacttgtcatgttgttttatatttgctcttcagtgtcattctaaggaaagaaaatgttaaattattagcatgaattttgccattcatctttatattatgccatgccagtcttaaataagttctgaataagaacttctaattcatttgcagaattactgacataggaaacatttcttatttcatagctcatgcagtgcatatatgttttgttcttaccagaaaactggacacactgcacagattaactcacctgtttttatttatttcacttcttgatatacacatattcaacaaacactctcttcctttggcttcctaatgagtaagaaaagactgaaaagaaaagaaactgagttgctttttcttttcttttccttctttgacataattttcagctgaggtggttggtcaattcatggaagtaacatgagtaagaaaggctataattaggttccttagtcatttatgtttcttagaatgccatcgttttctttctgtgttcaaagcaagttttggttccaatggaaaacatgttctttaaggactgtcagcatcccagcttactcagagtagatgtgagagactttgcaatcgctttgagtctcattgagtgtgcatcctaagtctaccagaatcttctactcccggggtattgtgagagctatagggggtgaagtggcaagaaacaatgggcatgtgtatagtatatccatatgtttatgcatctctcttttgctactgcacatgcctaattgtttcattagacttcattcaaaaacacaaattcaaagataaaattattaagtgtttcaagacggagagacaggagaatattaaaccaagagcaggtggtacagggtcctgtgtgactctactggctgcatacccatgaagcttcacctgggttttgcaagccatatggtctctgtctcaagtatttagctgttgtaccatgaagtgcggctataaatgatatgtaaacaaatggacgtgactgtgttccagtaaaactttatttacaaaaaacaggtagcagccagaatctggtctgtgggccattgtttgttgatccctagttaggcaaaaacatggagatgagaatatgtgagccttgtttgagaattgcttagctagtgtgaggtaagtcagggaatttcagaagaaagccaattatgaaagcatggattggactgtttgaatattttcctctagttgataaagtgactgatggctttagctactgaattaacgtgatcaaaagagtttttttttttttttggagatggagtcttgctctgtcaccaagctggagtgcagtggcatgatcttggctcactgcaacctctgcatcctgggttcaagcaattctcctgcctcagctttccgagtagtgggaacacaccactacttccagctaatttttgtatttttagtagagatggggtttcatcatgttggccaggatgatcttgatctcttgacctcatgatctgcccgcctcggcctcccaaagtgctgggattacaggtgtgagccaccgtgcctcgcccatcaaaagagatttttagtgaattaatatggaagtgtcctatcacagagataggaaggggtggatctgttaatagacagatgaacaagggagctattgtgagagtccaggtatgagatgataacaacttggagtattaagaagggatttgcaatgatggaaatatttgattccagaggaattttaagtgaagtgtcaccaggatgtggagagtgatttgatgttggggctgagagaagaaaagatgggaaatttcaaggtcttgtgcccggaaggctgcaaaatggatagccattcattccctgaacctgtattgtgtgtatcttctgtttgctaaaataaccatgaacagaaatggctggtgggctgctgattttaggtggctgcagaattttggtctatttgagttgatgttgggttgcctaatacacatgatgcttacaaggcattcaagatgtgtcactggcatagaggagtggagtgagggatagaagtaaaggtaggtagcccatcttcacagaaaggtgaattagaccagcgacagcagataccatctcccaatggagaaagcatagagaagagaaagaaaaagaaagaggctctaataccctaatcacttacataccctagtgtagtcctctatgcttttcaaattaagtagatatttcactttcctgtttaaccttgcctggaaagattgagaggtccatgtctagtcacaatgttagaatgaaataaatgtgtgaaataaatcatgtttatagtgtagatccccttcatcttcatctttgagtcaaatgccaaagccatttgttggctcagtaacgtttcacttagaaaatgaaacttttattttggctaaacgagtatggtgtcctggtcctttcccaaaaacataccttcaattttaccctagctggctgattgactgtttcctttacagatgcagtctagggatgctaagggcaacatcctttgtgataatgaaagccttataatgtattttttccagtaacttaggatgctgtatattaagctgtatattggtaaatattttgtctatgtggagaaatgtaaatgagatttttttttcttttcatcattcttctctacaaatgtgcattgaaaagacactgaactttggtcccatgcttatgcacaaggtataaaagttgcttatattcctaacctctccacagagttgtctagattcacaggactatttggtcaaatgttctgcaattcagttccactgcttgactgtaattcacctataaacccagaaaaatactgctggagttcagaggccctgactgttattagacagagaaaacctatagcacactggaacaatcacatttaaaagatttgcctcaagctttctatggtcactattactctttaatttatgcttttaggtttcaactttgaaatgatattgaaattttcattatgggcaaccctgaatctggaaaaatccaaggcagcttttaggacagtcacctttaattacccaccaccgttaagattaggaagtaaatgctgaaattcccatgtaagtgtattttgcaagaaattttcacactatgaaataattggtctttatctctcatcctgtctgattctctatcaagacatatcaaacatgcacccctctgctcaaagtgtaaaaaaaaagtttgctttttaaagttttaattaaggcttttgctgtgtgtgtgtgtgtgtgtgtgtgtgtgtgtgaaagtactacacactttagttgtttaggtgtcattgttgagacatttagactgtatttcattcaggcagatacttttactttattacattcccaaatgaggaaatgtgctgattagatggaaaagcatgtgtgtatcttatagtgttagcaatttggcacggtttttgttttgttagctctcagcatggttgccttcaactatatttacaccacatgggtgggcatgtgttaaagatacaaaaatcctcagacctctgaattgcattcctgaaggagaccttaattctattaggttggtgcaaattaaaatgccgttacttgtaatggcaaaaaccgcaatgattttcgcaccaaccttatactgcttattgcttttgcctcttctgtaatgaaaggcttctaactggtttgcctgcctttgattttagctttttgtgtagccttggtcatatcaagtttctgctgaaaaatttggcatggcctttgatttcccagtctcatctcctacaactcaccagtatgcaccggtagttccagtccgcaatacgtcctgcgctgtcgagcttacgcacctttctgtgtgctgtttcctctgctaagaatgtctagtgaacttctactcaccgtttaagaccagatttaaatggcatcttccttacaaataagttgattgatctatcattttattgattctgtcattcagaaacattccttcaatgcatgctatgttctgggaaactttctctaaacggactcaaacatttcttcttctgggttttcccagcgctggatactctgagtcattactaatccacactgggttcttgttttctaggctgcatccctcaatagactgtgaggtctttgtgagaatacaattgcttttgtgtttagttccatattcacagcgttcattctagtgtctggaacatagggttccactacatgcactacacatttgttgactagaaaaatgattcgttttatcaagggactgtcttaggaaatactaagtggggtgcctttctgatacattgtaatgaccacccttttctctgttctctaacgttgtatcccaaagtagataaactagagttttatccttaccaaccatctttctctcatctccatcctactttcccagcactcccctgcacccccctgctgtgtgcaaagctccaatcccgggaaaataccatgcagcgctttcattctaaaggggagcaattgaaagcatttctttggtaatttaagcacacagcagctacctttgcaaaagcctggttgctaaattatcccctcaactactcattttgcaaaagggaaaagaaaaaaaaaacacactggggggatagagactctaataagaaaagagtctgtgttttctttaggttcagcctgattcctctccacctcctctcccttcagtgactgcaaggctcctggtgtggctcgttctgctacttttccttttaatgttttaaatgccacaaatgcttgtcataaaccaccttcttaattatgcagaagtggagctgaatggttagttagcagttctattgcaattactgcactttttcaggtctgctgctgttttatgtggcactgttttctaagttgctgattaagatgatgtagtgggtggagttcttcttcccaccattggagaagggccgctgaagcctgggataatgagtccttaggcaatagtttatggcctaataagagttaaggatgggagcaaggaggagatggagagttatgctcattcatttccttcttaaaaagaaaaagccctctggttttgttcaacttttgcttctcctttgtccagtgtagatgctgaaattgctagagaaatatccatgatggctcttagcagtcctaatcttatttggacctgatattctgaggcttttaggcatcttcagatatccttgtgcagtgaaagagccttgcattggagttgaaatgatgacgagaaaatttaagaactgttgagaatttgaatcaatctcttcatgttgccatctctctctctctctttttaaagccaaatatgaatactgctgtgtgccgatcttgagccctgagaagctgcacttccagtgtagttctaggtccccactgaaaataaaataatgtgaaattgaaagcagcatgctattgtaaagtagtgcaatcattcgttcattcacaggtacttactgaatgcctactatgtcctaggcactgtgtgaggcccaggggatggggctaaaaacaatataaacttcttgcctttatggaatggcattctagtcaggtatactgatattaaaccaatctggaaataaatatatactcttcaatggtgctatgaaaaaaataaagtagaatgaggtgctataaaaaaataaagtagaatgagggaatggagagtgtgctagggcatgctattttgggtggagaaggtttctttgtggcagtgacattgaaataagtgcctgaatgaggcaaagcaacaagatgtaaggatatccaagaagagcattccatgctgaggaaatagcaggtataatcaccctgaaacaggaatgcacttggcttattggagaaacagtgggaggctgatggctagaagacagtgagcccgcagggcaggacagggggtaaagtgaggtcaaagagataaccaggagcatattgtgtatggccttgtaggtgaacaaatgggctttgaatttaatataatttaatttatattttaaaatcatcttggcggctgggtgccaattataccataaagaggcaaagtagaagactggagccaccgaggaggctgctgcaggaatctaggcaaaagatatattagtgtggtagtggcaagcgtgctacattattatgatgtcctcggccttcttaagtgtttgcttcataaatcagtagagttgtgagctgtgacttggacctgataatgaatcattacttattttaaaattgatacatacaataacattcttaattttttataagctcatataaaatattgaaggaggattggtcttattttgcatctgtttattaaacattagactggagataaggttgtgaggccctagagccaaataaatattcccagccttgcctggcagacaattattgggtgtggaggttacccagcctccatgttgcctcagtgactccctttcctgtccttcactaggtaggaggcaaaaagctcagcagtgacacacaggctctgctctcctaattgctgtaaagaactgtgctgtttcttcttcaaaatgttgattgcaggcagctacagggatgtgctcttatgttacagtataaagattttttattgtaaagaaaggagatttgttggcatggtgggatgtgtgtatttgtgtgtgtgtgtgcaagtagctgtgcttgcactgggagactattttactttgcttttttcctctcccattataggaagtaatttttggaggaaaatagtatgacagtcctgatactattttatttattttcttcttcagagtaggtacaacagaaaatcctgaatttatgcttgttgtattttttctccctattatatttctgcgtgttcacacccctctattaacagagaaagtttatgctatattctgtactccttttactctttttattaagagaaagtgagaaagctgtcctagaattatacaaaatatacatatatttttccacatctgaagggtaaaggaattgtaattcatgggaatagagtgttaagggcttatacaatgatatatactatatatatatcattgtttgtatgtatgtacatatattgcacatatatacatatcactttttggctctacttttattattttcaagtttcttttatataaccccagctgctcttctgcatttagttaagtgcagtcctaccatgtctagaacccccttctattctgcctacattcacgactttcatccctcaactctggtcccatttatctgtcacttagcattaactacgttataatgccatttatcccttttgtgcatgcattatttctactcaagtgggccatttgcttttttagggcaaatatcataatatgcacctacttatatgctccacatctgcatcaattcagacagtttggttgcaagcaacagatactataggcttagactacctcaagttggtcaggaatgtattaaaagtctttggggtagcttacagaatcaaagcaaagactaaaggaagaggtttccaaaaacaatcagagaatcttgggaggtctaagtaacagggactaattaatagctattttaggctgcagctgctagaatgcataaactccaattatttccccccattcttacaacagcctgctgaagcctccaaggtattgggtcatgtgcttacccctaagagaagcagaaaaaaaaatcaccttttgacaatcctacacctctgtgaacaatgggaaggagatgtaatttcccaaaagaaaaccgggcactgagtggcccaaaacaattgtcctctataatatcaagcatactttggtgtccacagttggagctctttacagatctggtgtcagtgatggtgacgacaaggagaaggaagagttgtaaatgactttgctcttttgagtaagtgatcatcaaatgtccttgcagtcagaatggcaaacaaatggcatggcctgtcagtatctgaagttaatttgggctggctgtcctttctttttggatatttaggtttcagtaatgatttcccgaaggccacaataataaacatgtgttatgttataaaaagcgggtgctgcatacattggaagcaaggccccctaattgaatcacctgtgctatgactctttcaactcctaaggcataattgaagcactatctcagttggcatctttgtggtttccatccacacattcttactttctggtagctggattatgaacaaccccaaggtcaggcttgtgtagaacccaacatcttacatattttactattgataaaatacaccctgagtataaatgttcacataacactttctctcatctctatagttatgtttctttcttatgaccttggccacatactttaaactccttgggaaaatatgctgccgttaaaaacgcttcacctatttcttgaaaaatgaccgacaagatgtttttcgtccaattctgtcgtatatttctattccctagatttaaatttcctggacttaactgttccctatagttagcagaaacattattttaagaacaatttaagttgaacttcatgtgaaactggctactgaatctgagtcgggaccttcttctggagggaggtaattaaatattccttattgatgctattttaaatgtgttgaatgaaaggagttaattatacagcagggaacatggcagagttctgactaataatgagctcaatgtttaatgtcttcatctttgttagaatcattaaagttgtttgaaccaatcagatgtttcaagtgaatgtagactcacagctaaccagctccaaatggcaatccctcacagatgcaggagctggtatatctaatgatgacttcaggaaaaggatggcgatatattgctttcttccatgcagtataatctgtttcagttggtcttccatcgtgatggtaaagagaaaagaataagtcttatttccaaaatttcatgtgttataatggaatgatgtttgtgcctggacatataaaagaggaaatgattttgttttttccttaaagttttacgtagccaatctctttggaatctggtgcaatattgacatttctggctgccaattcctcacatgataaatgcattaacactaaatcttaggatgcccaggaatcactagaggaccaagcactgtcctaaagaatggatctcctgtaatactgttgtagagaaatgtaggctcttgaggtcaggtttttcataccgtattactggtttgttatgtgtctttaaataaattttgcaaactccccgacactcaaactacttcctcttaaatttctcctcccttctgattgcttcaccaaacagcctgtggctttgtttttatttacaggactcctaagactctgtcctgtcctgtctatgctggggaatgtaaagtacagaagattacttccttggttctccatggaagtccttttacccagctgtgaggattgtaacaatgattggcggtgacatcactctattactgaacttcacatatgggagttgggagactttgaggaatcagtagggtgaatttaccaagttctcccatgagcccaggcagccggggtgtgtgtgtgtgtgtatgtgagtgtgtgtgtgtgtgtgtgtgtgtgtgtgtgtgaaggaagagtaagtgttaggacagaacagcagccatcatgggaaagggaaatcctagttccacctaggatggttacttcgtggagagggttactttgggtagttacggcagccttcagggttttcaagaataatataacatatatgatttatatttttgaacttcgattttaccactgcgttccctccagtgtacttagtagagataggatcatgtgtatcgagagctcaggctttagaatcccacaggtctggaatgaaatctcagctctgacttttactacccatgtgactttggacaatttatgtatccactgtcagcccattagataacctttaaaatgggaataaagtagtgcttgctttgcagaattgctgtatggattaaatgagataattcaggtaaagcacatagttgagtgcaaaattaatttatcacatattattagaaatgtggttgaagattgttttgttatttagatgaatcatatttaaatctttcattttcaagtatctaagacttccaaggactaaaacttccctctgaattttaccactcatcccagctggagatctaagataactatttttgtgtttgtttgttaattatttgacatgtttcttctcaaattaagggaaaattcttatttcggagtcactgttcagaatgaaaatgtgagactaagtatttgttttgcaaagcgcaacagaatagagaagaaaagttgggcattctgtagggcgacccatttggaaaaataaatcctaccccttttgaaggggagaaattaatgagatgagtgtcagtccctccctccccacccactgacctctctctgggatcacacaccaacagcctatgatgaagtgttgctgcagtgcaatggagcaaggttaccttcacagtaacagcttttctctggccagattactttatagccaaagatgtggttattttcacctaaacgtttcatttaaatacattgtaaagtgtgacctaggaaaacgagacaaaatcattctaagctgtatagagttggattgtttgtagaaatgctggacattaaccaatgactctcaacttgaatgtacatcagaatccccaggagggcttgttaagaaacagattcctaaaaccttactccaaagtaggtgtcaggtggagcctgagaattttcatttctaacaaccttccaggtgttgctgatgctgctagccaaggaaccacacttagagaaacaccttcaaagtgcatattttcgtgtcttactattcaaagtatgctccctggaccacctgcattagcatcacctgagaccttgttggaaatgcaaattatcaggtcccacttcagatgtaatgaattagaattgtattttcatcaactccctgaagtgacttgtttgcatattaaagtttgaggaacactgatctagtgattatagccaaggtctttggagagttgagaatctgagacagtcagccctggattcaagtctcacctactgccattttctagccctgtgattttgggggtgttgtcatttttcttctttttaattcccaatttcatctgagaaattgggatgatcatacttgaaaagttgtgaagattaaatgtgataatgtaggtaaaatgcatacaattagtagtgttgttaaattatgtcttcatttctttttatgtgaaacctgtcctgtgaaaccattagaaacagctgtttgaagaaggtatttgaaattctctctgaagtgttttcctatgtcctgttttgagagaagctattttcacagtatggcattagattgtcctcactatattattttgtgtatgagtgacagctgtagagatatataatggtttgagtttgccaagtcacagccccctcgtttgacctctgaatttaagggtgtgtgtgtgtgtgtgtgtgtgtgtgtgtatgtgtgtgagagagagagagaaagagatacagatagacatttcgttggaggaggagtgtgagggaaaacctagggttttctttcttctctaataataaaatatgacataggctttcaaagataaaattcgatttgtaatatttgacaacactggttagtcagccctaacctcactgatatattatgaagatgaaggttatgccagttaataaagtgttttgagaacattgaaaggtgctaataaaattggatatttgactttttatttacgtatgtatgtatgtatgttttgagacagagttttcctcttattgcccaggctggagtgcaatggtgcgatatcagctcaccacaacctccaccttccaggttcaagggattctcctgcctcagcctcctgagtagctgggattacaggcatgcaccaccacgcccggctaattttgtatttttagcagagacaggtttctccatgtttgtcaggctggtctcgaattctcgacctcaggtgatccgcccacctcggcctcccaaagtgctgggattacaggcgtaagccaccgcgcctggcctgacattgtttaattttttaaagtacagcccttagtgataatttttccttttctgtagccagagaggattctagtattttggcagttggacgatatcttatctctctcaatgccctcatcagttgagaaataagcctctttcttttagtattttatattctcaaagctcagaacatttcagagtcatgttatgtaaaaatgaggtataatggctgcagagaaaataaattaaaatgagaattgcgctaatgcaaattaaaagggttaatgggagcattttcttctgggtctcaatgtaggtctctgtacagatgattgaggggtttttggatcctgagtgttattcagcttggaggggctcttttctgaaattgctggctcccatacaaataggcctcttaggaccagtcattatgatgcacaccttgcactataactacatttttaacatttacaggtagggcggtggagctcttcactgcttagttactacccagggtaatctccttcaactgtaacagcaagtcaccaagttcttaatgagtatctcctgttggtccatggtaatgagggtaggtgtgtgggagaggcaaactgtaagacctttcgctgcaaatcctataagcacttgccactcaaagtgcgatccacaaaaccagcagcagtagcagcacctaccagcttgttagaaatgcagagtctcaggccccacttcagacccactgaaagagaatcagcagtttaacaagatctccggaggctgtgggggagactcacaggcagcttaaagtttcaggagctctgctttaagaaacattcctttcagagagggaacttaaactgagccaagatctaaaaccatgtgaactccaaattcagagaatcaggtcagtggtcaccagaacagagggtataataattggttataaaccattctaatagttgtaggtttaaaggaacatgtaagtgtgaggtcagttattcactgtattatgaaagatatgctttatagtttgcctcaaaaaaaaggaagtctgattaaatgtcctcaatctatgtggcagatccaagtaagaccccaaaggttaaaaacaaaacaaagcaaaaagggcaatgccgtgatcaattgcaagtcagagttaagatcaaaattaaaatatgaggtttgtaaatacaatggtaatagaaatttgacgttagcatacgaggctccccattgtttggaaccctggtttaaaagctagaatcaaaagaattttgtctagacctaatgcatactctcacttaagctaagtggaaatctttgcctctgttccagtaaccaaatctgtggcagagctgggagtggaggtattggtgagggttgtgggtggggagcagtgtcatcccccaacacactttgtgacagtttttaaggaattagttgatgagactcttgtttattctatggtgcagagagattagaggaagcagtttgagagcaaaggtcagactgttgatgctgggttgaaatagtctctaagatgcagacaggtatagatgtcctgccaacaaccagcaacacagggttgtccccagacttgctctcctgatattagagtctggctattcttctgaaccaaatacattattttactttatgacaagtgctattacatttaaggactttagagacactgtgattctctctgacatcatagcaaaatttttatgtgtgtgcccaagtactactactttttttttttttcctttggcttcccaagaagaggacctacttattgtttgtatcagatttttcaaggcaccttgggatataaaattttaagtctgctgaattggagaatttctatttattttcccaggggaaccctttggagttctgtcctactcagctgcgttatcccctagatttctgtaactgtattagttaggatgctttggagtgctagaaacagcaaatctggctcaaattgctccaaccaataaaaccaagtcactgacatgtaactgtaaccgcccaatgggttcaccttgtctgctgcctagatagaaccgatttatcaagacaggggaattgcaatggggaaagggaaattcatgcagagccggctatgcaggagaccggagttttactattactcaaatcagtttccctgagcatttggggatcagagtttttcaagataatttggcgggtaggggcttgggaagtggggattggtcaggttggcaatggaatcatagggggtcgaggtgaggttttcttaatgtctgctgttcctgggtgtggtggcagaactggttggaccagattaccagtttgggtggtgtcagccgatccatcctgtgcaaggtctgcaaaatatctcaagtactgatcttaggagcagtttagggagcatcacagtcttgtagcctccagctgcatgactcctaaaccataattgctcatcttgtggctaatgtttgtcctacagaggcgatctagtctccaggcaagaaggaggtctgctttgggaaagggcttttatcgtctttgttttaaactgtaagctataaagtataaactaagtttctcccaaagttagttcagtctacccccaggaatgaacaaggacagcttggaggttagaagcaagatggagtcagttaagttaatctctttcactgtctcagtcataattttggaaaggcggttttataactgaaaagaacagcctggctcgctcttcatgagacttgatacagggtacaaaggtgtcacctagagcatttttttctttctctttatttcctgtgcctttcctgcatctgccagaagatgacctaccaaggctagatccttgtgtacctctcaaatgttggccaacaactctggggccaactgctttccctttcaatttgagttggagagaaataatttttgtcccatcaatctcaggaaaatactttcaatctcaggaaaatatttcaaatatttccttcaaattcactgaagttgggttgatatagtttacctgcacagtctggaggaaagaatcctttttcccttttttgaggagatgttgtcttgctctcttacccaggctgatctcgaactcctaggctcaagcaatcctcctgcctcggcctcccaaagtgctgggattacaggtgtgagccaccatgccctgcctgaaaaaatcacttttgccagagggatagctgatttagttagtgcatgtgctctatccctggagccagggcagtttctaaatggaagtcagtggaataaaattctgggaagagaggtaaaaaaatgtttaccagttttctcagaatgccagctctgtttgacacttctctctcaggactttgaagactccaagaggaatgtattattatctatattctactgaggcaagccctgaagtcaaaagttttaagtgaaataggtggggttgtgctactggtctgccaactccagatccttccagggctcatctgaccatgtaggagtctagtttatggtatccacccagctggtgctaggaggtgagtgagaggaagaagaggcagactctttctctctccaattagcctctgcctctctgtttggttaataagatccatatatttaatatgctcaatgtgctttaatgtgttaccaaaccatttgagtctgttgtcacataggaaatgtagaacttttcaaacactattaaattcccttaatcgattaaagatactgccaaaatggtttacatgaaagaactaacataatagattaaaatatctttttcttttacatttattcattacattaaattttatgccatggttatagatctgaaactaattaaaacaattatacattgacttttttattcctaaatgtatcatgtttttagatgtgtaaaaataagaaacagattcagatttaaaaaataagctatgactcaaaaaaaattaatgtgaaatgcatctggaaaatttctcttttgaaactgaaatattcctcttactaaaaagttgacaatataactctttgtaacacaaagtatatcaggagaatctttggcaaaatggtgaaagaaactcttacagaatatgtaagtcacctaagttccagaattcaatctgtgctaagatttttatggctcagagggaaatatcatggactctttatgttataaaaggagtgaactatgtgattatatcttattctgaatatcaactgtaagaagcagattctcacgggcttcatccaatatgctcttgtaattctttctaacatatgtcctctattcacgaagaacaagaaaacatctccagtttaactgcattttttgtttgttttattaaattctttttttgggtatttgcacgttccaactacccagaaaattactcaaaatatttgccttgtggtctctgtggcactgagcatttaaagcaaactagtgtagttttggcttggtagagattgaacaccctttcgtgtttcaaatatttttagagaagaaattcagatacaaaagccatataagatttatcatcactttgacattaagggagcagccatgggttaaattacttgctttaggtgggtaagggaaattgatattacaccgattctgtcctcagcaccagactgtgtaatgtggggtcaccagaaacctctgacacagctcctgtcctcggggtgtttatgatgaggttttgagaaaagccagactaataagaattagattcacaatgccatgtcttagcaggatgatatagtttgggtacttgtcctctccaaatctcatgttgaaatagaatccccagtgttggcgatgcagcctggcaggaggtgattgggtcatgggagcaagtctctcatgaatggtttagcaccctccctttggtaataagtgaattctccctctgagtccacatgagacttggttgtttaaaagtgtgtggcacctccctcctttgctttctttgttcctgctgtcaccttatgatacccccctttaccttctgccatgattgaaagttttctaaggcctcaccagaagctgagcaaatgttggcacatgcttcctgtacgtcctgcagatccatgaatcagttaaacctattttctttataaattatccaacctcaagtatttctttatggcaccacaaaaatggccgaacacacaagatatgtctgcttggcctccaaaataaatctcaggtctctgattctgcctctatcaacctacattaggccaccatcgtttctcacctaaaccacaactatattcccctaaatgatcttcttgcttcagtttttttccttgtactggtttatcctacctatggcaaccagagttattatttagaatgtaaaacacagcggctgggcacagtggctcacgcctataatcccagcactttgagaggcagaggagggtggattacctgaggtcaggagtcccaggtcagcctgaccaacatagtgaaaccccatctctgctaaaaatacaaaaaaattagctggatgtggtggtggcacctgtaatcccagctactcaggaggctgaggcaggagaatcacctgaacgcgggaggtggaggttgcagtgagcagagatcatgctgttgcactccagcctgggtaacaagagtgaaactctgtctcaaaaaataagataaggcaaggtaagataagataaggtgagataagacaagatatgagcacatcataaaatgatcttgccaaaaaaaagaccattcattgatgtcccagtgcacttaaaaatcctaactctttcttactgcctggaaatctttacatgatcactgctaaaatctcagatcttgtgtgctacccctctgcccctaaggtcactaccctctgatcacattaactttcctgttctttgaagatgtcttggaacttgccattgtttctgtgtgaaatgtgtttttcctgtatgcttaggtgtatcactcctcgttatccagggttcacttacatctcgcctcagtgaagagatttagcttgattgccccatccaaaaagatcttatttgttaacttatttacatggatactatgtcttccccaacttcaagttcatgaggtctgtgtttctgtcttgtttatcaccccaggctcaatgtcttaaaatagcacctcgtaggctctcaataacagaagatggcaccaaattaatacactgaaaatgccacaagattttagataaatgtaaaaacattcaggctttgattatttggtgaacattttgaggcattacgtgagttggagcaaaactcttgaggttaaataatatttgaatgggctctgagaggcaaggggagcgtggccatgcttgtccccccacccttatctgtattctgataagaaaatacagaataaatttctttgaaattaaaaaataactcaaactctctgtaattatttttctttaattttctgagagaaggtttttttttaatttggagaaatttttaaaaattaaataaaaactagaaataatacttaatgtcttgacaaagtattaacttgatctagtttcagaaagatctcattaaactgcctgataaagtgattattcagtgccactttcatagagttttcagtaattatctgaaatgatttttagaatgaggcaacgttttcctttttttttttttgaaacagagtctcgctctgtcacccaggctggagtgcagtggcgtgatctcggctcactactacctccgcctcctgggttcaagcgattctcctgcttcagcctcctgagtagctgggactataggcacgtgccaccacccctggctaattttttgtatttttagtagagatggggtttcatcatgttatccaggatggtctggatctcctgaccttgtgatccacatgccttggcctcccaaagtgctgggattacaggcgtgagccaccgcacctggccaacatttcccttttcagtagcaggtgaaaccgtcttggtattgacacagaaatgctgataggaaaaggtgatgaactcatacacactaaaaatatgacatctacctctaaaagttttagaaatatgtggaaagcattcttggcccttttctcctaagttaagactgttcgcaaatcacttttgagagcgaagtgacgatgacatttttctcactcaagtcctaactcatttctaggcatataatttgaattaaacccttatatataattttctaattagatttttcttctttcatggctttttaagctttacataacctttgtgcttcctttttccattaatccttcaaatgccagcatcctgccaagagggtatttaccgcagtatttccatcattgttaacagagccacaagtttttttccagtatattgaaattacccatccatgagaaaatgcagtcttggatttttaattatttagttgacgcttattcaactatatgatgtaagtaggccttttctccctaatgttttattaccagttaaagcacagacaggtattttactttaatttagatatagagtaggtaacagagagctgaaattttaaaaattagataaattttttggtagttagttttatagttaatcttctctctttttttttttttttgagacagagtctcgctctgtcgcccaggctggagtgcagtggcgcgatctctgcccactgcaagctccgcctcccgggttcacgccattttcctgcctcagcctcctgagtagctgggactacaggcgcccgccaccactcctggctaatttttttgtattttttagtagagacagggtttcactgtgttagccaggatggtctggatctcctgacctcgtgatccgcccacctcggcctcccaaagtgctgggattacaggcgtaagccaccgcgcccggcctaatcttcttaatttgtcacttagagtagggcagtcgccacaatatggaaatgagctgggattagtgttatcactgggaagtgattgtaacttttgggtttgtaccaagaagtatatagaattgcttaaacttctgcatgatcaattactgcagatttttgcacctagctccactacgtagtccatcacatttcatagggcgatttctccactcctttatcatagaaccttaggagagaatgttcttttataactcccttgatggagttgcttaatgctgcctttaatttaattgaaaatggttgatcaataaagtcactttttatggatttatttctactgtttgatgtggcaaatcattaattatcattacctaaattagcatggattgccatgaaagtgaaaggagtaaattgctttatggatttcctagtgcatagtacacatagaacttttctaaatatacatcctcttcagcagttagtttgtgccagatttcaattcctacgctacaagttctccagcaaactagaggtgtccatgtccaagtggacatgctaaaaaattcaaattttacagaaattttacagagaccttacttttgtaaggtctccggaatctttaaaaaaaatctatttaattattgatagaattttagtgaccaccatagaggggagtacctgtgtaagcagaaagcaggaggaaatgaacccatttccagaaaacgaactagacattaaggagaaaaaaagaagagaaagaaaagtaaaaagaaaggagagcaaatacctctaggttttttattctgaaagcccatgttatgggttgaattgtgtatctcacctccgtcctccccgggaaaaaaaaatacacacacacacacacacacacacacacacacacacacacacagacaatattatacataatatgttgatgtcctaacctctagtacctaaaaaccttaaaacctctagtacctcaaaaattgtatatagtatgttgaagtcctaacctctgttacctgtttggaaacagtcttaacagaggtaatcaagttaacatcaagtcatcagtgtgggccctaatctgataggactagtgtccttataagaggaaattttgatacagacatacatagaaagaagattatgcaaagagacacagggagaagatgccataggcaaaccaaggagagaggcctagagcagctcttagaaggaaccaattttgccaacaccttgattttggacttctggcctctagaactgggtggcaataagtttctgttgtttaaaccatagcatttgtggtagtttgttacagcatcactagcaaactaatacagcccataatttatgactagcatttcatattaaaattaaacatattatatgaaagcttccccaaacactggaatactataatctataagagttgcattaactattttcatggaacgtcagaatgtggaatccaaagaaattcagagcctaagctgggtactatcaaagcattttataatcaaacattcaagtatgctctgattgagagaattgatttccatatgtatctttaataaaggaacccaactttcatactttcattgtattaacaagaacaaggcacagactttgttaagcctgattctgaatgttaagtaagccaagggtgaggaactaaaatttgtagagaattgagtcatgtagtgtctactctactgtgggactctggtgttggaattatcaaatgacaatgtgaatgcatcatagagatttatcctggactagcttacacttggaccaaaggtgatttatcaggcttatcattttatattgaagtccataaactctctcttctgcatccctctgttcgggagtgtgtgtggcatagaacaaatcagcctttggcacacattggaggaaagggtgtgtgttttgttttcataggttttttttagtgatgacaatcaaaagcccattttcttgattcctatggatatgaagccgattaagtattgataaggagtaaggtattagagtttaaaatcggggccatctctgagctacatggttaggtcagtggcacctttctctgaatccataatcctccaagccatttcaggccttttatgcagtcctactgcaacccagaactccttctaggccttcctctccaggagcagttatgagattgagtgttaactgcttataagacaccatatgctacacaaaactttttataaatgttgtgcttatatcaactttgacattaatgctattataatcctcaatttacagaagaagaaactgaggcttgaagcggttaaatgacttccccagagacacatagcagtatatgctagaggcaggactccaacccagaactggcagaaaagctgatactttcaaactttcaactaatggtctctgcagcctccaaagtatcagatttctccgtcaaatccttcttgcctggtctgtctgaccaactaatctctgataatgtaacgaaggttataataaatcccttccagagaggatatttgcatttaactggatgtttatgaaataatgtgctggcagaaagaaatgatactcatggtgggaatttctcattctttttctggtggaatgtataatcttggacaaatcatgaccgcaggagtcttcattttatcatctataaatgccaggattgggttaactactgtctaaagatctcttccagattcaaaattctatgattctttcacattaaatgcaactccttttcaacatatgtgtatacttggccctttattgaacctttttataagctgccaattggaaatacacagtcacggtagatatgacaatgagcaagtcacttaataactatcagcctcagtttcctaatctacaaaaggaggctattaagagcacctacctcacagtgttaatattatatacacaagtagcaaaatgtctggaacagagcaagggctcactagctatagctttaataacgtgataactgatggtgtgatcagttctattatcatctccctgcagaaatcacagtttatctaaggttatagtaaaagcacccatcatgacttcttttaatcataaagcatttcatgcagagtgcatattttaactttgtattctaaaggcattggtgtctcactaaaagctgggcagtatttatatcaaacagtatatcatctatgtgttcatttatgcatgcagactttcacccccctccaagctatgagaacaataggcgctttaaaagtctgaagcaagaaggatattagctccatgaatctttattttaaattacatttctgagttagaagtgtcaaaatggtagaacaagttaagcaagattgcattccccagtagggctattgatgttggttgcaaataaattgctggagcaggtgatgatagcaaagtccatgccatcttttatttagcaaagtatttctcttgttaacagctccttctgcatgctttcctttcttctgtttcacatcaatcatatttgacacattgcccaatgtcagggtaaaaaaaaaatgcagcgtctggctaatcatccagatgtttggcctcacactgactgaaacatctggttgtgtagctaaatgttatgttctttcatccagttattttgtgttctgttagacagaactgaagaataaaccctaggatcttcttctattaggataaagcttatagaatctcgaacttgagattccagaaccaaggccttactggttctcatagttgcacagctgtcagcagaatccggatcaattgagataatgtgtgtggaagcattatatagtatgtggaggcattatatggatttgagaagctcatgttaaaagaattctactccctttacttggttatacaatggccaaagaatgtttgtcttctggaaagaagttttaaaacagaataaaaattaattggtgttagaagccaagatttcagagctagaccaataataataacagctaagatatgtctgatgctaactctgatccatgaactcttctaagtgctctgcatagatgtaaaaacaatcctttgaagtggaccctactctttttttccattttacaaatgaagtaactaaggatgagagtgcagttaacaatttaccccagttcagaagctcaaaatttggattcagacaatttgatttcagagtctacgtatttaacttgtaaacttcctctgaaatcaaaatgtttattcagcttccaacaccatcacttattaaacttggttttgtcaccttaaagtggggatagcatgacataccttaaaaggattgttgtaaaggttaattgaaaggatgcatgtaaaacatttaacaatgttgttttttggtaagtagtaagtaaaagtagctattttttctctatgttatgcaatatttggaatcaaatatttcaatactaatttaaataatatattctaataatctcactttctgaaaattcattcaatataatttttttttcttggaagaacattcctagcaggttaagcacttttgatcaactcttgatataggctgttcttaaaataattggaagtccacaaattatatgtttctggaaactattctgaatatggaaaattatattcctttttctttttaatgaacatataatgagtatgtattaaggggaagatatatgctgagcttcctcttgccttccttttctcccccttcatttctgtcaccctgcctttcctatcttcacaatggtcctgtacagtaaactttgtttgcttttgcatttgaactttaggaatcaaggtttttaaagaagctgcatcatgtatcataaataaaaacgaaaaaaatgaagtgtaatattttaaactgttttagaacatgaggctcagtgttctatccaacaggctatgaaatattgctgttactaataagtatgatgatgaaagccactgattcttggacaactactatatgcctgacatattgctgggtgctttgcatacattttctcatttaacgcttagaagttcttgtgattgacacttgggtatcatgagcaactttgctcaccattttttcctatggtccggcgtctttagtcacttgtattactgttgttcagagtgacctttatttgattcatttacctttcagaatcttctattactcatgtatgaggaccacacatttataattagggagtaaatttggtcatcaactcggataaggcaatgggcaaatctgacatgttttcaaagacttttcagtatgctaactttcagtagggctggtttctataacagctacgacatcttttgtcaacactcaggctgattaaattgcaagattataatgttttccgaccctaagtgaaagtgacacattcttgttcttttagtggcttcataaaagtcaaatgtttaatctcaggaggaaatttaaaagatggaagtaaaaccttaatgagatgcaacataaataatagaagtccctttgcgtgaaatgacttgtgatgaggtttcttcaaaggaacaaactataaaatggagtgtttcagaaacctaaaatacactagtaaacactgcgttttaaaaatatggtatcaatgatactcagcattcagtaaataaaaagagttagacaactggtgtctgtaaaaatgttaattttccaaaacactataaatgtatcaccaaaaaataaacattttttaaaaaaattaggtgactattttcatgaatttttagtccatgaaacctgaggagttacttgaccacagcaaagattctttctaatcctttatccagccttttgtgcaatagtacctcctgttccactcacatttcacatgcctgtatgcatgtacattcagatgtgcctgtctttgtctcccagtgcttgttacacagaaggtattcaagaaatggtagccattctcacaatatcattcctattaccatttaaaaatgtatgtggaaaagggtaaagtgcaaacctgggttgttaaaataccggaaggatatctataatttaacaccagttcatttttgttttcaaatcactccaaaatgccctcacttattggtttagaaataatgtaacaaaacaaattgtgttgtgtctccaaagaacattttgctaagtgccagagctgtatataacactaaagtagatgctgacatatgaggattgtgagagatgaatggtgatatttggcttttgcttcccaagtataggtcgtgtccgaggtatagataattgttgttggtttatgataattcgacttgcggagttaggtcagtcagcatagatgcatattttttggatggttttttaacaatgttgcttaaaattttaaatcagattatttgccaaaggggggtgacaagatttggttattagcaaaaaggaaaatattaatctagatttgtttggtcttagtactgattatgaataagtcatcaatagttaatgataaggaatcagtctgctgtgccatattggtagatgaaatgctgctactcctcctattcctgggcttttctgtcccccacccccttccttccctccttcctctgtccctccaactcttcttcacatctcccaactcccccaattcacttcttttccactgcatgccatgttaccctatgcctagttatgatcctaattgtaaccctagttagagtagacacaaagtaaactcaggagcagggattataaagctcaaaattgttcctcggctccgcattttgtgtttattaacctattttacccttgcagcaactccaagcaagtctgtaaattttagcattgagagttctccattttgtgagacccctctgtctggtcaaagtgggatgacagttggtcactatagcattcaataattatccactatggttatttttattcttacagcttttattgaaagtttctttttaaccatagtgccaaagacaaaataaacaataaatattaatgattttcttggcttctatttatgatattgttattttacttttaaattctttggtatcttctgccctttcatcttttctgttctgttcagtcaagacttagctgatcctatctcaacctcaaacatatcttttctatttcatctcttgactagttagaaactttcacggcagctaaaatctcccacacaaatctgagtaaagaaaccctagaggtcaaagattgtagtgtaaataaaagtattttcctttatatatgatataatttatatgtgttatataatatgaagtctcaattagaatagggaaaatgaaattcaataattattagagtattatttgcgaagtgttctgctaatatttttcctcctattaatcaaaattagttttgtattttttttccatagcaaagtagtctaacaatagagaagaatgtcttttaaaagactaaattaggtgaaatctattctttttgttaaattatcctaatgtaaaaccaggtggcctgattaaaactagccttctttgctgcctcctactgtttcaagaaaaaggtcgccttaacacttagtttctcttgctgtcttttgtttggagtatgtgtgggggtgtgttatttatgcaggcatagctcctcattatgggaactccaagagcctgattgtgactgttttttaatgccgcctgctgtgttgtccttaaactcttgcttttcctggaatgcacaactttctcccagctcctggtttagccattggtgtcatgtcttcatgctgcatccttgtgcctctgaaatcgtgttcaaaagagtgtttatgtttcaaattcatccacagtctcaccacatttaaagataattgcagaaggtaaaacactattaataggaacaaatttactagcatctcttttactatgtgtcttatgcataaagcagtttctggttgttgggttatacagtgcctattgtgatagtctattctaccttcacctcccgccccactgcctccccatttaactaaagctcctgctgatatgttcaatttacttttttttcttttttttgaaatggagtctggctctgttgcccaggctgaagtgcagtgatgcgatcttggatcactgcaacctaagcctcctggggttcaagtgattctgctgcctcagcttctggagtagctgagactacaggtgggtgccaccaggcctagctaatttttgtatttttagtagaggcagagtttcactttgtggcgaggctggtctcgaactcctcacctcaagtgatctgcccacctcgtcctcccaaagtgctgggattagagacgtgagccactgagcccagcctgatatgttcaatttgataaatgaatgtgttgaaagatataaaatgtgttaatccctaattgcatgtggctgtgatatttaatatggctgattctaatggagtttgtaacttatggggaacactatgaatgggatattataaatatttgtatgaagtaatacaagagacatttcaacagaaaaccatgtgatctatgccctccatcattattttctttctgtgtaacaaatgaccaagtaaaagtagtgaattaaaatatgagtaagtctattttcacagtattcataatttattataaacttcttttttaaaaaaataaaaaaaattaacttctattcctttaacaaagcaaagcaaaccaacattattatcagctaatgccatttgatttcggtttggtttggtcagtctcagggtggccaatcatttaagttttctgggactgttccaatttaagcactgaaagtttcacttcctgggaaaacacacactcctttgagtatttaccgttgacttccaggtgacccacttaagggcttcttccagaagggcaggcaataagactatcaagactcttcaaagcactcttccccaaagccattagatgaggtccaattttctcagcttgatatttctgagaactgctcttcctttatttccaggatttaagaaaaataaaataaactgatatatatatacatacctttagaaggattcagaaaagaagaaatggccgtttcaccccaatatgtcactatagatatgaatgccactcatagaattgacacgtcatgtttttaacttctgtgctttaggattttcctgtttgaattgtttatgtgcatgtgattttggtggaatttcttcccctttcctctgttccttgctccttcttttgctcagtcagcataggaacatagctcccacactaggaagggctggaggttagtaacatcaagcagtgggctttcaagttagtttgcaccttggtttggaagtgtttgctcaggtctcagatacacaggagactgtgtaatcactcttgtggcatctactacacacagcacgtgagttattcctaaactgagcacaggctcctgggtggtgaatcctagtctttttatctcctgcaggctaagccttggtatttccttcagattacaccaaaaccaaaataatgggcaatgttgtccctgaatgttcaaattaggttgagtacacagagccaaagactatcaaaagaaagtgtcctggccgggcatggtggctcacgcctgtaatcccagcacttcgggactttgggaggcagaggcgagccgatcacgcggtcaggagatcaagactatcctggctaacatggtgaaaccccgtctctactaaaaatacagaaacaaaatcagccaggcatggtggcgggcgcctgtagtcccagctgctccggaggctgaggcgggagaatggtgtgaacctgggaggcggagcttacagtgagcagagatcgcactactgcactccagcctgactctgtctcaaaaaaaaaaaaaaagaaagaaagagagaaagaaagaaagaaagaaagagaaagaaagaaagaaagaaagaaagaaagaaagaaagaaagaaagaaagaaagaaagaaagtgtcctaaaagaagtggtggtacctgtggggcgtgtttggtgtcagagtgtttctgctaaggttattttaattagcctcctcccaaagccctccccctattctccttgaggaactgtttgaccgtcacatccttagaaaggccaaaccactactaactctcctgaccctctgccttatcctcatacccttaaagatgtgacttaaaagagaaaaaattatgttgttaatttcatcaactagggcaaaggggaaaaatgttcatttcgatgcaggaagttaatgggagatgggaggaagctacggttacaattcccataatacattaatgtatatttaatataccaccttgatttgtggcctcaagttaaataactacatatgtttgcagcataattcttttcataattgtgtagcctcaatgggataacatttgtattagtttccataatcgaaaatgtcaaatgcctgtttccaccttccaagtattttggttttaggtagcaaagacaattctttcaatgcgtatctgttctcattaagttctgattgctttataaagaaataaagtcttttcccattgttctgctctgtggaagtcaccttcagagtaagggtgggggtgactgtccttgccaatttttaagtaactgccttgcaagggtgattccctacagagttattttctgcatagtttccctctgggtacagaatgtgggaaagtagatgcaacgcattttagagtagtcatttgctctaataattagcattatagtacagtgtatgggctggcttcctgttgaggtctagatttctacatataatgtaggtttttctattctgtcctatattaatttcattggagttactctttatcagagcaaacatccgtaacatttagtctttttttttttttttttggagacagagtcttgctctgtcgcccaggctggagtacagtggcgtgatcttggctcactgcaacctcttcctccaaggttcaagtgattctcctgcctcagcctcccaagtagctgggattaccggtgtgtgccaccacacctggctaatttttgtatttttagtagacatggggtttcaccatgttgagcagagcaataactctgtagggaatcacccttgcaagccagttacttaaaaattggcaaggacagtcacccccactattactctgaaggtgacttccacagagcagaacaatgggaaaagactttatttctttataaagcaatcagaacttaatgagaacagatacgcattgaaagaattgtctttgctacctaaaacgaaaatacttggaaggtggaaacaggcatttgacattttcgattatggaaactaatacaaatgttatcccattgaggctacacaattatgaaaagaattatgctgcaaacatatgtagttatttaacttgaggccacaaatcaaggtggtatattaaatatacattaatgtattacgggaattgtaaccgtagcttcctcccaactcccattaacttcctgcatcaaaatgaacatttttcccctttgccctagttgatgaaattaacaacataattttttctcttttaagtcacatctttaaggatatgaggataaggcagagggtcaggagagttagtagtggtcttgaactcctgacctcaggtggtccgcctaccttggcctcccaaagtgctaggattacaggcgtgagccactgtgcccagccatttgtaatatttacagagcattgctctttttcttatcatggaaagttattccaatatctattcattctatacacatttattaagcatctactatgtgccaatgttaaagaggtgaaagtgtaaccttggccctcagactgactttttgcaggttatgctgaaagatgaatgctcagtaatagctcgtgccttaagacgtggccgagcaagctttggaggtaaaatagctcatggagtttttatttatttatttattctttaaaaatggtcacaaagatttcagataaacaatctgagtatggctaaattatttttcttaggtaaacataggaggcaagaaattaaaagggtgggagaaacattaattaggctatgctcttatcaagtagtgtgaccttagcgaatttacctaatctttttgaacctcagtgtcctcatttataaaatggaggcataactttttatgaagattaagataatgtgtgaacaatctgtgcagtagtagttgctcaataaatggtagtgattttcacatgtatttggactattgtagaatatagaaaagaatatcatgcaaactctagtcctttaaatatgagtgaggaagaggaatcacctgtgtgtatgtgattaaagctgttagctatgatgaaggcagggtgatttttctctgaagggtaattcgagtacagagatattactttgaagaagtaatatgttaaatgaaatcattggggctgaaagtggtaacaacattctgggaaaggagccgtttactctcttcacctctaagataaaccataatgcatgcatgtatttaataaactgtgatagctagagctgtttcactggggcatcagtaagctatcctcaacccccttttcttttcttccagcttttcacttccaaccccctaagttttatcagaattagttaatactgagtccagctgaatacattgcttgttataaatagaatgctttctcccttcctctgcccctgaccaaacaattgattacaaagtttatctgctgagtgcggtggctcatgcctgtaattccagcactttgggaggccgaggtgggtggatcacttgaggtcaggagtttgagactagcctggccaacatggtgacaccccgtctctataaaaaatataaaaattagcccagtgtgttggtgcatgcctgtaatcacagctacttgagaggttgaggcaggagaatcacttgaacccaggaggcagaggttgcagtgagctgaaatcacgccacggcactccagtctgggtgacgggctaaatagaatgaaaaaggaatgacccatacctgaaatgtttaacataataaaatgactgatatcgattgatgacgttgagagcaatgaccagatataagggaacaatgtgtttttacttggattgtagatatcaagaatacaggagaatggaatgggagggctaacaactctagacaacatggctgcaatctatgactttgcattcttgctataatttactttcagtgcttttacaaatgtaagactctcgaggccagcagtgtatcttttacgctattcattctacttttataattattattattattattattattattattattattatttgcaacctctgcctccaggtttccaacaattcttctgcctcagcctcccgagtagctgggattacaggcgcgggccaccatgcccagctaattttttattttattttattttatttatttattttttattatactttaagttctagggtacatgtgcacaacgtgcaggattgttacatatgtatacctgtgccatgttggtgtgctgcacccattaactcgtcatttacattaggtatatctcctaatgctatccctcccctctccccccaccccaccacaggccccagtgtaagaaatacaataaacaaagtatcttttattttggctacgtagttatgttgagggtcattcatcgtcctccagtttagcctatttggaacggtactggttaatctcaataaacaaataacattgtcagtttaattgttcaattattggagggaaataaatatatattaacctaaatgttaaattctgcaggaaaaaaactgattagacatagacaatatcaacatgggtttgttaaataacttgccttccaacaggacccaaccagaaattggaacctatgtttcatagaaacatgattcttagaaatgatctttacacaattgtaaaacaaagggaagattatgtgacgcagatgccaagaaatcagacctaggcaccatgtacaagtatacaagcaatgccgagttcatcagtcccatggctgctgctaaattgggctttatccccagcaaattaacacagttccagcaggcacgataagtttactctgaccagattactgggttgaatggcatatgccgttattttagaaagatgcagaataacatttccatttagagtcctggcagaacaaagcttggatttgggcaatagataaaaacacatagagagtatttgcagatgcatgtgatagatagaaatggtgagtgaccatttagaaatttagaattggaatttttttttttttttttgagtctcgttctgtcacccaggctggagtagtgcaatggtgtgatcttggctcactgcaacctccacctcctgggttcaagcaattctcctcccccagcctcctgagtagctggaattataggcgcccacaaccgcacctggctaattttgtatttttagtagagacagggtttcgccatgttggccaggctggtctcaaactcctgacctcaggtgatccacctgcctcggcctcccaaagtgctgggattataggcgtgagccactgcacccgacaaaaattgtctcttttttgatatttcctagagcagtgtggctcatttagattgaaatatctgtcagaagctatataccagttccattgatttcaacattaaaatgtctccacatattcttccgcatccttcttccagctcatagctgtaattagtgttatgctccatggagtggcagaagaccagctgaacaaacagccatgtacgtaggaacagttccaggcagctaaaagagcttcttcctcacttgccactatcttaaatggtatctggtgtctacagttgctccttctactttcttaagaaaaaaaaaaaaaaaatccaaatggaaaagaggactctgaagacaaattagtcctttacaattataattttatttgatttcaaagcagtacttggtatagcaccagtccaaacagattggaagaatgatattttcattccagctcctgcatagaatatctttgtgcttttcaattgctttagggagcttgcaacaatagaatcctgttaaatctaacaccattttgaactcttccttgccgatattgtgataagaaatttatacctggcccaggtttatctctgttgataatgggcttcatggctatagggacatgttgatatggtgagctagcacctatcattttgacacctactctttagtagacatagagaataatgggtgcttggggtaaagtgctggagaagagtgtcagcagtcagtgtgtatgaacctagtgatggatgtctctgtgtttgtgctgtggccatatctgtatggctatcattctttcttcctcttctcatttcttttaattttccttcaacagtctttcatttgttgcttcaattcactccatttctccccagttcttcttttttctgtcttctataattctagataaaattatgacatgacttaaaatatcctccttttttgtccgtgattgctttcaatggttctaatgaccccattggaagtctggtgattaggccctgaggggccacagtaatggaaaccttgtgttcagccttcataagggtgatccaaaaatgttattacattacttacacctctttctgtaagtattttttcttcattcacttcgaagtatgggatgcttcccatgtgcaggagaattagctcattcataactcaaaggcaagtaatttcatgttttgctatttataagagaggagtctatcatgcaaggatgcaaaggagtatgaaatcagtcacaaatgtaggaaataaaaggcaataagcttccattaaaccaaacaaaagaaaaattaataattaggcagtctctttgcaagtacataataataatactctatttttcaatgaatcaattaggtaaaaatgaaacaaaataaatgcaaagagagccctcaaaaatatatcacttttacatatgtaatataagttgaacatctcattagaataatgtgacttttttaaaatttatttttgcttcctagagttcataaatcttcaggtggtaagtaggggttctttagctattcataatgcaacttgcttaggttaattagtagagaccctttcccttcacagctgaatatgagtgcccctacttactattcaaaaatccccaaaaccagcactcttctatatattggtgcttggaagagattgtatttttcattgacctgcaatattaggtattttattataaataaagtctcaaacaggctttattttatttgtcagattctcttttggtttcgtctcataaaatattagctgaatagttattatataaaaaggaaatgatcagaatatcacatttcgggtggtggtgtttagtttgtgggttccttcatgtgacaggttgaactgggtggtagagaattctgagttctgtacaacagagtgattgatttctcggtttgcatttcttggcatctggcagtgacaccactgcagaccgagagcagaaaatggacagtagggaaaaatgcaacatttctacttggtccagctgcctttgaaggatgctgatgtttcattttttatttcttaccccaaacatatttatttgctgagtcattaaatagggcaagtgttatttctttctttgtatttgccatctcaccacagaagagttttattggccgggcgcggtggctcacgcctgtaatcccagcactttgggaggccgaggcgggtggatcatgaggtcaggagatcgagaccatcctggctaacaaggtgaaaccccgtctctactaaaaatataaaaaattagccgggcgcggtggcgggcgcctgtagtcccagctactcgggaggctgaggcaggagaatggcatgaacccgggaagcggagcttgcagtgagccgagattgcgccactgcagtccgcagtccggcctgggcgacagagcgagactctgtctcaaaaaaaaaaaaaaaaaaagaaaaaaaagaagagttttattaaaccatctcgaatcgatattgttttggcacaaattgcactaataacttgaatatatagttttgtttttttaaaggtgccttcaaaatctgatacgtataatgtatgttaaaattgatatttctgtgaaagaggttaagatcagaccgctttctgattgcagagataaaattgatagttaacaagtatttattaaacatctattatgtgactagtactatgctagggcatgatgaaaatgattcaagatgaaccatgcaagcacccctctcttcagcacctctgtgtgtaaaacataaacagaatgctatgattaacactgaaagggttcagtccgggatacttgggataaaaatcggagcactgataagttacttgtcatgtacttacttttttaaaaatttaaaattttttaattatgggtacataataagtatatatgtatggtatacatgtgatattgtgatacaggcatataatgtgaaatatcacatcaagataattggagtattcattacctcaagcatttactgtttctttgtgttaggaacattccaattccacttttttaatttttaaaaatatgcaatacataattgttgactatagtcaccctgttgtgctatcaaatgctagattttattcattctatcaatgtttttgcacccgctaactgtctctacctttcccttctctccccaatacccttcccagcttctggtaactgtcattctactctctatcttcatgagttcaattgttttaattcttagctcccatataaaagtgagaacattccatgcacttctaatttagactcttctcctctttctctgtcttctttttttccatagctcactaattttgggcatctcttctcatttacagtagcttgctgctcttcattcattaattattacaatatataattctaccaagaagcccaaagaactatagtgtttttatgtcattattctcagttcagaaagaaagcatgtgtgtggcacagggaaggcatttgaatgaatgtatgcattttctggatagcattctcgaacagagatttgatgagagtcacatggataattttaacttttctagtagcaatattaaaaacacagaaatagcttctcaataactgaatcagtaatccatttttaaaatctttttcaattcattaaaattaaatagaattaaaaactcagtcccttagtcttttttttttttttttttttggagatggagtcttgctctgtcacccaggctggagtgcagtggcgcattcttggctcactgcaagctctgcctcctgggttcatgcctttctcctgcctcagcctcccaagtagctgggactacaggcgtccaccaccacgcctagcttattttttgtatttttagtagagacagggttttactgtgttagccaggatggtctcgatctcctgacctcgtgatccaccagcctcagcctccaaaagtgctgggattacaggcgtgagccaccacgccctgcccccttagtctgactgaccaaatttcatgtgtttacggattgacaaccatgtgggtagtgcaggttttggatgcatggcaggctgaagcttatgtagcacatatttgaccttcacattttattaagtctaattttttaaagttttgtctgttcatttacatgtggaaggatgatagaaatataggaagagacatgacagaaagcttgcctaggactcagatcaaggattcagatttcccaattccggcttcagggccctgttctgtaacatcacatcagggaaaggaaaatgagagaaaagaagaaagaataagaactaatgttaattcatgtcagacacagtgccaaagatctttatttgcattattgttattattttttaaaaaataaatagactagcacgtagcctagcttacacacttctcattgtatagatgaggaaactgggaatcagttaaactttataaccacaccaagatcattgagctagtaagtggcaggcttgggatttaagaaagcttgtaatgatgttacatttgatggtttaaactgtgctgtgggaagggaatccaagaagataatcccatgtttctgcttcttgtgatgtttgcaaatctgtgttctggagtaagtctttgagttgactcttggagcttctgaaacgtctattggatatactataaccaaagataaataaataaataaaaagatcagggttcctgaacgttttcatctttacattgattgcaatgattacaagtgatcatttcatcacttggagcattattacctctatggggctttacatgatactgactttgtcaataaaaggacatattaggagcaggatttctgtttgggccagaacaaggggacataccctatttttaaaattccccagtttaggaattgaagtgactgcatactaaagttggccaaatttcatgtggctatggaatgagaatatatgaaaagttggttgtaaaaacaattaagaggattggggcagactattttatggatcccttcctccttagcttctgaaatgaactaacattgattctacaaccacttattaaatacctactttttgccatggctgatgctaagtgttgaggctagaaatgcatatgaattatattttaataagcacagaataaagaaaacttgtcttcctaatttttactttaaaagacttttatctcattgtttaagtgccataattgtacaaagcatgctgttctgagttcagtgtttcttggctcattctcagtcaatactctgcatagcatctttgaattccttactcatcaaagggtaatgagttaatttgtgtactctacctctgccaccttttgagctgtgttgttgaccattccctatacatttgcatctctgtctgccagaagatgtaccaggaaaataaaagcagcagaaaatcttataacttcccacctagacatcagtcaccatcagagtttggtctggaaacagaaaagtttatttaaaacaaaattggtactctgtgaatatttcaaccatttgttccatttaatccccattagtgaatttgcttagattaatttttttgtggattccatttccaagaatgaaagcaaaataattacatcaaaaggccactgaaatcagccaaattctctggcaggaaacttattctattcagtcacattcaaactatcaggtatgaaaaatacctttcaccactggataatacaacaatggagttggaaaatcaatcgtgtggtaaataagcaaaaactacgtgcaaacagaggaaagaagagttgttctgaaaatggtatttcaataaaagttatagtgatgacgagcagtgtgatgatgtaggaagttccaaaactaggtagagggtataatcaaaggtgggtacaatggaacaagcctggaggcaaggacgggccagtcaggaacaggtgggcttatagtgaaagaaagtggaggctttagaagtagagtatttgatgaattcttccgtccattctattttggcttctatgtcaaggaggatgacagatattcattgtgtagttttataggaaaggcgattggtagtgacttcaatgttataaagaacttggccaagtccataaaatgtccatggtgtataacaaatcttttatggtgagtgatccatggaattaggtacttagaaaagtcgattgaaacatattcacagaaaggcaaaggtttgatgacctggtgcatggaatgagacagagacactgagaaattttgattgtacaagtttttcctaatatcccacttacatcctgtagcggtgtgggcccatttattcttttttatgtttggtttccctgtctcatggtaaaatcatggacagatgttacccctcaattttctctttttcaattatttctgatccttctcactttaatcagtttacttgatagtctctgcgctagtgtaatttctccagccttttgaaaaatgtagacgcttgagccagacaaaagcacttcagcaggaacatgactaatcttgaagacatagagcagggctgataatgtacgccaggaactgtcagttaagaaatagtgatactgcattgctgactcacagtcagctcatgggtcactatgctgcccccattctgttgagatttcagtacactttccgtatatggagtttctgtgttggtacacatccagaaggtttcttgggcgcattgaccttcacatattgtttggttaatttacctaacttggtattaatcagacagaaaagacaaacatgaagtaaggaaagtcggcctttgctgttctcccttgaacttggcttcacttctatccccaccatttagtaaggaagaacagccccaatttattgagttgctatgagccagacactgtgtaagcactttctacacattattgcatttaattctccaaagaatgagataactattataatctctgttttatagaacaaccagctaaagtttatcgggttttttttgtttctgtttttttgggtttttttttgttttttttttttgagatggagttttgctcttattgcccaggctggagtgaaatggcgccatcttggctcactgcaacctctgcctccggggttcaaacgattctcctgcctcagcctcccgagtagctgggattacaggcatgcgctaccatgcctggctaattttgtttttttagtagagacagggtttctccatgtcggtcaggctggtctcgaactcctgacctcaggtgatctgcctgcctcagcctcccaaagtgctgggattacaggcatgagccaccgtgcctggccaagtttatgttaaataactcgtccagaaggtgtagtgggatgtttgactccaaaatacatgcttttaccgcctcaactgactgagcttgggactacctctaactttcattagaaacacaaatctttttctaataaactttcttcttcttttcaataaaaacatttcccacaaggtgacttaaattcattcacaattaggtataaatactgataagagcagttaacttgttttaagagtctaatatgtgctaagccttatgccagatgctttacaagcattatcttaaaccttgtaacaattttgcaaaaatgttactctattttatagaaccaaaacccaagactatgaaaacctaaatatcatcctcagagtcatacagcgaagcagaaattgtatcagctaatgagacttagtgccatttctctcatattgtgtgagaaaaatggcaatgctcaataaatgttgttctaactgttccaggtatcaagcagtagaaaaagaatatggcagatcaggtggattttgctgtcagccctggaaacactcagctggtggctacataatccatcatctcctgaagctttcattgtccacattttttttctaccctttagtcatgtgtttgtaaggaataaattactaaaatacaccataccttttaaaatatagaataaaagctcacagagagttagggtgacagaacatatgattcaaccttctgccttctggcagacagtaggctatttcttttaggtgggtatctaggaatagatacttgcatataatattttttttttgaatcccagactggtcctactaacattcttgattaccacttatttaagtgaccatcaaaccagttttatatctgatatgtttaatccaaataaatgtctttttttaaaaaactgtttaaaaaatggtatttaaatccttcccagattttagctgtgtatagtctggaaggaaacccattcacatggttttatcaggtttgatatttaatagatcaaattagtaaaacagggccctcacttcacaggcacggtgaattctttgttgataagatctatcaatgatcagtatggatcattggatggcagtgaacgtatacgtttgtggggaaaattcttatgcaccttcatagtaatggtactgcccattttatttgaggataattaaaacacaaaatacccaacgatgctgtttttattgtaggtatatgttaattcctctagagatagacaagactctaaattcatggaactttaagtgggatgttccacaaaggaaactctttaaaataatatagaaaaataaataagtaaatgtcaaccaaaatggcagaacatttaaaatcagtctgccaaatatcttttctcactttacttcatttgttgaacaatttatatgctgatatagatggccattttaacagtgtatacaaagcatttatatccacacatgtacatttaatcaaacctacatgtctacatacacatacttaagacacacatagagagtgtgtgagagagaatcaactcatcataattgtaaaggtgaagaaaattgattccttaagactaaaacacaccatattaaacttggagtttatattttgaaaataagattcaggaagtcttctaaagcattcgaagattgattagaaagataaatttcggcacacagggtctctgttcttgtaactttccctgtggtagcttatccctctgtataatacattttgtcatcattctttctttcctccctgatacaataaaaataatttccaaggttagattctatcttgcaagagcttttccccaaggaggtgcatgcatcttcttaatttattatattatataataattcctcataggaaaactaaaggcaaattaaaaccacatggagataatgcctgactgtgctttagactgttgtctaccactggctctttagaaaaagatcagagatacccctctcttgattgtccattttcttgatcatgcaatgtggtattttaagttctatgctggctttgatgcttttgttagtcaaggtgcatgtgtgaatgtgtgaattggatatgtgaatgattttaatattagcttaaataaaacattactgggaagacaaattttctgaaattcccattttcctcttccacttcccctacccccaaagaaacttgacatattcgtttcaaagcatacactgcttttttactatttttatttttatcgtgcatatcacaaccccttcattagtagacatcattgagcattaactgtgacttaattctagaaaaaaatatttttgagatacccattaagatatcacccctgacaaatataaaaagagaccttgagtttacttcattttaaataaatagactgtcttcatttcctaactctgtgaatctgacgcttcttatcaacaccccaaattactgtcaacaaattcaaaaccatctactgatgaatgagatgtttaggtccaattctgatatgccatgctcattctcatacagagaaatacctacactcttttaaatatagttgttattgctgtgacttgcacctactaaacaaatgtaaaaattcttacagttcaagaaataccagtgaagtgtatattattgccctcattacacaaaatgctcatggaaaacactctatcaattccaattatgttctggggggaaaaaaaaggaaactgaataaaaagcaatcccagaatatttgactgggctggttggttatagctgctgaacaatatgtaattgtaagaagtgtggcaaaatgataaaaataaactcagtatttgttaaagaaatgaaaacgtggcaataaaagattccggaaagcgatttagttttttgcattacttcttcattacttgattattttactgtttcatttctatttacctaccaagttgattcttttgcatctggattttgcacaattctttcaataatatacggttcagtggctataattacaggattgttaaagttcacattttactattcatcttgttatctctggtaatggaaggttggaataaatgcacataattacatggttggtcttaaattatttttatattgctcttgccaggatatactcgaaaagcagtatttattctctaatatttatttttggtggtagtggttttagcaaaataaaagtaataaatacataaatggactggtcccacgagcttactatctatggtttttttcaaattaattctaacccattcatctctctgagcctgctaggggcaggaggtgcttagagtctatggaagaaaaacgtcatgtttcagagctctggtaacaggaaaatgtccctcatgaggtactcatcatttgatctattattttatctatttgtagcagagtaactcagtaacctacagatctgtggaccaacttactaaataaggtgtcaaataagtttgatttcattctaaagcaatgccatgtcatgaaagtaaagtgaatttttttgtttgtattatactggaaatagtctcattgtactatatggcactcaaaacattttataaaaatcttagcactatcaactaaaaattaactcataagctcccgtaattaactgaacagatgactccctgttggccaaagggaccccagaaaagactgaagaactgagttcgtggccattgatggaagcgaggtcagaaacgcctcattacatgccctttatgttagagtttaggcacaactgaccagcattaacattaaaatagagatcataagattaactaaagggactcattgtgacactaaaataccacattctaaataagacctaaggccatgcaaagcaagggttaaggcatgctctgcaaaccgtaaaatctttttttaaaaaattaatcctgcataatgtggcttactttccaatctgactctggtataccctcacatggcagatagcagaccccttatcttgacttaagcatccctttgtattgacctcaagtctttagacaaagcttaactctttcaatcaattgccaactaaagtatctctaaaactcacccatgacttgtaagcccatgcttcaagatgtcccaccttttcaggccaaaccaatgtatacttttcatgtactgatttataattttacctacaattcctatctccccaaaatgtataaaaccaagctgtaacctgattactttggtaccaattatgcaagacttcttgggtttgcgttttcttgggctgcaccattcatattggctcagaataaacctctttaaaacattttacagaggctgatttttccatgaacagcagcatccaaaaaatccacaggatacatgtatcaagtatttattaagtacctacgatatgccaggcattgggctatatatgaaaaacagtgttatcagacatccacctagtgctcctgattaaaaaatggatgtgagctcattttacctttacggaggtccagagatttaaattacttgactagtccctcagcgagtcaggagaagaggggttaaaacctgattcctccagttatatagtcatttaatgttcttggacttaccagtacttttgagtttttgtgttttttttttttttttccttaaacacaaaactacacccccgcctccagctcccaccccctcccacacatatacccttttttcatagaacaaaatttggaataaatggactttaaatgaatgcattgttttgactctgcagggaaatgacatagagaaaataaggaatggatcgtacatgctcatgcactgtctggggcactcctgctgaagtctcaggagtgtctttggtttgttgtctgagacctgagagttaaaaagcagagtgccttttggaggaacacgtgtctctttccgcagcgggacgtgcacttgatacacatcagtgggcatgccatcagtgcctcgcagctcatctttctctttagggtggctgtgttgttcttccgatgactggcttgccctggagaaaaatactgcttaaatattaagattagattagttttcacacagccccattttaaccactaaatttaaatccctcagcaatctacttcccaaccttccctaggcataatattcagtttaataaatggtttgtatgccattatttctcatcaatatataaaaactaaaaggaattttaaaaatccatacatcttggttgagatgaaatttgacttgatgagaagagattattcttagaaatgtttctaattcccaatcaaggcattctatttcaaaatgtaggagcatggttgaaagaataaatctttagaaaataatgtatgagcatggttgaaagaagaaatctttagaaagtaatgtatataataatatacatatatgtatatatacttatatataagtgtatatgtaagtaatatatatctctcacaaatattgttttagtcatcatcatcatcatatacacgtgaatatatgtacatatatgtattatatatggtatatggtatatatgtgtatatatgcaagatatatatgagtatatatacatgtgggtgtgtgtgtgtgtgtatgtatatatatatatatatatatatatatatatatatatatatatatatatatacacatacatatgactccaaaaacaattcctctacaaattgtgtgtcacttccttgacccattacctccccaatgtatatatcatgtgaatatcaaacaattgaatgttttgttggtacaattggattcattcacacggaaacgtggagtctatttcttccttcaaatcctcatcctccaattaattagctgaaaaactgactgcatctctgattctctaagaagcatggaagagaaagaaatgggaaaccagctagcagctcattacatgaattcaaacagttccctttgaagggaaactttttcctggcatagatgatgtcattgatgagattgcaagggtaggcattgtataaagatgagatcctttttaattctgttttcaaaactataaagctaaaatttttagaattgaaatttcagttaacatgacccatgtattagataaaatgtctctttaaagcctgggagctctccaaggtgtggtgtgtttcctatttgctaggtacatgattacgatgcatatggatagatgtttctgaagtgtttccttctaagtgcactattgccagtcagatttacacccaagtagcaaagatgttaatgccatgcaatcctattaatctaacatgttgcttttgtggattagaactactcagactctaccttttagttgtagttattttaaatctttaatactgagctatcaaattttcttttatgatacaaagctactaagtagaagatacttgaatattccattggctgactgatgtgtttattaggcacttactctgtgcccaacacaatgataaacattctcagcaatatcgtgaaagtttaacacaggattcctggcttccagaaatatgatgtttacttaagaagagataggaacatatgtgaaaaagttaagcttcatgtagtatcttaagatgctaagtttagtattctggtggtggagtttcttatcaacaatgtttcacagaagatattgagctcagcttttcattatcaaagcaattgcatgaagaagaaatttgagaaagtacaacccctggtaatgattggagcctctgaaacttttgtaatgtcaatatccatagcatgactattttttatttccggtactgatgtggcagaagttgtggagtagtgtttttgagttatccgctgtttaggatcctgtattaaaagaagtatgtcggctgtgcatagtggctcatgcctgtaatcctagcactttgggaggccgaggcaggcagatcacctgaggtcaggagttcaagaccagcctggccaacatagcgaaactctgtctctactaaaaatacaaaaaaattagtcaagcatggtgtcgtgcacctgtaatcccagctactcaggaggctgaggcaggagaatcacttgaacccaggaggcagaggttgcagtgagccaagatagtgccaccgcactccagcctgggcaacagagctagactctgtctcaaaaaaagaaatatgtctcagtagtgcagttatccttctgtaggtttgtattggtgttcagcaagtatctggtaaattaatgaattaacaagagaatagtttctatgaagcagaaatgcatagcaaagaagtggggtgttgaaaggaacagctgggatatcagttatacaggttgaaatgtggcattggtacaatgacatattagttatactcttacaagttgtccttgagtgggtgcttgatagaagttggcttgcaaaccaaaaaaggttaaacacttgtcatggcctcaggctaatgaccccttctaatatgcaattctgtttttctcattctgagagcaaaccagatgccccatgatgtgcccactgttcttttgctaatgtgttcatcctcagtgccttcattaccagtttctttcatttgacatgcaaagatcttttttcttggctcatcccagagaagtggccgggcaagtgttctcctgagaaaatgttgatgactctggcacacagaccacatacaatttgctgcttcctcacattcacactgaagttggctaaggtgcccagagagaaaccctgagccctgactgcatccaaaaccagtcattagggatgaccaccgtgggatccctcctactgggtgcctggttaaaactgagtgtcagagaagagactggtggctttgtcattgactttcttgttcagatgtaagagcatcatcactgggagaaggaaatgtgaattgtgaaaataaataatgcagatagaagagtcggaagtacagaggagtgttcctagagtgctttatatggagctctattatggtgcataccatggtgtgttgttaagttagtttacgtgtcagtttcccctttacactgtgaaatttagcaaagcagagactatgtctgattcatctttattccaagtacctcacaaaggtaatgctagcgttgaccttaataagcatttaatcatgtttattcatttattttttgaatgaatggataatgattaaaattgaggtttttatctcttgattatggagcttaactcattgtgagcccattgacatcctgaaatacttgctgaatgagagaataaatgaacagatttaaaaaaaaaaaaaaaccctgaagagctaagcttaagccactatttaggctttgaagttgatccatgtggtcttttgttttggattgattgtagggactaaagaagtacttcatacgttgtgttatctttctgctcaggtcactgtggacgatagatagcctttacttctccgctttctcaattttcagccactggtattcaactgcaggccttctttaaaaatgtacctctttctttcaaaattttctgaaaagctagaatttttttgttttttgttttttccaggaaaaaattttaacttactggagaccaatttcttttcttaaacctgtctctgagctgagtatactgtatagtccctataatgattttggtaaatccttaagcataaggtggtcattgtgtgtgacggtgttttctgtttagtgaagacaaatggtgggatgagtctcctgctaggatgtgcagaaatgtgagcattagtctcaaggtacattccgtaaagtgttggtgccaggtgagtattgaggttgatagcttctgtgaggcctggtttcctggggttgtgcccatgttcatatgacagctgcttccacaataacatagcaggtgcgtagctcaggatttgcccactttctgcaagtggacactctcgcttgtatctaaaaggcctctcccatggtgccagaatgcctctgacagcattttcagagctgtgacggcaggactgtagctttatggtgggagcttctatctttgtaaatgccactgatgtcagctctcaccattaaccattttcttttgtcaaatgggagagattcaggactcatggaagtgagagactggcatgatgaggcaaacagggggcagtttaactggctgtttggccactttcccccactctaattctccttctcctttccataaaacatgctttccaatttctgccaataaaagcctttttaaaaaagtactagtctttcatttttttttttgcataccttgttgttattccttctgaaccagtagtaacacaatatacgaagtacattctcttgggtataaggccagtgtataggtgggaatcccatagacctaaaaagaaaaacaatctaggatttctggatgtgctctgaagtggcaccttctaagctgcagtatttgttcaacagtgtttttccaacaaaaaataggatgagttcacctgtgaagcatcctgaagggaaacaccggtgcactgggcagggaacaggagacctagatatacttcttcttttttttttttttttttggtagatatatttatttatttatttatttttattttattattattatactttaagttttagggtacatgtgcacagtgtgcaggttagttacatatgtatacatgtgccatgctggtgtgctgcacccattaactcgtcatttagcattagttatatctcctaatgctatccctcccccttccccccaccccacaacagttcccagagtgtgatgttccccttcctgtgtccatgtgttctcattgttcagttcccacctatgagtgagaacatgcggtgttcggttttctgtccttgcgatagtttactgaggatgatgatttccaatttcatccatgtccctacaaaggacatgaactcatccttttttatggccgcatagtattccatggtgtatatgtgccacattttcttaatccagtctatcattgttggacatttgggttggttccaagtctttggtattgtgaatagtgccgcaataaacatacgtgtgcatgtgtctttatagcagtatgatttataatcctttgggtatatacccagtaatgggatggctgggtcaaatggtaacaacaggtgctggagaggatgtggagaaataggaacacttttacactgttggtgggactgtaaactagttcaaccattgtggaagtcagtgtggcgattcctcagggatctagaactagacctagatatacttctaacataatctgtgactgtgtgcaggtcatgctaagtatgtcagactgccattttctccttgaggctggaagtgtggggagaaggggataatgtagttgagaatccattactggccccaccttggacagagagacaggcaggtaaagggtacacatgtgcctggatggtgctgctactggactcttgtttacattaatgtgtcaacagtgtgctccaaggttctattaggtgttaacaggtgtctcaagaaaaaaatgtttcttaatgagatcagtttgtaagaattctgggtgaacacgttaattagtttattcttttaatgcgttgaatgttttttttttttttgaaaaataatagaatcccttcagaattcttaatatgatatggtgttctgtatattttcaagaggagaggtatatagtgtttctcaaatttatttgcacatgaaatgcctgtgggacataatatctctgaaggccgatgttccttgaaagactgtgtgaaatattgaactatatgatctctgaaagttcttgaattctccattatcatcagaatacctggcccttccaagcccttgaccttcgtctgtggagtattgactctagctgccttccagacattgtcatctatgcttcttttcctctgaggacgatgaaccccggctgttctctcagtacccctgaaaaatgggaaattgtatttttttcttctttgtacccaggagtctatgtataatgcataattctcagtcaaaaggaacttgcttacttaagtgctcaaaggtttttgtcctgtggtttttgtaaggtaatcccacaacatccagataaacaaataatcacaagacataaccttccagagtgttccataacattgatcacaatcaaataatgaggcacgattccatgaaacattaggaaaattataaaggcatcaggcagaaaaccagcaactagcaaatggtttctccatgatgattttgggttcacatttcacttccatatataatacaacttatgtgcccatatttcatcctctggaagcctgccacattatcctctgaatgaatattaacactccttgtactctgaagtagcctctggtattctggtatttattcaacaggttttgaacaagattagtggattataattttggcttcaccacattttaaactgtgtgccttctctgtgcctcagttttctcctctgcaaaatggaacaatagaatccttttcattgagttattctgaggattaaatgagtgaatataggtaaagcacgtaggacatccctggcatatagcagtcaatcccttgtaaaatgttagctgcagtgggtgcaactgactgcggccagttgtcaccacctgtgacatttaccaagacaattttgggtaaaaaaggcagatttattggagaaagtacaaagataccttgcaagaaagcaatgcgcaggacaatgggctgtctaccaagaggcaggagctagagggaagttttatagggtcatactggaggggctatgtccagataagttgtgcagataaggtcctgctgctagggctatgtccagaaactaggtatttgggaacatgatgttctgtcagtcggttgtctgtgataagccatctcctctctcagaacaattgttctccccaatctggggccccttcttcattcttgcttatcttattaggactccacattaactattgttgttattatcatacacagactatctctgaaaggatatataagatatagataccagccataacctctgcaaaaagatacaaagagactagggagccggaaagcaaagatagaggagtaggcttacttttccctacatatgaatttactctattgaatattttaaaatcacctgtgttttaccatcaaaaaaataaaataaaacaagcatcaatatttacaaatgaagaactgaggttccaactttacgattgactttcctaattcaattggctatttgacttccctaatagttaagttagatttgagccagggatttgaactacaaaaaccgtgttttttctagtctaccaccttatatagagagatatgacagaggggagagatgagaggtgtgtgggtgggtgggtgagggtggaggaggtggtactggatattactgaaaaacttttgatgatattgaattctttccctgagttctgtagattttggcactggtctcttgtttcttctatttctactgtgagtaaacaaccattcccaatcctccagttctaacttgaatttcagtggactaggctgagtggatgtacaagggcaaacctgcatggggtgtagggaaatataaatagattggcactgtggaagtcagcatatgtttgcttggcacccaaccctcctatgcctttcatttgctgaatattaagcatctcatttttatctgtcctctttttgatggaatggacatgcaaatttttcaaacctacacaccctcttctttctcttggacaaagggagtaattttactatgaatccatcatgtgtcccaaggaggcaaactcaaaatttgtctgcaaaaagcctttcattcatttcttttcatgtaagaaacaaaattggcaactattttttcatagcttgtaaattccaagaaacttagtatcttttcttttcacttgctctgcagccaaaagcatattgttcagcattgcgaattcacaatactcactgctcctcagtcctggctacaacataattttgaaaagtttatgcagggaccatccgagtaataaatcacagaggaggactgctttaactgttcaccccttagctactgcctgaatgagctccatgctttatcatctcagaaggaagctgtctcaaatgcatgcttcattttattatccaattgtaacccatctagataaatttaacttcctatagatttgctgcctcttagtattcatatcttctccagacttttcattaatattatgatacttggataggagtattcccctccctttcctttataatgtaacagctttaaattgacatttggtgaatgtatcatcattgctattcaaattaggtcagtgtttttatttcattatgctggaagtcctcttagctgcgaaatcaagtttgaatgtctgttacctgaagcaatgcttctggcaaatgtttcttagaggtttttgcaagccagaaattgtcaggcacctcccccactcccacttcttatttctatgtggtttggttcatataaccatttaacatatttttataaagcggtagttgaatagagtataaaataggaaaaaattaatcatctgccctttaagaggtttctgtccactgtgtgggtgttggagagggaggtgggggaagagaggggaagggaggcagatatgcaaacaaaaatcatactatgccatggttttggtacagtcagttaatgtctaggatataatggaaacgtgggaaaaggagcctcttgacgtttactaagacttgagaatgagtttttttcttaataatctataaattgaaatccactctttctaaatgtgcctttggcactgttcttttgaattaggaaatacagaaaaacagttaaatttggttgaacgatacaggaagtactcagaaaaggcaaccatcttaccccaggagagatcaaaagacattcacagattatgttaacccaaagttttggcctcatttctcaaggaaggggctacatcttttagaccacaggcatttttccccagttttgaaactgtgaaggtgtttaggacctgagagattattaataacaggtttcaatgcctgacactcttggacttaaatgttcacctacactcaatctgatcatggacaaactacttaatctcactgagcccatgtcctcatccataaaatgagggtaataatagttccacgttttagtattgttaggatgattaaataaaataatgcatgtaagtaaaataacccagctattggaacaatcgctgctgtataataaaccatcaataattcttagcttttgctatcattcttgctactgttaattagttagtggttctcacttttttctagaaattgctctacctctgtttctcaactgagatattatagtttaagactttgattatgataactagatgataatttagatggtgtctttttttttattatactttaagttttagggtacatgtgcacattgtgcaggttagttacatatgtatacatgtgccatgctggtgtgctgcacccactaactcgtcatctagcattaggtatatctcccaatgctatccttccccccgcccccaccccaccacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgtagatggtgtcttgatcagcaatctatgctttgagtgttttttgttaagtggctaatgcagtttgcatatttgtcccactaaatctcaagttaaatgtaatcctcagtgttggaggtggggcctggtgggaggtgttagagtcatgggctgagcactcagacttgggcaccatccttgtgacagtgagtgagttctcacaaggtttggctgtttaaaagtgtgtggccatttacctatataacaaacctgcacatagtgtacatgtacccctgaacttaaaataaaagttggatatttttcaagtgggcttcatccctgggatgcaaggctggttaaacatacgcgaatcaataaatgtaacccagcatataaacagaaccaaagacaaaaaccacatgattatctcaatagatgcagaaaaggcgtttgacaaaattcaacagcccttcatgctaaaaactcaataaattaggtattgatgggacgtacctcaaaatcataagagctatctatggcaaacccacagccaatatcatactgaatgggcaaaaactggaagcattccctttgaaaactggcacaagacaaggatgtcctctctcaccactcctattcaacatggtgttggaaattctggccagggcaatcaggcaggagaaggaaataaagggtattcaattaggaaaagaggaagtcaaattgtccctgtttgcagatgacatgactgtatatctagaaagccccatcatctcagcccaaaatctccttacgctgagaggcaacttcagcaaagtctcaggatacaaaatcaatgtgcaaaaatcacaagcattcttatataccaataacagacaaacagagagccaaatcatgactgaaccactcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatctcatccccatcaagctaccaatgactttcttcacagagttggaaaaaactactttaaagttcatatggaaccaaaaaggagcccacattgccaagtccatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcttatctacaaccatctgatctttgacaaacctgagaaaaacaagcaatggggaaaggattccctatttaataaatggtgctgggaaaactggctagccatatgtagaaagctgacactggaccacttccttacaccttatacaaaaattaattcaagatggattaaagacttaaatgttagacctaaaaccataaaaactctagaagaaaacctaggcaataccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctatagaatgggagaaaatttttgcaatctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaagaaacatgaaaaaatgctcatcatcactggccatcagagaaatgcaaatcaaaaccacaatgagataccatctcacaccagttagaatggcgatcattaaaaagttaggaaacaacagatgctagagaggatgtggagaaataggaacacttttacactgttggtgggactgtaaactagttcaaccattgtagaagtcagtgtggcgattcctcagggatctagaactagaaataccatttgacccaaccatcccattactgggtatatacctaaaggattataaatcatgttgctataaagacacatgcacatgtatattttattgcagcactattcacaagagcaaagacttggaaccaagccaaatgtccaacaatgatagactggattaagaaaatgtggcacatatacaccatggaatactatgcagccataaaaaaggatgagttcatgtcctttgtagcgacatggatgaagctggaaaccatcattctcagcaaactctcacaaagacaaaaaccaaacaccgcatgttctcactcataggtgggaattgaacaatgagaacacttggacacaggaaggggaacatcacacactggggcctgttgtggggtggggggaggggggagggatagcattaggagatatagctaatgtaaatgacgagttaatgggtgcagcacaccaacatggcacatgtatacatatgtaacaaacctgcacgttgtgcacatgtaccctaaaacttaaagtataataaaaaaaaaagtaggatattttttaaaaagtgtgtggcgtcttcccccttattctctcttgctcctcctcttgtcatgaaatgcaccagctcccccttcaccttctgccatgagtaaaagatccctgaggcctctccaaaacctgagcagatgccagcatcatgtttattcagcctgcagaaccaactacacatctttaaaaaaaataaattacccagtctcaggtattcctttatagcaatgcaagaatggcctaacacagtggctttttttttcttttaagtatattttatatttagatgctactattagcagatgatttgtgcgtatgtcttgccctgttcagctttgaggagtccaggcccttatgggactccttctgagagtggggttcctattttccttaggaacccaagacagttctttcagaggatttcattgatctgttgccccatggtgctttgtggcacataatgacaaagcatgacaggcaggctcacagccctcgactcatgctagatctcggttcattctgtatccagggactccagttcatcatatcccttacccaggcctctctcctagctatgtctgtgtggctcacagatactctagagggagaggcaattaatttctttttggcggtgagatggtttgcctgggtccccactccaatcttatcttgaattgtagctcccataatgcccgaatgttgtaggagggacccagtgggaggtaattgaatcatggagatgggaattcatgttctgttgtcatgatagtaagtctcacgagatctggcggttttataaatgagagttcccttgcacatgctctcttgcctgcaaccacgtaggttatgcctttcttctccttagccttctgccatgattgtgaggcctctccagctatgtggaactgtgagtcaattaaacctctttttctttataaattacctagtctcaggtatgtctttattagcagcatgagaactgactaatgcagggggttatttcatgtcagacattgtcgtaagttgtgtcttccttggtgtcttagttttttctgtgctgctataacagaatacctgagactgggtaatttgtaaagaacagagatttatttcttatagttctagaggctgagaagtccagatcagttgggtggcatctggcaaaggctttcttgctgttttgttctatgatgaaaggtggaaaacaagagagagaacaaaaggtgtctaaatttggttttatagcagatccattccttgataaccaacaaactcccaggatgataatattaatccattcatgacggcagagcccttgtgacctagtcaccacttaatgctcccacctctcaccactgttgcattggggattaggtttccaatacatacctttatggaacacattcaaaccatagcatttggcaaataacccaaacccttctttcctcatctgataattgggaaaataatagcaactaccttgtggatactttgtgagaatcccatgcttcatgcaataaggacttaataattgtaagttgttaaattgtcatacatgctccttttagttatgaaaacctgtggcttttgtctaagagttgaatatgagaaggttcaaggactagggcttttatccttggatctctgtagcatgctgaattaatgaaaggtctgtctctctctctctgattaatcaaaaactctgactagtactagtgaaagtcaggtttgaacaattctgtgaagaatggatttggaaggaaaatatgaggcaagaattttaaaaagttgtttctgagttgaatttgatttacatttgctaactggaaaaagatcagggtataatcagtccataatattgaaagcagtttggaaataccattgcagatacaggtaatttaaaaaatctacatgaattaggtccaggagcggtggctcacgcctgtaatcccagcgctttgggaggccgaggctggtggatcacgaggtcaggagatccagaccatcctggctaacacagtgaaaccccgtctctactaagaatacaaaaaattaggcgggcgcggtggcgggcacctgtagtcccagctactcgggaggctgaggcaggagaatggcatgaacccaggaggtggaacttgcagtgagtagagatcgcgccactgcactccagcctgggcagcagagcgagactctgtctcaaaaaaaaaaaaaaaaacctacatgaattattcttcctgtgacatatttgtcattcttcatctctcctttaacattcctatcttcatccttcaggccatcctctgcctacctctttctgctgctacagtgtaagttgaatcatactttccaaaatatgtaaatgaaagtcagaagtaaggcaactcatagtgtttcagtgactttgatttcaatctcactcaagactgggagattctcctaaattctagcaaacttgtgcctctttcccagccttataagaaactgtccttctatctaaatactggaatgccactatgtgaagcttcaaatcagggtggttattctgagacaatggcagcttcttgggatgtggtgtaacatgtactaaatcattatgtgcacatacatttatttttaatcaacctgcgtttacctgagtgctgtggtttgaatgtgtcccctaaagttcatatattggagacttaatcctcaaggcaacagtgttggtgtatggggcctgataagaggtgattaggtcatgagggctctgccttcatgattgaattaatgtcattatcacaggagtgggttagttagcacgagagtggcttgttctaaaaggaagttcagccccctcttcctctcttgccctttgcctttggtcatgggatgaggcagcaaggagtcccttgccagttgtaggcccttcgaccttggacttcccaggctccagaatttcgaagaagtaaggctctgttctttgtaaattatccaggctcagatattctgttatagcagcactaatggacttagtcaccaactaaatgtaatggacaagaatggcctacattaaaaaaaaaatgtgattagaggatcttaatatcttattctgtagtgaactttagaatattttagacactggagattttctatcagatgtatcctgtggattcaataggattcattttgagaggcagctttctgaagtggaaataattctgtactccaggcacagtaattgggttcaagccccagctctgccatttactgggatggggagaaactcttggacagcctgttaggcctttttggcttccacttttcttgtctttaaaataaagttaataattttcattctgcttcactcatggcatagatgtgaggctcaaataaaaaaatattttggaaactaccctgaaaactgtagaacattctacaaatattatctaacaaaatatatgaatgcataattagtgtcttcaagggatgtcataaatatcgtaaaactaaagggtgagctgtatcaaaacttggaagggattgggatgaaaatcaaactgtctaaaatagaatggccaaatacattgggacttggctccagaaagaattaatgagaattacacagattcatatcttctccattattccattggtcacgtctaataacttgccatgaaattgcattgatttctacaaagtgattgcatatgctgttgcctcttttcaactgcacatgtcataattcatccatccagatcagtattttacttttaggaaaagagagatgctaactttttctcagaggagagtgtttagaagtctatgttctatagtccctcctagagaggggggatttcttcagtactcagcagctaatcttttttttcttctctctctttttccttttttattatactttaagttctgagatacatgtgcagaatgtgcaggtttgttatgtaggtatacatgtgccatggtggtttgctgcacccatcaacccatcatctacatgaggaatttctcctaatgctctccctcccctaacccccacactccccaacaggtcctggtgtgtgatgttcccctccctgtgtccatgttttctcattgttcaactcccacttatgagtgagaacatgtggtatttggttttctgttcttgtgttagtttgctgagaatgatgatttccagcttcatccatgtccctgcgaagtacacgaactcatccttttttatggctgcaaaatattccatggtgtatataccacattttctttatccagtctgtcatcagtaggcatttgggtttgttccaagtctttgctattgtgaacagtgctgcaataaacatacatgtgcttgtgtctttatagtaggatgatttataatcctttgggtatatacccagtaatgggactgctgggtcaaatgttatttctggttctagatccttgaagaatcgccacactgccaacaaacatatgaaaaaagctcatcatcattggtcgttagagaaatgcaaatcaaaaccacaatgagataccatctcatgccagttaggatggggatcattaaaaagtcaggaaatggccaggtgtggtggctcatgcctgtaatcccagcattttgggaggccgaggcaggcagatcatgaggtcaggagatcgagaccagcctggctaacatgatgaaaccctgtctttactaaaaatacaaaaattagctgggtgtggtggcatgcacctgtagtcccagctacttgggagtctgaggcaggagaattgcttgaacccaagaggcagaggttgcagtgagccaagatcctgccactgcactctaggctgggtgacagagtgaggctccatctcaaaaaaaaaaaaaaaaaaaaaaattcaggaaacaacaggtgctggagaggatgtggagaaataggaacgcttttatactgttggtgggagtgtaaattagtgaaaccattgtggaagtcagcaggtaatctttttacggtctgagtaatgaggaacctggctaatagttgccattctagatagcattaagggtgaagtctttgctcacagaagttggtgtatccagacagacattgtaattacagcagagcaaattaccatactctgaaagagaagaacacagaaagcaacaaacacatttaaagaagactgtcccagaaataaggagaagggcaagaaatctaagcagaatattccacttgccatttacagcatagacaaggacagcaaaatggaaagtcacttatataactgcaggataaagagatgggtgagatgaaatatactttctccgaatgaagttcactgtatgtgtagtggattaaatgagattgactatttttaaaaagcctgttacaaagaagaacaaatttaatagactattaagaggtaaagaggaacttttaaaagcacatattgattaaaacaaaagttatacactttgggaggccgaggcgggcggatcatgaggtcagaagatcgagaccatcctggctaacacggtgaaaccctggctctactaaaaatacaaaaaaattaaccgggcgtggtggcgggcgcctatagtcccagctactcgggaggctgaggcaggagaatggcgtgaacccaggaggcagagcttgcagtgagcccagattgctgccactgcactccagcctgggtgacagggcgagactgtctcaaaaaaacaaaaacaaaaacaaaagttatagttcagaatatttattgcatacaactcagcaaacaaagttgacctagatacaagagtattattggaatttgttagtgaatacattgacaaaattctgttatttttgtttaattatcactaggtccagtagggtggaagtcagaaattttgacttaaaatatcagctaattgaattagttatttcaaatcaatgtctagtttggataagaatattttataaaaaaacaaatcatagtattaggcatagtttatgcttggtggcatgtagagaaatataaaaataaaagatagtgaaatctttttaaaaattgtgttgaaaggtataatcatttgtgttaatgtattattcaaccaggatgtaggaagaacacacatgtcactgagctttgttctggggctggaaggaagtgcaaataacaatgatgataataataacagcagtagctaatatttatcagatatagagcttgttaccaccacagtaagcaatttgcatggagtatctcagttctcgtgattagtcaggtacacttcttacattggtttttcggattgagatattaaagtccttagaattgaaagaacttgctccaaatcatacagctaggaatggtagactagcgtttttactcaggcagtctcaagataacatttgttgagggtctattaacaaccaggcattgagatggtgtttacacatattagttatctcagtggttcttaacctgggatgcatgttaaacttaccaaggaagcattttaaaaccctgatgcttaggacctacaccaggtgaattaaatcagaaccttttgagacaggggcaggacttggcatcagtatttcttaaatataaacattgtatatgtaaatattatatcaataccagtatttttaaaagtatcccaggggagtcagccttttgaattactgtccatttaatattcaaagcaaagtctatacatttgtattattcctattttatttatgaggactctgagattcagtgacgataactgacttgctcgatcaaggtcacttacctggtaaattgctgagctgggatgtaaatgcagttctgtctagctaaagagcccgcattcttcttgatgcctcagtgtctagccattttacccagagcaataaattcacttgttcctgttatttagtgtttatcatagaatttagctttagcctcaatttcattttattgtcttcactattgagtactcacaaagggagccagttaacaacatctttggaacaaccatcctgtgtggagcattgtgctaattgctgtgggaaagaacaggggaagatatgaaatattccctttacaaagatatctactgttctgccagggttcataactttgggcctgtgacttgacatctgggtggcaaaagaagtctcatgaattgtttgggaagtattcatagttttcatcagattgtaacagagccatgagccaaaatatttatgaacttctgccttgcttggtatgtaaggcatttgattccagaagcagtggcatattatcttgaattttcttcataaaggcaaaacagtgccttttcaagagattttgagtttgatatactgtcaaaaactgtttacagctaagcctagtaaaagatgttgcatatgtggagtgtgtgtgtgtataaaaaaaatgcaggctgtgaggccgggcgtggtggctcacgcctgtaatcccagcactttgggaggccgagatgggcagatcatgaggtcaggagatcaaggccatcctggctaacatggtgaaaccccatctctactaaaaatacaaaaaaattagccaggcgtggtggtgggcgcctgtagtcccagctactccggaggctgagtcaggagaatggcgtgaacccgggaggcagagcttgcagtgagtggagatcatgccactgcactccccgctgggtgacagagctagactccatctcaaaaaaaaaaaaaaatgcaggctgtgaatataaaacaatgaaataaatttcattagtggctcagaaactagatctgagaacaaggatttggttgtttctggcaataaaacattattaagaaatgtgatatcatgaggtaaatatcttaaagaattgtattcatttacacacatatatgtacaaataaatttgcacacatatatacatgctatgcacatatatactatatatacacatgtatgtattatatgcatgcaccaatacatgctggcatgttttatgcaaattgatttttattccatagctatttttcctatataatccattatttttaaatgtattaataattttaatatcaccataaactgaaatgagtaaagaggcctgtaatgtgaatattcatatatggaacataatacgggggttgcgtaattataggtccatatatgtattgtatttcctgatatatttatatatgaaattgctagtatgtgtgaaagatatctacatatattttactaataagagatatattcatatatatatatacaaatatatgctttatagagcctaagtttggggtggaacaaatgttctcacccttgtttgattatgagaaccacttgcagagctttttaaaaacctgagtcccttttacccttgattcaaattcagtacatccagagcgggtcctggtgctgtttttaaaacattccttgaatggttgtgttgctttgcttgagaagcagccctgtagtttgtgtacaggtaggaatgaggaaggaagggtaccagacaacagacaggtaagacagtcaaggggaagaggccaggaaaatttctaccaggagggtggcagtttattgatttgcttatgttaaaatagttgagtccgcgctgtatctttttacttgattaatttaatttacacaaaccaaaggtcaatatcaatgattaatgtcagagggaagggtattattattatttttaaccctacttctttttcaactactacatatctgaccttgcagaggaaatcttggagagaaaatagccactttcatacgactatcccttggtcaatgcgctacttattaaactttattttcccactgaagaaagaaaatcctaccttcagggaataaaatagagattcattttctgacctcctagtataatgctaaaggaaaagcatacaatctctttggggagggagctgttaggaaggccagaggcagctgtcttggaaacatacagaaaggtgctattgggacagagcataatttaaagtaggtgagattggaaaatagggatttttccttctcttttacatttttttttcctttcttgaacatatacagttcttcagttaagtgttagcctgagattaaatataacatttatgaagctcctttcaaaactcatccctgcatgtgaatggaccatttcctcctttataccactgcactgacttctaattacatgcatctttcatgaaaatgtttgtcagactgtctgatgttaaattgcaagataattgataacaagacccatgtcttaatcatctttgttggtgctaaatacgtgtttattgaatgaatgaacaaacacttggatgaataaatagactgtaattgttagtaactccatgagacctgcacatttctttgttattggcactttgcctccctgtttctcttgagcttcatggttctatatctacatcacaggtagtctagtgtaaggttgaataacaacactcaaattaaaaagtaaaaatcttaagatgcttttggtacctaagcataatcataaaacaatggtcttgtttaatttgaggaggagataagtgatcaaacccaagaatccataaatttggcctaagtattggtatttatttccagagatgggcaaggaaagagtgttggaagaaaatacaaggtaagttttacaacctgtgagtactcagaacctggactttcatgtcttttagaaagacacattgacaataggcagaaaatccttagctacaactcactggctgaaagcttggtcagttaaattgtgaatttacatggaatccaaatgaagtgttcagacatttcaaacatctcttgcttaatgaggttctgtgcctggctagcaggtcagcagtctgatttcagtttacagatgcagtcttaaaaaaggaccctgagatcatctataacacttccctgtcttcctttgctccagctgcattcatcagcttccatcagggttcacagcaatgaaattaattgacaagaagctcaatcttaagagcactctgaactgtatactcttgccatccacccgctaactccaatcctacatgaatgaatgcaagtgtagttttttgagaaggggccatggctcaagcagtgccatatatgtgccttctatacaactggcttggtatctggtaaaatttccattgcccagttacaaactagccagtcccttgcagacctaggatcctcttagaatgccctatcaggaagttctttgcaagatgttttaactgagcaatgaatttatagaggaggacttgaataaattgtttcaaaaatgaaaccatttgaacacaaatcatgtctttcactaagacccagacaaactaactcatatgtactccacacatctcagtgtagtaagcagatggaaaatattcattgttttttttttttaccaatgagacactagtaacaaagagaaagtgtagaaattcttcaagatccctagaggctgggcaatcatatttctagcaaaactcttgactttcttcctgttctcaacctctgccattaaaataaggaaatagtgctatcaaagtaaaagagaagcatctgttggaggggttcaagggggttgagtctttaggcatcaaagctaggagttggctgggcgtggttgttcatgcctgtaatcccagcactttggaaggccaagtcaggcagatcacctgaggtcaggagttcaagaccagcctggccaaaatggtgaaaccctgtctctactaaaaatacaaaaattagtcaggcatggtggtacatgcctgtagtcccagctactcggtacactgaggcaggagaatcacttgaacctgggaagtggagttgcagtgagccaagattgtgccactgcactccagcctgggctactgagtgagactccatctcaaaaaaaaaaaaaaaaaaagaagaagaaaaaaaaaaagctgggagtttcattattcctcaaagaaggcacctcagaccaggttccatagggcacgcccctaaagagcccaaccttctcagggttctaaaatgtatcttaagcccaagcaaaatccttgactttccatttagatgccaatatgccatcctcataatattcattctcatggaattttgagttcccacactcttacatagctcccaaagccaacttattttactgctgaaaaatacttcagtacacttttattgctgacactggtttctctatacttcccccagagatattcatgttataagtaaatctttttccaaggtgtgcttcatctcctggctggaagcaagaaaaaaaatgttcaaagtattgtagcactttttacagagtgtgtatcatgaaatcaataatcatttattgagtactgactattcactgtggggccagatattgagaatattggagagcaattagatgtggtctctgactccaggggtctacaaacggcatggtggggaacaagctcattagatgaggagaaaaaataataatataagtgagtataaactcaagaactataattatgcattgattaatgaaacaaatactgaagatttactttttaaaaagcgttgtgctcaaggctatggcagatgtaagtttataatatgaccacttacattaatttgctaggtttgccctgacaaattgtgaaaaactgtggctgaaaacattggaaaatcagtttctcccagttcgggagaatagaaggccaaaatcaaggtgctgacagtgctatgctacctctgaaggctctaggggagaattcttccttgccttttcctagcttctggtggcggccatcaattctgggctttccttggcttttagcagcgtcactccagtccctgtttctgtggttgcaaggccttcttccctgtgcatatgtgtgtgtgagtgcatgtgtgcatgtgcacctgtgtgtgctcctgtctttacgtgacctgatacgaacactagtcttttatttggaacccaccctaatccaatatgacctcatttaaactaattgtatctacaacgattctatttgcaagtaatatcacattctgaggttccagggggacattgttcaacccagcacaacccttaaatatcctattgtcttgttggaggttattttatgggattcatttttggtgttccatggcttttcagaggaggctcagtgtccactgatagtctctgggaagactacgtaggcataggtccgaccattgctatattttcttatatctatgaaatcctaagttaacattttaaactacagtctactgtgtgtcaagtgttgtcctaggctcttatttacttaattcaatcttatcctcacaacagcctttgcagtatgattttttccattgtatagatgggaaactagttcagaaagtttacttacttacatgagacttataagctaggcgctgggatgctaaacaaattagttccaaagtctactattcaggctgaacttatgcatttctggtggtgaaagcacagcctacataaccattagtttgtgatttagaccttagcccaaacattcgtcattatcatatttgaagccaggatggacccattgttccagatctatatactgtatatcagttagccatatcaattaataatcttttgatacttgtcaaagagcagagaaccgcagaaattaagagtttattctcttcattaaaccattaaagattggaggtggctattgtgaattgggcatgaattatagcataagcctatatatgttgcatatagccccccgtaacaagcctccttgttgtcttttgtgttcctaacttatgagcagggcagagattatcactgaacacattgcagggtaaatgtaggactctgagtcacccattggatttttacaggctgaaacatttacagtgtcctgcttacaattctcaagcatcagttaggtgcaggaacacacaggcagagtcagtagctgcccagggaactagtgtccagtctaatctcttcacaaactttgtgcgtgattcaggaaggattattacaggccaaattttacccatggacctgttttgtttagtaaaatattttcaaaaataaattttggatttgaatgactttagggaaggcaggaatgatctaggctctcacaagccttagtcattacccctggcctgaattacatatttatgtgagccctctagtccctggaagcagttctgtttgtcaccctgtacttagaaaagtggaaattaatgtatggttcctggacaggcagcaccagcatcaccagggaactttttagaagtgcaaatcctctagtcccacaccagacttactgactcagaaactctgacgtggggcctgtaatctgtgttttaacaagccttctggttgattctgatgtgcattgtcctaggagaaccactgacttagagataagttaagaaactcttcctttcttgaagaatagcgtcttctgctttctaataatgaacttttctgtaatgcctcaagatctacaaagatgtcttattttgcttccagagtcacgtgagaaaacagtaacaatttgagggaggtgttgctctttcagctttatccagagatgtgcggtggcttgttccaggtgttatatgacaggacaatggacctcaaactcaagattctttttcctctacacttcactactttaactctcctgattattttgtggactgatgaataagtacgtgtaaactgattttagttttcctggtaatgaaaaaaaaaaaaaacaatgagtattgttactcttgtaataatcacatcattttttgtctttctttctttttctcattttatttttagacagggtcttgctctgtcacccaggctggagtgcagtggcatgatcacagctcactgaagcttcgaattcccgggtttaagcagtcctcccacctcagcttaccaaggagctaggactacaggcatgtgctgcaacacctggctattttaattttttattttatttttttttatttttgtagagacagggtctccctgtgttgctcaggctggcctagaactccctgggctcaagtgatcctcccaccttggcctcccaaagtgctgggattacaggcgtgagccacttcacccagcctttttttctgtgtctaaaattcagttactctctcattcacttaacagtttagaaaatactaactatacaacatgtactacgctagatgattttttaacttaaaaatgtgcaatgcacatgcatattcataataaaaatccatctttctaactcctgagaggtaagcaaaaacttattttactgctgtaaaaatcacataattggggacaaaaacttgcatgtaatatattttctatgagactgtattgactttgagagtggttagagttaatggtttgaattagcataagtaaaattaatgatattgtaggtcttaaatgtaaatgcaattttacaccaggcccagaagaaattcccctcacctaccttaattggtcagatgaaaatatttggaagaaatacctcattcaattttttaaaagcatattggctacttgccaccattgaagaattagatctcaaactaaagggattgtcgggatgggcttaaacagccttttgatttgttcattaattcatcaattcaacctctcacaaaacaattgtatgttgaatgactgctaggtgctgtgtgctatgctaggtgctgctgatacagttatgagcaagacagactcagaatcttataaatctttttgtacaaaagacaaacaattatttcagtgagttgattaaatttaatattaatatttaataaagcagaagtaattatacctgcaaaggaaaaataaagtgtgtttttagcacctataatttgaggactgtgggatggtagggttatctgaaaagagataaataatttgttgtatatttgtttcttttggggggtgaatgccatgtgccatgatgtgggaattaattggaaaaccataggctatgggagtcagaagagacattagaggctctaatatctgtcccacttttctctaatttagaaatctggaggctgggacccagaaaaggtaaaatgaattaccccaaagccacacttagtgaatgaaagatgtgtgaacggacatatgcatgggcctccttaatcctatgctagggatgaggacatgcctttcccaaaaataggtgaaattaccatatgataaagaacatttttagatattgggagtagggtagggtacaaggctttggaacagcaaagttaatcagctcagtagggggaaggaaaaaggaagagagaaagagcaggacctccagtggaacaagagtctgtggactctgtcaccctgttactccctcttaatcactcagatgatttgctttttctgcttctatttcaaaataagctgctaaaactgagatgcagtgcagtgaaagcacatcatgatctatgttctcatttttgcatggagggagtgagtaaagacctcctacttaggtagtcatcttgctgtccctgcatgtagactaaggctgtgagagagaacttggtgctttataaggcattccctgtgctggtataaatttgacccttgcatgtgagtgatggtgagggacatctctgagaattgttcctggtacaacatgtgtggatttcaacatgggtactgcatgctggagagatcttgatatgacccaaaagcaagaccagaggcaagcttgacacgatggagcaaagggtggaaaggtagaaaatagaatgaaaaatttttctttgctgtcacctcctcgattttattcaaatcttaacccaaacaactagattgcattactgggctcttaaaagttttgttggaaaagtgctgctaaagaataggaagacaatctaggcaatgccattcaggccataggcacggacaaagagttcatgaggcagacaccaaaagcgattacaacagcagcaaacactgacaaatgagatctaattaaactaaagagcttttgcacagcaaaagaaactatcaacagagtaaagagacaacctacacaacgggagagaatgtttgcacactgagcatccaacaaacgtctaacacccagcctctataaggaacttcaacaaatttacaagagtaggatctcataggtttatttacaataataattcaaatgtttcagatttgtaattgtcctttgaaaccattgctttcctttaattccagctataccaaagactctttggaatgggtaaattatttctacttgatagactaggaaagtgagtcacaaaaaggctcgcccagagctactggttattagttgtgtgtttttctctcctattccacactcgagaaaaccccgaagaatagggggtggttaatggtaaaaagaaatctagaagaagagttctggaaatgaaagacagctaggttttgagtttctctaagaaaaggtagggggcaatggatttaaactaggggcatacactgcgattaaatatcgaaagaaacacactgagatttaaaaatgtataaagggcttatgggaacgaagaactaaaaagaaaatatgaggcaagaacatagggtggcgacagaacaaggctgtgagacgtgtgcttggtttgtttaggctttaaaacttgtcaaagtttaccgttttctctttcaagagggatgaaagaaaggatggtgcttcccttagtttgtttgctttcttctttcatgtatctgccctggcagatatgcatacatgtgcaggcccgtgtgttcgtgcacacatatgcacacagataaagtgggaacagagagaagccagtgggtggtggtgagagatgggggcagaattgatgcatcagggggcctaaatccatgcaatgatcaagttcatagcaatttccccaggagactgtatcatattccagtgaaggggagtacggcaggaggttgccatggcaacaaaaggcctgaaatattaactctgactagcaacaggccagtgaaacagcctagctaggatttatggcacattatagtgtgaaaagcaggagaaaattactgtaaaggcaggaattatagcacaacagaacatataaactcccaaatccgtcttcctaattaaaacagcatgctcggaggtagagcacatagtaaggccattagcttaaatggggatgtgctatcatcgctttgttatcaagtttaatgtccttaagactaactgtgtgcactgggagagtgagagcaagggtaagatagtctggagacagatggaagcaagactcttgggcacttgaattcttctcaaactcattcttggtgacataaggtttcttcagatactagtctctgatcccacaggagattctagaagatgccttgatccttctatttgtaaataaatcatcacttctcaggcatgaaggctgagagactgataccacagtcaatccctctggaacccaccaggaagagaggagcaactaatcaatgaggtttattgttgaggaaaaaggatcttggatctcccgactccctagaggggaaaataactcccttgttgtcacagacccaaactttcttttatgtcttagtcaacagcctgcccctaagtgtttgaatttgcaatgcctggaggaagtcttccatgtaattcatactttatgagggaacctttgtcttcttgtgattcttattagaaactcccaatttctcgaactctaatccaggaccttagtactcagtctggagatgggtcagggaaaatgagaaaaccattattttacaagggttcattgttcatcctttattctgccagccattcaacaagtatttaatgaataccttctacattctagtaaatgctgggaacatgtccatgaacattaaacaaacgcacaaataattacttaataaacagttaaatatacaaaagaaagtacagaatgttttgaaaattatgaaaattcttcccatagcactatctttatttccctatcaccatagttgccaaagtgcccccacctgacattcttttaggtttgccagatgaccaagccctacattcccacagctatgtcagcaacatactcaagatcatcctttagacattgcattcccctcccctcccctcccatcctctcccctcctctcccctcttctcccctcctctcctctcctctcctcctctctttcttgagacagggtcttgctctgtcacccaggctgcagtacagtgattcaatcctggctcactccaacttctgcctcctgggctcagatccttccacctcagcctcctgagtagctgggatcacagttgcatgccacagtgcctggctaatttttttttctcttttgtagagatggggtttcaccatgttgcccagctggtctagatctcctaggctcaagcaattcaccctcctcggcctcttaaagtgctgggattacaggcatcagccactacttctggcctgtgtttttcttttttaaagataagacctaaagaggattttgactattttgaaaatatattcatatctgtgtatttttggttattcacttccaggtcctaaagttgcaattaaggagaaaaaaatcattgattattcttagtagttttgatgaggtaatgcaaggtttttctgtagcaaagtcagcatgcgtcgtgaatatggttaagctatgtatgattaaaggattatttatgttttatttataagtatttgctatcaataacagctcccaaaagtaagattcaccagtattactacagcatatgggacttttgctgtagattaataatgccatgatattttctttaatgaaggtggaaatgattgctttattttaacaaagggacctctatggtccccctgagtttgagccttgaatgtagacgatcagggatgctatatcacagctgtctccctgctgataatgactctccttggggtttcataatttctgcctgaaatcctttggtttcctctcaggaggcatggagtgaatttatagggagattcttcaatccagacacaaaaaaaggttttaaaattttttgtgtgtctccatatttgactttctgtctcccattctcatttcctttactttcatgtgtgtgttttcttcttactgtgccaaacacataataaatgctcagtatttgagattaatagatataatcattattattttgtgttattctttctactcctcccttataaaaaaagggattcctcccttcatcatgcttcccatgccttcatatacttcttattggtttgcagaacaggcatagttatgatggagaaagtaaagaataatgattaaaaagaataataacaaaccacataactaactgtttgggtttaaatgacagaactctcaaatccatcttcctaattaaaacagcatgctcagggatagagcacatagtaaggcttttagcttaaatggggatgtgctatcagtgctttgatatcaagtttaatgtccttaagattagctgtatgtgccttgggagagtgagatcaagggtaagatagtctggagacagatggaagcaagattcttgggcagttgaatccttctcaaactcattcttggtgagtactgtcactttctaggtgtgccttaggcaagttatttaactgcttcgtgccccagagagtggtgggggaatcaagggtaggacacatgtgagtcactcagaacagtgcctagtctttagtgaatggaacttcgggtgttcattattgttgatattgcaggtgtaaagaatttgattcacacactcctatcatggattggagggaagttgaatattggttcatatcttgttttaggttctggtttacttgctgcctgaactaggaatataattcgggatttgcagctagtaagttgaaattaagaagaactcaggcctttagattaatcaagtacatatacagtattgaaattatgtctttttatcagtatctttccagaggcccagttaggggagctcctggcatgtgcccggcatgtaaggagtgtccacaagtgtttgcagacctgcactgaacactatttctcttttgatatgatgcagtttaacatactcaaaagagttgagccttatcccctttgctcctcaaaaccaaacacagccagttttggattaacttttattcagtcatgttttatgctgtagggtccaacctaaattttctaggacgcagcccaactaactgaattctttatgtcacttgaaggataacgtcactacagttaattttgataataacatggtttgaaggattcctaactgcttgcaatttatgtaatattctcagtgctctgtgaatttgtagtctgatgaaaacactgaaaagggaggtaatgtttactatttctgattattattctgtatccctcatgcagacctaacctcaagcatttgcagccacccaatgactttttttgaaggaatttttactagtgggttcatctggggcagatgaaaatgtttgcattttagacactccaaatacagatataaaaactttatgtctcctcctccagctctaccttcaactttcttttcactttctttcctactaagagcacatatttccaggctcattcttcatccctaaactctgtccctctccttactcctttgttccgtcttttgtcctctccctggaatttctggtcatttgcattaactacacttataagtcaaactttctttgttcctttgtgggtgtactcagaacatcattacattcaagtaaattcatgtgttttttttctttttttgcccttttatttaaaagcactcctactggccattagaatagttaccagaaatctcctttggtctatggataagaaattctgcagaacttttcaaccaagtaattagatcatattatgtctaaactggtgcctttttctcaactgaatccaagtaggagtatagactgttaacaccttcaactgagtaaactgcaatctttgcaaagtgaattaatatatgaatgcttgctaaggcaagataacacatttttcaattaacaaagtaacaggagctcagggtagcatgtgatatatatatatattctgctacatacatatgcaggtatatttttcaatcaacaaaacaggagctcagggtagcagactacagatatacatgtgtgtatatgtgtatatatatatgtagcatactacatatgtatacatgtgcacatgtacatatttatctgtgtatatgtatacattatgtatatacatatataggtatatgtatacatatatgcatatgtaggtatatgtatacatatacatatataggaatcctatatatgtagtctgctacacatatatattcacatatatatacatgtatatatgtagtctgttgtcctgagctcctgttgtttgtcaattgaaaaatgtgttaccctgtcttagcaagtgtgtgtgtgtgtgtgtgtctatatatatatatatatatatatatatcctcaaaattttacctagagtaaaaaaatgaaatgcctacattacataaagacccatatgacaatattaattctgtgagctgagacatattcatgccaattctccataccttctcccccattgcccattctccagccctttgttgttcactggtcctaactctgctttcttactacaatggcccacttactgcatccttagtttttgacattttgaaatcacaaggttctcatattaagcatggacattttctttacttttttattaattacaaccacagaacttctctcgtcccactccttcttgttttgtctttgggtaaaaggaataaattatatatttatcataaattttaactctacaaaatggccatatttatactttcttcagatttctctcagttctagttaaggtttttttttggcttccatttgccccttatttgattattatactccaagtggctgaagaaaaaatacattcaatataatctgtctgtaattttcatgtcttcctcattaccgtaaaatataatgcttatttgagacacacacacacgcacacacacacgtgcatactcttggcctagatcaaccacacagattcatttattttaccttctcattaattagaccctcaagcctcttaatgttgttttaacactaatttgttgagttctttctggcaccaaactaccccaaactccatgaagaactgaatcatcaatgtattatttataggggcttctttcgtgtgttcgtttaaaatgtagttatctaattaatttattaatttatattgtcaataactattcccagaaggttttttttttttcagatctactagagaacttaaagctttttcttttccaggaatggccaaaatatccagaaggacaatatcaagtaataattaaagttataagctcttggtttgaattcttgctccactagttatgtgaccttgagcaaattacttaacttctctgtgccttacttttgccatttgtgaagtggaaactaaatagcctttatgtcccagtaacaatgcaaagtttattcattgccgattagaaggggcacactgttcaagatgctcattaattcattcactcattttatgtaatgactcatttatcaatcctttgttgagtctcaaccactgtcctaggtaatgctgatacaatcttatgttttgaagctcgccacaaaatttgatcaccactagagccaagatttaacacattatttcatttaatagctattttgagtcttcagggtacaatttacagttttgggggggaagatgtagggaaatatgactcgtcagactcaattaagtgcatttactcagggctacccatctattaagtggcatggttctctaaccccatagttcattctctttttctgtgcaccactagtaggttttgcataaggtaattttgtccaagtggttactgtgtgggtcctgttcacaatcttgatcatgattgtattccaacttctatgtcagagtttgcaagcatgtggcttataaactcaagatggctggtacaatgttgttcaatatttaatggaggggtattaccaagatctagttttctaggttttcttgagaaattagaaaatctggcaacactaagtttgtaataataccagggacaactagccaaactgccctattttgttgaatcatgtgctgtctaagtcctcacagtccttgccacccccaaccctgcaatcatcctacatgtagtgtttctatttatcattgtatttttgcttttatatctcttacatcttgtcacattgtatagcctgtctagcatttgaatttttgactcctgttttaagctagagatatgcttgtcactgaacacgacttgaataaggaaatgagtaataattatgactctacatgccctttatagtacacaaagaactttttaaacaaccatgttatactgctactttgattttacagtagtttgctccaaatgagtcaaatggtatgtagtagagtcataattagaatccagaacaattggtgtaagtctagtgcttttctcatttatctgtcattcattcatttattgacatatttattcaacaagtaaacaattataagtaaatgtcaaatatattctagaccgtatagtggatgctagagatatagatgtgactaagatacagtcccaggctttaagaagctcatagtctatttaggaatgacagataaacggatttttctgagtgcattgtgatgtgaactgagaaatacacagggtatgtacaaggtgccatgttaacatcaaatggcatgtgattgattttatctgtgactcagacatacctctgccactgtagggagtagtataattgacatgggatcctggccagtctccttatggtgatggtggttaatctacatgtccctgagtatcatggtctttacagaagcaggagagtgaaatgtaaaaagtgctggaatggaaatcagggcaccaagtatatatggtcctggctctgacatttgcttgctccttgacgttagaaaaatcgttgaatttatgtgtgcctaaatatcttcaccaaaaaataaggaggcataagaggggagataccagatcttacaaaataagtaggttttatttacaaatacttatggattagtgggggccctttcactaggctacaaagaatttgaggctctatctatgcttagttttaaagaatgctatggtcaaagaagctatgtttgtcataggcactagaggaagggatagaaagattctgagatctaggggcaaaagggattttgagagtgcaagtgaattaaaaagctaggatcagctggctcagtggctcacgcctgtaatcccagcactttgggaggctgaggtgggtggatcatttgagttcaggagtttgagaccagcctggccaacatgatgaaaccccatctactaaaaaaaaaatacaaaaaagtagccaggggtggtgacctgtaatcccaatcccagctactagggaggctaaggcaatagaatcgcttgaacccaggtggcggaggttgtaatgagccgagatcacaccactgcactccagcctgggtgacagagcaagactctgtctcaaaaaaaaaaaaaaaaaaaaaaaaaggctgagatcaagtttctgctgcaaggacattttcattagttaaaataagaaggggctaataccaataaaatgcatagcaagttgactattcaaaccaaaaggcctccagttgaagttgtgttttaatttaagcactagtagggcccagcaaatcaaatattgaaagatgctaaaattagtctgattactttgtgagtcatcaaattgatttgactgtccttgcccttcatataatgtcccaatagacacttaacctgactctacttccttgaatttggcaaagtaagcacgatcattggagttactgcttttgggattatttatttatcacatcacctctgccatcattacttcccactcgtctttgtttggcttactttctactgtgcttctctctatcaaatctttgcacctccttaggaagatctggaagtcacctctctgtaaatctgagaagttattttcattgttgttggatgataatgcttaagccagtgttggaggctgcacaagtaaattacatggttttagaagcacctcctccttccatctgtgctgtttggttgtattctttattggatctgggatgatatgacttctttgcctggggctgttgctgccattacgcagttttggattcactgttgcttcataccaatgttggtgctgtaaatgtacatgataagagttccacagtgagatggactacaagacttctggacccagagccccctaaaactagatccaagaccagattatgcactgctactgaggttggcctgctatggtacagactgctcctccttccccaaggatacaggcacttttacatagagggtacaacagatcttgacctgcaggtgttcaaaaatcgactcataacttccctcctcttatatctatcttatcagtaaacaaatattaataagtcataggaatgaaacatgcgactctttttggttttgttggagtgatcatgccagaactgggactttctaatcttgaattcaaatcatgagagttaagcctgtcatgaactgtgagtgcaagctgacccaggaaccatgtggttctcaaaaaaaaaaaaaaaaaaaaaagcttatggctctttttgtgccacaatggcagaattgagtcattgctacaggcagtgcatggcctgcaaaacctgtgatattattctctgctctgatattaacatagctggaatgtgccccaaatgtatttcaatcaagagctttcatgtattttttgaaataacctggataagaaaatccagattttagactcaccattctgcgggggagtgggggcggcagggggtcattgatcctgtttgttttctctcttgcatgctgtccttggagatcagaggattgatgtttgagtaagaaatgcagaataggaccatatgttaggcagggttatagacagtaaagcaggtcagcatcctataacttgatgactcaatcatcctaacattatgccatctgggcgctgatactgttcagctctcccttttcttatgaaaagtttgactcaggtcaaatagggtgtctttttttgtttccttagaattttgttttctcttccttttagggattagttcttttagtcccacctttgagataaattttataatttcaaattttgaattctgatctaaaccctcaactgttctttctcccacagtaaagaagttaaagcaatcgtagcaaaaaatgtagagagtatttctttccccatccccaactttactgagatataattgacgaataatatcatatgtattcagggagtacaacataatgtttgatgtatatatacattgtaaaatgattaccacaatcaagctaattaacatatccatcacctcacatagctaccgtgtgtgtgtgtttgtgtgtgttaagaatatttcaggttcactcttagcacattttaagtatacaatacattatcattaactgtagtctccatactctatattaggtctccagaatgtattcatcttataacctaagtttgtactatttgacccacacctccccatttcccctatttcctgacccctggtaaccacacttctactctctgtttctatacattcaacttttttagattcaatatataagtgagatcatgcagtatttgtatttctgtttctagattattttactctgcataatgtcctctaggtttatccatgtttttgcaaatatcagaatacccttctttgtcacaggatgaataatatttctatatatatgtgtgtttatacatgcatacatatctctctcacacattttctttgtccattcatctgcacggacactcaggttgatataatgtcttggcttttgtgaataatgctgcaatgaatgtaagagtgcagatatctattcaaggtactgatttcacattttttggatacataattggtcctccatatccatggattttacatttatgaattcaaccaactgtggatcaaaaatatttgaaaaaaatgtgtctgtactaaacatgtacagtttttttcttgtcattattccctaaacgatacagtgtaacaactatttacttagcatttacattgtattaggaacttaagtatcttaaagatgatttaaagtatatggaaagatatgcttaggttttatgcaaatctgatgtcatttcatgggagggtcttgaacatctgaagatttttgtgtctgtgggaggtcctgaaaccaacccctgtggatactgaaggataactgttactcaaaagagggattgctggatcatataaagttattttcttaatgcattcatgtatgcactagtgtgtgtatgcctctatacacccatgcctgtcactctatgacctgttgtcatatctgtacattcatgtaacaatcgccatgtttaagaaatgtagcattgagcctatgtcttaactgatgtatcctgtttcaatctatcttgaagtggccaatcaccctatccccaaagatactgctactcaaagcatggtccctgaaccatctaggaacttattacaaatgcagaaccagagaactcatgcctgatatactgaattggaatctgcatttaacagatttcttggtgactcatatacatgttaaaggttgtgaacactgttctaagaaatgtcttcacttcttattcctttggcttgcagtgattaattgggtagaggaggcagcatatcagaatcattatgaagcttaaaataaagtgtgcctgggttttagacccaagattaaatctgaagcgaaaccaaatgtctgtattttttaatgattccaaaggcaatcctgatgtacccaacacagggcaagggtatatattgcaaggagtcacagaatctttttattcttttcttttaaacctcctggcaaccttctcttttgctgcctggtcaacaaagattatctaatgtggttgatcagcttttcactgtcccgttcattcttatgacaatttgccctaactatgcacaaactgagaactctttttaagggtaaataaatgttctcattcatcctcacaattgatttaaaatattgtaacattttctaaatatgtacaaacagaaagctatctcatagttcttgtatgaccagaaagttattgaaattttacaaatcaaatgcaaacaataccatgtaaatgaagaacattaacgtggcagatgacattttcctgagaataaagctctacttgcaacataaatacaacacaattgctatattttaggttctttagaatttggcacattttactgctgtatgccttgtgatttctcagttctgttattatttgtctctgtttgaacccatgcaaaaccttcatccacacagcttagactgtcattcagccctctctttctgcaaataaatctaatatatgtctatagtcagcccacttttcttctatgcagatttcattaatgaaagtagtaattcttgtcagtgtgattgcaagcacaaactcaaagataacattacatggcagtccttggttggcaattgaatggtcagtattcagttgaaaggtcatcaaccagaaatatggttagccattttttagaagaaaacaaattagaaaaaagtatggataacaactttggacaccaaagaatatttctataatatttcctgctcagtctgtagtggaaggcagtagagaatagaacttacaaacatagccttggagtgagaaagatctggaaactatttatgatagttctacttactagatgcatctcttggaacaagattcttcgcttctctgtaacttggtttcctcgtgtgtatgatggagatgattattatctatttcataggccaggaataggtatgatatgcaagaagcacctgtggccctatcttagcacatcataaggactaagttatcaggagctattttaactattataatgatgttatcattgttgcatctttattataaatgtgaacattaagtttttattaattaaacctgccacatatttcttccatttgcttcattgtactcttaagatgtttattcatttttctcacttcttgctttaagaacctggttattacagaggtgaaaaatcccatcaaaatgctagagaatttggcacaattattgcttatatttctcctattgctgcttttactgctgtagctgcctcctgaactgctgctgctgctaccatggcttctagatgcttctttgacaatttatttattttccagtggaacccatctgtgaagaagcccttcatagcagtaatatcctggggctgggcactactacaataatgatgctttcgttaatcaccccatgtaattttagtttttgctgataaatactacaataaatcgattgaaactgatgaaaatagctcaaaatttagagacatacagtatttcattttaccatcagcgtatttctatgtttatgcaatagggattgaaaaagttcaatccccatgctcaaaaacacatacttccagctctctgagatgatatgccagacagggcttttgattagaagccttatttttttgcctagttctagcttctgtatgagtggagactttattaacaaaggtaggtttggagcactcaacagaagcgtagagaatatatggaaaaaaaaaaagaagaagaaaaaagataaaagggaaccaaacaaaacaggtttacaactgttttactaataagagggaaaagtctgctcatgagttaaaccaagactaaagataaagaaagaaagaacatccaaaaccttcatgtgctttgtatttgtacatttctgacatatgcatgaagcatgagggaaatacagtaatacactgaggtatgctgccaacatcctgactattcctagtcattagatagcctagtgatgtttttcagttagaggggtgctgaccttactgttttcagtaattataagtctataattaccttttatattctttaagtgtatttttgtaatttcaggttaggtatacaagagtggaaaccgtgtttgatctgacgttttggctcttgtatgaggcagctttaaatagctgtcagatttggtttcattttagtgaagggttaagtaattttaaggcgttaaaaccatgggcaataaataaccatccacagtcatcgaaggaagttgcttcttagacaagagaatgaagctagagctgctagggacattagtctgataaaaagtcacatcagagaaggtttacctccaaatgattttggtggcaaagaagcctgtgcatcaacacctgcccttgagcacagcagtcaataaaaataaggtaacacaaagcagctctcttgaaaacaaaatcagagcctatactcttaagaagttcatagccgtcacaaaaggaccctcgtggcagtagaagctaaatggccaagaatgctggaaatggggctgcaagtcataaatggagaaagtctaaactaagagggtaaacagcaggtgacagtaaattggagcacttggccaggcaagccctgcatctgccacagtgagatcagttactggagagtcatcccaggcctatttcacactgccgtctgggaatgtgggactctaggttcttaagtgttaactatgggcaaaaaagaaacaagaagtataaagtcattgagaagattgtctgcagtagggcaggcatggatgaaaatcgaactctactttgtctgtgggtgaattatttaccttctatctgtcctgggtctgtaaaacagttataagaatagacagggttaatttgtgaaacttagatgaatatgaagtatgagtaaagtaccagacatttagaaatgctcatcaacatcttgaaagaagttctttcattgagataaaaagggtctttgtatctctttctgtaattcttctgaaaacagatggtcagggtagagagctggtgcaatagctcaaatggtaaatgacagacataagattcaaaagaagctcaataggaagaatgatcctaagacaaaatggatgaattgcaatagggttacataaaccatttccttaggtttagaaaagtcgttattccatttctaggtaggagagattccactgaaataatgtttctgtgctaaaaatgcaaaagccaatttataacttttaaaattataaattgaataagtgcaaagagtgtgatatggctgctagatattggtagaaaaccatccttctcatttgtgcccttattagatgtcatcaagagtcttgtgtgcctcctgctgccacatttaaagaggggagagagagagagaaagggaggggagagaaggatgaaagagagagagaaagacagaaagtgaggcatgtccagtatggtgaaatcagctgtaatcaattccagctcaaccactatgagtccttggacaagttacctcattgacaaaatgaggatggaagctccctccctggcttgacctaaggattggattacataatgcaagtaaacaactctgcacagtacctggctcataactgggagctctgattattcacaggaaagagtggtgagagacagctatgagataaggagctgcagaagctctcggtgatctgccaatataagagaagcttaaggcaggacatgacaactgtcatcaattatttagatacctgttatgtagagaagcaattctcattaatcagcctaactctaaaggaaagaaccaggaccagtagatagaagttatgggaagagatattttggctccataacagaagtaatgaaagcagtagtggtgtagtagtaggaactgagaatgcaaatagctcttggagtgttccagttcctgttctaaggactctgcattcttatttgatcctcagaacatctatgtgaggtaggtataattattattattttcattttacagatgaagaaactgaggtacacagtgaagtaaatttccaagaacatgtaaaatagaaatgaatgacagagctggaatttgagcccaggcattctgtctcttaacccatttatgctggaggttgtgattttttaaactgatgtatgacagaaaaatcagaccttggcaaatatcttgagcagtaggctataaataactcccacatgcttagtgttccaataatggaacactaggcataagtggctacacacattatctcaactgccccaaaaagtagctcaaatacacagggaaaggctgagtgactgtacaccatggttgctagtaaggggattcctgcactgagttaggaattggcctggataatctctacggtccctcccatgacatgtctgtcattttataaaaccaaaaagcaagcaaaaaacacatggtggcaaaagctaatacaaaacctagagtcaaacattcatgaggttttctcaatgcaaaagaagcctaaaatattcacctgtaatctatttatatcaaccttatactcagttataaaaggatggccatcttattgtcttgttcaaggcagagcagaagaaatacatttgaatctgggagtggtagtagaactaatagcagcaaggagagactcatgaatctttaggagaaaaaggaggtgttaacgcactgaacaaatattaactgagtgcctcttctgggctgagataagaaaatcattgtgaaaccaaataagaacaagcattgcaggccccagatatttagagactccagtgacgtttgggcttttcctgaactttagtgtgcaatgtcattttaaaaagtattttaggggaaatgataaattatagccagtttcataaaagaggtatacattatatttttaaaagactttatatgaactgaatcatttgactttaagtttgggtgtaaaaagggtatacttcaatttctctcaggccagcttgctccccagtaaatgacaaatatgggtctcgccgcactaagatattttaatatacttcagtgggaaaggctctgatccagaaatttgcagttgtgctattgataaaatttatgagaaactttcttctgtgggcctcagttttcacatctattaaatgtgctgatttaactaaactatctttatttcctttaggctcagacatttcctatttcttttatttctataactgtacttattttcattatgtagataccagatggcaaaatgtcctggtagtgtgtgcaggactcaaactgattctgggaaaatggggcacaagtgaattctaaggtataaggagctgaagtgagcagaagcctctagaatctatttctatttctgtcagctacagaatgtaggcccagtttaatattaggagacgttgtctagcttttaatattaggtttcagagttgcctaacaaaacccatagaggttgtttcttgcttagagtaatttaatgttataaggatcaggcaggtgcaacatggcataaaagtattacttgccccaatgccacctttaatttctctcaatctttcaaagcatcaaaagaaaaaaaagttctctctttgtctattgtttataaatataatttattctctgtgcttaggtgattttcatagataagaggacattcattgtattcagtaaaacttctagagcagtccttacactagtaacaagtttcctgggcaatactgctttgttatcagacttcaccatgtagatctcacatccttctcttttctgatcttgctcttatcatttcaaagttacatgtagagtgaggatgcaggtttcatagggtttttgtttttatctgagacagagtcttgctttgtcacccaggctggaatgcagtagtgtgagcatggctcactgtagcctcgacattctgggctcaagtgatctcctgcctcagcctcccaagtagctgggaccacagatacatgccaccacccccagcaattttttttttgtcttttttgtagagatggaggtctcaccatgttgcctaggctgggcttgaactcctgggctcaagcattcctccctcctcagcctcccaaagtgtaggattacaggcatgagccaccaggcccagcccatggtgttttctgacaaagctactccattcatttgctgtttgaagttgattagtgaaccacattttgatgttcactaccttcatttgcttttatattcaactgcattctttaagaatcttccctcagcagttagaaggccaaagataatttaaatgggattgagggatatttccctctcacattagtgctgtagagccacataagaaggtattctatggtagaaatagatttagaaaggtcaaatttgaaaaataaagtaagtccagacccgagtgataagatggatggctgtctagattgagcatgcaattctaatacttcagttccacattcttttttttttttttttttttgagacggaatcttgctctgtcacccaggctggaatgcagtggcacaatctcggctcactgcaacctccgcctcccaggttcaagcaattctcctgcctcagcctcccgagtagctgggactacaggcgccctccaccatgcccggctaatttttgtatttttagtagagacggggtttcaccatattggccaggctggtctcgaactcctgatcttgtgatccacccgccttggcctctcaaagtgctgggattacaggcatgggtcaccgcgcccggcctagtcacacattcttaaagatgtttcagcttttgatttttaaacagaatggtatggagaagggcttttgctggaggtgcttcagtcagttagcttcaactctgaatgaacaccgaagatgtcttggctttcctaaagactcaggctacagattcttgctcatggccaggggtaaaatgcccttcatccaatttaatgctctcccatgtgtagcaaacatatcaactactctgggttggcatatgggggttttagtaaaactgtgtaaagaatttgccatagaaataggaatagtctttcactttccattttgtactctgggtcttctctgattatatatctcttttggttttcctttccaagctccatctttatcccaacctattgggtatacatctgatcactgctttgctaacacgataatacttgagactaattaacaataccttagtgatactgcattctcaaataggaaaatttcaaatgactagaagaagactagttgatgcctaggaccagtactagaatggttaagttactggttggaaacttcagtgtgcttgtttctgcaggaggagaactgctttaatgtgaattgcattagaaagctcccctccacttttccttccccagtgtttgtctactgaatagcagggtgaaagcgtcggttgctctcatcgcctcacaatcaggccaattgggcataactgctttctggtagaattcatctcataataaattgcattcatggaagatgcctagtatgtggtaaacatggcatggacaggccaatactagagaaagatagaacactggctcagaggagacacaaacaaattgcctttctgctggctctgaaatattctttttcagtgtagttaaatataaagttgaaatgatgctaactacaccttgatccaaacaacctcttcattgcttggcttctgatgggaatgctgtaggtagccatttgttttaatgattgatttcactaatactgagtcacaattgcactcctcttgaagttgacataagatctccatgcacagaaaatgaattcattagaatcaaagtgattgtataagaaactcaaattatccaggtgttgaaatgcatgtctactttcttttcagacaatggaatcatttataaaacatatagttatttaaaacacagacacacatacagagactatcatatgggattgtgagagattgctaattaacacatacaaattaagacaaatattcattaaaacaaatattaattcctcaaagtttaattcttaacaaatattaattctacaaagagctaaaaggctctatgtaggtagataacggcattcagatttacctcctaatctttacagtaattggttttaagggttggagaaagaagtaaaggaggtaaaagaatgtacatagacaataataattatgaataacatttactaagcatctactatgtgttaggtactttgctaaccaagcttagcatttcacatatattatttaaaattcacattaactacctgaattacattcaattattttactcttcagggagatttgtataagttgtgtaaggtctaaaactgttaacaggaaagctgggagttgaactcaagtttctctagttcctgagccaagatcttagttgctaagttattaccacattctcagagcctctgaagcaataccactgaattcagggcttatgtttattctagcagcatctttctttacaaaggggtatgtaaaaatagtagtccttctaatttctcctccctccccccaatatttctgggattatgcaggcgatactttgcttttggaaagaatgaaatataggcaattgacagaggcagggtcctgactttcttttttaattttttttccttgatgatgagcataatcatgtgaataattaagcttcaagagctaaatgactgattggcagcaagctgactaactgttctttatttataaggatatagctttcatgggaaaatgtagggtggttggtaaaacatcagaagtctcccttgagatttcataaatgccatagcttaggggttaaactcacagacatttaagtcacatgttcttgagttcaagtccaagttgctggccctttgggacttttaactcccctatgatcgattgctataaattaaaactcagttaatagaatataatgtaagtagttatatatcggaaccaatgatagtacctacttcttagggttgtcaagagcatccagagagctaagttatacaaaggactagctcgatcactggcatgggataaatatttgataaatgtggtttgtaatattttataaaagtgacaaaaattcttatttatgtaccttttttactatgaggagaatcaggttggattcttagaaaaccttcagtgcctctgtcacagccttgcaaagactacttgggatatgtttatgttgataatttctccccttttatttttctatcagtcagatttataataagaatcagctgttctttctaaaagactattgtgcctttatattattttctttaattttcaataatcctatgaattagcaattattatcctcatttttacaaatgaggaaactagagatccgaaaagtaaacagcctcccagctaataaacagatgagctgcaataccaaccgaggtcttctgtctctcacaatccagttctaatattaaaacaaaaggctttgagaccatatgacccaaggtgcaatctgtttttcagatcagaagattgggactctaagatagaaacacggtctgtccagagtcacatagcaagttggagacagaatggacactagaccctaggcctctatttctggtctagagctctttcatcatttccaggctacttgtttgtttgcagcaatttgtatgttctgtagaggaagattgaaaagagaaatggatagaaagagagagcagagatgaggggatgagagtctggagagaaggggagagagagagagagagagagaaatagattcatatatgaaggttagatcaagggccagcatccaagggtggtctaggtagagtactgggaaccaatctcaacctggcaggagaggcataattaaccagtgtctacatctgtgatattatttgtccttgctccaaaatgacaatagtgattacagtagatgcagctgacagtagcagatgacacaacctcctttcacctcctggccagctgcagcgctaccatcaccagctatagcagctttctccctggagattcagctttttctccactgatggaaggctttccctccatcactccaatgtcagagcttggccgatttggttcctcaggagactgtagagaaattcactcccattgaagcattttcttgacattttgacattcaatcagagaaaggcaaaaggcaggctaagggcccaatcatcaggtccatgaagatcaagctatgttttctgagtacctattgatagaatgtgcaggagattattactgtttgccaaagctctattgatcttggctttgtgaagctcaaagtctgtttacagccacctataaaaaccaacagccacttcttttactgaaggttaacgtgctgtgtttatttaattgaatggaaatggccttgtgttttccaaatgtcattgttaataaattttcaagggaatctgtgactagtgtgtaggtgttgaggatgggagaagggactgtcatggggagggacggctgttggaatttgaagttgctggaagcaagagataaaagacaaacacatagatacgacattggaataatttccctgtatagaagtgctataaaatatccttactctatattagtgttgttttttaaacttgtcagtaagaattctcccctgggtgttttattctttagcctgcgtctgtttttgtttgttcttttgggtttccaaaaaatatatattttaaagtgacattgagcattttagtataattgtgagttttggggttgaatatttttcactattatttgatcagttttttccttctgtaagagatttaacagaaatggctaaaattaggagccatattagatagaggaagatattggcaatcctattgacctgctttttaagaggcgtgtttcaactaacaggaggagagatgcaaagagctttcaccaaagcaatcagaagacctgtaaacagcctcagggaactgtaaaagtctgtgagggtctctagtgtaccagatgaaaagcagaaactttaggtagccgtctgaatgtgtcaaatgggaatatcagaataactcactaaatttcctttttcaactttcctcgcaaggtttgtctttttatgtggtaaatgttggtgagttccatttttaagttttactcttcccattctacttcagtctccttagcaaacacacacacaaacacacacacacacaaacacacacaacacacacaaaattgttcttcttgaaagatacatgtaaatgaatggtgagtaaaaaattaaagtctggacgcagtggctcacgcctgtaatcccagcactttgggaggccaaggtgggtgactcacttcaggtcgggtcactcacttgagaccaggagttcgagaccagcctggccaacatggtgaaaccccatctctactaaaaatacaaaaattggtcgggagtggtggcatgtgcctgtaatcccggctactcaggaggctgaggcaggagaattgcttgaaccctggagttggaggttgaagagagctgagatcgcaccactgcactccagcctggcgacagagcgagactccatctcaaaaaaaaaaaaaaaaattaaaaacttattgtctcaaagcagccattcatttattcaaggaattgctaaacttttctaagggaccaggcactggcctgagtgctacatcgagagagagtaataagatcgaggatcccattcccacgttctgcacgtgtgtgtgtgcgtgtgtgtgtgtgtttcgatctgtgtgtgttggtgggtgaatggctatgcaaatacataacaatttaataagtcttatgatactgggagtacctgactctgattagggggcactgctttaatatctggcaatggaggatatatccatcttcattcgctccttcatgcccccatctaaccttgattaaagtctgatttcaaatagcccatttgttgaacattttatcaaggtttttcaggagcctgacagaaaatgtaaagtcgtcgtatgttttgttttgggaaatactacttctaaaacttatttgagtgtctcagctttttctttcttttattttattttttaattaaaaaaataatattatcttttatttgtctttaagagacagaaccatgtctgcctagtaccttcacttggtcaaatacctcttttggtggaaacaacacaaattatgtaggttgtatatacaggatgaactcggtttaaagataagacatgaaattcagtggaaatattctttaaattctaaacagagaaatcaaaacaaaggtatattcatactgcatgtgggtataagttttttcttacatatattatatatacatatataagtgtaacacttttaagaattttattgaccatctaaatatatagcaaaatcagctgggggtacaagagtgtaactacttccttttttcctaagttgtggaaaatgtgagaaatgagaagtaagcaagacggaggattagaatcacaaggtaggtttccctagtatgaattcagtacctgaaaatcttcttagttctgagtttgaagcagattctataaaatcctgtattaaaataaatacagtaggaattagcaaggatgggggaataggagtgggcagatatgttcttgaagagaataaatgcagaacattattctttgtcaattaatttttactttttatagattgttagactatttaacaaattcttatgagaaaagtgtgtttttaagtgatctctgggaagatgttcctgataataaattaaattaggactgtgcattgcggagcccccaccagttgtactccctctggtgaatttaataccagacgcaacctagttagaggtgacatgaaatcacagaatttgataatcttttttttcaaagttaagcaaatatagatgagctcttcttgtatatgtaagatgccagatggtgtttttgagaaatcgattcgtgtatagtaccagtccagacaaatgggtccaatccttctatagataaggcgacccacttttcctattcaaccatagggctccgttgtctggcacacattatttaacaaagtgacattgtggagtcatcagtaagaatgtggcttctggagtgaatttctttttgagtttgaatcctttgctgggtgatcctggccaaatttcttaacctgtttgaacattagtttcctcgtctctaaaatgtgagtaacaagagtttctcgtaggaactatgtaaaggtaaaaagaaactgtctagcatagtgcctggcacataatataatttcataaagtgtaactcttgttattaaactggatagctcaatagatattgctccagaaacactagtgcatgaggctgccattacgatcgccaaatgatagcagctgtgaactgccactccaagccctttgcagatgcatgtacttcttcgcaagggcttctagtcattgacttacccagatctatcgtcacctcttgaagaaacaaccagaaaacactttccctacttacagtgaaataagtgagtatccttctacagaaggacagttagttcttgaaccaagggacttcaatgccatatgagaaaaattgtcttgtatacaatatctttggagagtgaaagagttttaagcatcttgatattagaaattaaggctacaatgcattcaggttgcctataagttattcatttctgtatcttgttgtcaggaaaaaaaaaaagaatacttcaaaattaagttttttccatctaggatctcagatctcattgtataattttcatcattcaactggatttaataggtctatcagtatgtacagtaaattattttcaaaattcttcacctaatagctaaaaagtaagccctaatctggttttctgtgaaattgtcctcgacagaataaatagttcaggtgtctgaaaagaaaaattccatattcctatatctgggttgacacttaagactgcgtttgtgaagcctccttatatcttgaagacaggatgtatctatcttgctggtgagaattttgctgttctggagtctatatcaggtacctcaaacgtgatgagtgatagaggtcatgttttgttgtatcacagtttgttgaatctccctccttagagattcatttgactgaaaaattaacaggtttatttgtgcaaatggtagttgcacacccaattattgcttctgggtttcccatgtgactagccaagactcaaggtgaaagtttggcctgcagctttggcaaacaaaggagaagctaatgaatcataaaggtcacatcttcttgaattttcttctctttcttcactgttctgattacttttaaaaaatctctattccttatatattctgagtacaaaaactcattagcaagatttggttctgttgtctggagaattttctgctcactgcaataggaaggtgatccaggtaccacataactgtctccatgaagatgtttgcaatatgttatgagttttttaaagttattgtttgagaaaaggccatataaggagataatttttgcttattactaattagcttacccctcttctgctgttcttacatttatgactatttacttgtaaataaaagttattgatctttttagaagtccattggattctgctgcttttatttttgagaatcattttaacttacaaacacatattaccttttccaaaaagtgaccacatagctttgtgactcctccctcatatattttgagcacacagaaattaccatcctctcactgagtactatacatcggggcctctggctcttacctcctttctcagatccaggactgaatgcatagctgaaaagatgactttagtctttattcacaacctgtaaactaaagaaggtcattaaaaaaaattcttcgtatcttgcaaacaaaagaactgagatacctatctaagaatggcaagtctgagaagcaaatacctggctctagccctctgccataagtttgcaagcttgtgtagacctttgtctgagaattggttaggtatagaaatacacttcagcagagacttgacctatatgactttcaaatttgttatgattctacaattagtgtttgctaaaatcaaaactgtagaatatagtatagagagtatattaattgttggctctatgctgacccaaaatgaagtcttttaagagattagagtactacactgtctacatttaaccaggtgtcatataacaattaatgaaaattcaatgttttatacttagaatttttaagtaataacagatgatggatcaagattaaaactgtattgacagcctaagcaaagaaataaaatctaacaaaagaagctttaaaagaaatgaatgtaaaatcctatattttgattaaataaatcaagtttgcaagtaccaggtataggagttttggactgacagaactttacactaaacaagatgtaaaagttttagttgtacataaatttaaaatgaacctgccttactgtttcttttaaaaaaattaagaaaaaaaaactctacgcagtattaagttctattaatagacttctaatttattactaaattatgttgactcttcatctgaaatgtatctatctttttactccattaatttctcttcagtgatctagtcacagaccttattatcctttacatgacagtagcttaataatggtatccttgcttttctccctactacagtctgtcctctgcatgtagccaatgttatacttgatgacttaaatctgatcatatcattcccaagtaaataagccaacaatggtcctcaataattaccgaattaattattccctgagaaatggggcccctcagtgtaatatctcatctcaatcattttttttagttttgcagatagcacctgccatttctaaatatgtgtctttaattcatcttaaccacttcggattatgacatcctaaaattgccatatatttttatatttccatacttttgctcaggatcttctttggttaaaataatctttcctacttcacctttgaccaaccactgccagtgatccatgagattcaaatgtcttctcatttggaaggactgcctgataacctgctacctcagcttcaggagaaaccagttgctggcctctgtgctgttctcctacctctaaacagaatgtaaagtactattattttctcttcaattgacaaggcgcttctatgattgttcccatcttctgttggtattatttttaataaaaagatctcatatattgtgttaaagtactaaccttgagaagacccccagtctgaaagaagaatatttcacttctcccttccccattttcaatcacacatattattgaataattttggttaacatccttaatattctaaagtatcttgaaacagttattttttctattttcagaaataaggttttagtgataatactgaaaattctaaactgtgagcttttgtttcagggatagaaatttaaaaaatcatgaggtcttctgtcatgattttgaatgtttaatctactttgtccagtgggcttctgaatcttttgtgattggcacgtgttactgagatgcagacacatgcaattctggtgaccgagttctcaagctacagtttattatttcacactgcagtaaatgtatggactgagggtgaggggactgtcagaagatgtgtgtcttgggtgcctgaataatgcttcttttgctattcactttcatcttaatttagagtcatatatttcttgttaccttttggttttccccggcacctaacaatgtaatcttcacaaagcagtgctacattctaaatttatagtgcagtaaatgaaagaggttggatccattgtgcttcataattcagagggaagaatgtctgcagaaagaaacgtgggtattctttggaatgccatatgtgcaataattgaaacattttgaggaatttccaatttacctcttaggaggaattcaggtttttgttctttttgaaaagaagatgattgttacagacttgggaaatcctaaaagaaaaaagaaggactgttgggacatcctggttgttcttgacccccgcaagaacagctacagttctttcagatcacagcacttgaagtcagaagcctaagtgggtgtccagagaattcaatgccgaaaggttttgcccctcttaactctcctgaccactagcattctctctaccttagtgtgtgggtaggtctttgttatgtctccagactcacactagttttttaaaaaaaatacttaggtaaatagcagtgggaccccaattctctttttcttgtattccagatgaaaaagaaaaaaactcaccagtttaaagtgctcgtttcatatgttcacgatatctaatagatgttaaattttggtaccaggaagtgagagagtgatatgaaggaactagtgaaataagattttaatacctggcaacatttcatagatgataacactggtccacttgaacacttgccattttttattcattatatctggtctagatgggtctagctaaaactttattccgtgcaacacagctcttgcctatttagaagcctttaactgtgtgtttaattatcacctggagtggttcttttgcagagaaaacatagaacgtaggatccagtctttcacaatgcaaaagttgaacctctgtcacctggcatgcttgaggaaatttcagaagctttgtcctcaccttagacccactgaataaggtcactaaggaatggcacccaggaatctacattttacaacctctccatttaatacatatgcttgctagaggttaagcaacactgtgggctcacctgtagcacgtagcactaatcagacaagactcaatatctggccagacttttagatgataatcacaagaagcaataacatttttctgaaacaaaacaagtggcaaatgatactgtgaaatctctggcactggttacccaatatccacacataccccacttagctctagattagaaaataaagaatgagattcagcccagaggcagccatgcgcacaggtgcacaatttggaaaaaatgagaccaattcttaaaaaaaaaatcaagctgaagtcaaagaagcttaataaaaatgtaaatcctctttcaactggctccatgttttctgtctcttcatgaacacctgccacctggtgaataatgtcaaggcctctcagagtgggtcaggaaagcaaaaaggcccatggccggaaatgctattaggcattcaaaaatgaacaatccaggtaacaaaaactcatgtcagtggtgcaggtacgatggcgtattctcttcataagaaacactatgcaaatgaatcgcaaagcgtgagagagcagaacttttcactgctgccttctgtcaagttgggaacactgaggtgaagattgagtgcaggggatttggggtggggagggtcccctgtgaaacagtttctgaatgaaagtgagggaagcaggcatgggatagaaggataatttggtctgagatgcaagtgcggctaaagcctcagccagtcccacggtgagctctgaagttaggttgtcccttctgagatgacctaaattgcataaacggatctgagtctttgtacctcccgtgcccatccaaacatccagtcaccatatgaggccacacccattgactgaatccggttctggagagggactgaggtttggtgcaagttgtccgcagccaggacttccaacatctggaggatgagcaccctaatcttgaaggctgaattcagtagcacatccactgcaactgaatatctgattcaaggccaaaaattgtggagctcagagccacaacgggcttctgatcttccacaggctgctgaatgcccctggcagtccactgaagtgataatgttaaggaaggaaatgattagaagtaatttgctgagggatcagagttgcatttggagctatcagcaagtaatgaagcaagaatgtcaatcgacaggtgaatcaaagtcagggcaaaagaaagggaggaggaaatttgctcaaaaaaaaaaaaaagccattactttcattgaggcctgggatgaggtaagtagagaaagtttgcaactgccagagattgctaaataggaaaaaatcttttgtgcacgtgttgctggtgggattgggacatgaaagatgttgtgggacagaatctcactggaaaagtcaagaatcagagctggtttcaaaaaaactcaaccttcaaataaaggatcccctatctctatattgaacctggcaatgaatacctctttcttttccttattggttggcaaggatgtagaacactaagatacacacacacacacacacacacacacacacacacacatacattctttgtttgtttgttttgagacaggatctcgctctgtcacccaggctaagtgcagtggcatgatcatagctcactgcagtcccaatctcctgagctcaggctatcctcctgccacagcctcctgaggagctgggactataggcatggaccatcacacttggctgatttttaattttttgtagagatgaggtctccctgtgttgcccaggctggtctcaaactctcggactgaagggatcctcacacctcggcctcccaaagtgctaggattacaggcacgaaccaccacacttggcaaatatttaattaaatattaaatatatctaattgtttgataaaaagggagagaggctctccttgatggaagtaataggttctggaatgcagtgagttctgctcggaatgccctctgaccactgcctccatgtgtctaatataacctatgacattacccatagaggtgccgctttttcattgggggacactgctccaaaagtgcctggaaccaggttaaaccattgaggttataaggaataaagggcctttataataaagaccatttctgtgactgtgttctgaaactgataaaaagcacttctttctgtctttggtgtcttccttgatagttgtaataagaatagtagtagttattcttctttttcttttttcttgtttgatttgtaaaataaaaacacttttcctttcctctctggtgtttgaatgcacccagtctcatttcagcagtccacaatgacatactgaaagttgtaatagagctacagctttgctgtatagaggtccatggatatgttttctaattataatcattcttgagctgtttgtaactatttcagactgcttacccagctgtatgccactggcttgtttctatttcaggaatcatctcttcctcttctcctccttccccctccattcccaaatccccacattagtagcggccaagttattttcaagtacagtgtatatgtaagtgatcttgatctgctaagaaaagacatactgtttgtttttattgggcaggcagcatcctagggaaaaggagaattacaagtctaatttggttaggaagcatcctttttcgcaacagtgaggactgcaggtaccactaaaatcattgctgttcattactaattggattaagtcctctctgttccaccaaccctgcttttaaaatttcttctctgcttttcattcagaaactgcctcagcctgcactccgttatctacctccaggctttattgcaacacctcccactgcctctctcctggaccaccttgtccacgctgcacacagttgccaaattcaactttctgtgttgcaaaccttgttgtggctccccctgtgtaaaaaccttttagtgtttctcatctccatgaatcactaatccatggtgcttagtagcatgtcaaaggcccttccgaatctatctctagcctacctctgtggaccttatctcttggctctcccacctgcccccacccacacctctaccccttgctttttgcttttcttttccccaaattctgagctgcttatacgttctttcccttcatggtgttttatacctcagcgctttcatgcatatagttcccagtgtctggaatgatcttttggataaatagtgacacttcaagaaatatctttgtcccaacttcagaaacctaattttcattgtgatgaatagctcccacagttttttccccgggctattttgcaagtattgaggattcacatgttaatcctgaaatgtgcgttctaaaaaaaaaaaaaagctccatctgagaacccattaaacctctagtttaaatacccaggcattcttaaaaatcgaatttgcattgtctttgctgcagtgtcttctcaggtaaccaatgcagccatgtcagattgatacatcatgttgttaagacccccatctgtctctagggtagtagaaaagatgcagctacggaagagaacagaactgtgctcctgaacatggcatggctgccgaacctcacagataatcctgaagcaggcaatctctgcagacttctggggtgatttgagcatgtgtagcttttgctggcagctgagagaaatgggaagtcccctgagctgaaagttgggagcactacatcctcatcaacctaaatctgccacatacaatctctgtgatcctggggaagtcactggacctctttgagtcatgctgtcctcaaatgtaaaatgagttttacatttaaatgttctaaataagttcctttagaatgtttcaattaaaaatttatccatctgtatcagataatattggtgatctcattcaatttttttagttccctttttgattatttttgtacccccaggcctcagcgtggcttctcttgcaatagccagcatggcttgttcttaagaaagttgtcctcagtctactactctattgcctctggctggaaaaactcgggtaggtgcaaggtgtccaccagcattttctcctgggatcgggctgctgccagctctggcactttgcctgggactgtagccttgtctggactcccctttccctctgcgtgggagtgcttccttatcaatcatttgccctcgaatccatgtcttaggatctgcttatgggttggactcagcccaagatattctctatctaggtatcctggttgagtttgttaataaaagttcggtttggatttagacgagacaaaccaaacttggttagggtaaatagaggaggaaggtgccttgtttcctaaattgtgtttgataaagtgcttaataagggcggcttccaaagtggttccaggtaaagaagtactaaaaaggcctctttattaatgtatggattttctgtcactgatgtttgtctgcctatgaatagtttagactagatttttcaagtaagcactttataatatctgtaactctttctaggtgttttataaacaactaactgagtagagcagcaacaacaaagagctgtaagttttctgccagtaacttctagtttttacctcctcaaaagctattttaaacaaatatgtgtctaattaaatctcaagggaatgtgaaataaaaactggaatttgagttcagagtacctgaaagagcatttttggaaaagactttgtttatgccatttgtgcatatgtagatggaatcaaaatgtataagataataagagaaaggtgccattgagcctccaagtagaagcccgatgacttcacttatgcccggctgatcacccaagtgtacagttagtcatgatttgatatctgttgtagattaagcctgttgcacacagtttctaccctgatgtttggcatgggccatgcaccatacattgaaacaagattttgaagtaaatagaaccacattttccactttctttcatgcagttattttctctgcaagatgcattctggctccttttgtgaaacctcagatttgattctacaagctgctgagaaacacagcacctgcatgccacccaccaaagagagtgtttacatagtctgttgtacatagaaagcatgtgggtgtgagtatacgtatgtgtgatgaaatggttcaattgacattgtacttacaagataaactgcatgtatcaccaaattatttgacttctctactcagaaagcattaaattttgaggtttaagtagacattaaacatttataatttaatatacatttaataaaattaatatttatgaacacatttgccttgggaattaaaagtggaaaacagtgtcatttacttgctaatggccaccacggtgccatgcagttacagatttgatggcctgcatcccagtgacattgctccaagaccagagacaagaccattttttgtttgcatggagctaagtattattttcagaaaatcaaaaccaaaaggtatgttttgcttcctagctcagggtctctggagacctgacctgccaggtatcatttgctcattttatttaaagaaaataaaataaatattcaatggagaagttaaaagtctctttccaactcaactctatatctcaaagaattattttctcattctgtcaagccatgttaaaattttcaagtaaagtcgtaatcatttctacattttctttcctgtttgtcttgcatctcttaaaatggttttaatgttagaagctacttgacaatggatgtgaaaatagatttaactcagcaatcaatatattatcaataataatcattaatttatacataaacatcacatgggtagctttccaagtccatcctgttttttgtgggctcttatgctggttcagagatgatatatgccatttttataaggtgaagaagtggagcagtataaattgtaccaagcaagtattgagcactgcgaagttcactgttccttagagaaatgagctatgcatttactgctaaaaacaaacctttcataaaatatttttttgggcaccaacctagtgaaggagtaaggaaaagaagtggatggttttagcatttaccctatggaagcttatagcctggatggcaagatcaaattaacatgagaaggcagtttggtgtaatggttaagagcctttggattcagccaaggcagaaagtgatttgaattctaattgagcccctttttagctgtacaactttgtaaaagccctttaccttctatacctcagttttcttatctttaaaatagaaatgctaatatctacctaatagtgttgttactattgtttcttaaagattgacaacaaggcgtatgaacagcatgcctggaaaatactggatgctcctcataagtagttatttatttattaatatcactgacacaagtgaaataatccatctcttcctaccccagcacacttatcataacaaatttgtaatttgtatgtttacaatatcttttctgatgaattgatccccatagtatatttagagcagtggtgtctggatttgtataaatctctgtaactctagaacttcacccagtggccaatacataaaagattctaaataaatatttgttgttgtcattgtaataggggaagagtatgctccaaaacaaagatactgattttaaaaacgaccacactttcaaaaaaaaattttttttaattctagagaccagcatcgagagtaggagtactcagtacgattatttacggtaatatatttattgggtaaattaggcaccatctggtgtgctagcttagatggctctagttctttattaatagatatatgagactctggggtaataggttgctagatccatatgctattcaggagacaaatttagtatacggtaagcttgctacaggatcaagtcgcataagaaaatgaattgaagtcgaagaaatgcttaggttaacccaacaactctgataattgaccaatgtggcaagggccattctgttccaaaaataattaacaatatgatcagtactgaattaatgttgttacggattataggtttcaaattttcccttgttaggaaaatcaccttttaaataatctcatagggttttgaacaaagagcacagtgtttctttttttttaaatagaaacccatacttgagaaggtagcaaagagtagcaaagagacctggatctctgtagcaagttcttggcctggtcttcattttcaattctaaaaattttgagggaaataaacagctgtccaaacaaaatgctgaaagaatatccctggacaaacagaaaatctttttttttttttttttttttttttttttttgagacggagtctcgctctgttgtccaggctggagtgcagtggtgcgatcttggctcactgcaagctccgcctcccgggttcacgccattctcctgcctcagcctcccgagtagctggaactacaggcgcccgccaccgcacccggctaatttgtttgtatttttagtagagacggggtttcaccgtgttagccaggatggtctcgatctcctgacctcgtgatctgcccgccgcggcctcccaaagtgctgggattacaggcgtgagccaccacacccgaccgacaaacagaaaatcttagaggggcatcaaagcaaatcatatggatggagagtgtgaatatgaagaaaagcatattctttcttcacacacacacagtatgtgtgtgtgaagtaatcttcagccaaagcaaagactaaaatgacctgttcaataagatggaagcaaactttaaaaaacaaacaaacgacaaaaaaaaaaactgtcctccttctccgccaaattcaggatacatgttttatcagcccatgtgctattaatctatttgtgattattctatttcattttctctcccatgcttttctcatttcttctcctcattctaggtgagtataggaagcatcagggctggggccataaaaagcctgtggccaaggacattgcaataagacagagaattttagatacttcattaattatttttcctaccagttaaggattccttgtgtaatgacagaacaaggagaagacagcaaaataatactaatgctaataaaaatatgtaatacagagtacttatgatgatataagcattgttttgtttgcttagattattctgtctggtgttcttaacagcctgtatgctgggcaataaaaatagagtctcaggaaaacagaaccaagtttgctataatttggagagacaaaactaagctaagattctttaagtaatgttcatggggagtttgtgcatatgatttatcagaaagagctgcttctaccagggctcataataataatggttcccctgaactggatgctaaatttatcaactggttattttgggcttctcttgccagtaagcctatagaaaacaaaaacaaaaacttttgctataaccttgattattcagagaaaataaggtttctgctacacagcagggacaggacatggttggcaactgggaaagacactcagcaaatattacagataccagaaggaacctggagaaactctgattctttttcattttgttcttaaaaagcaggcgtctgaaatgtgcccaacttcagctaaagaaaaaaacactattgttgggtctagacacaaagcctgatttgctgattttatttttcttcatttagttattttattgttctgtaaatatggacttaccttttttgcttctttattttatcttttggtagaaccttgagcagggacaccctagacgttcaactgttccgtgtgatcagtgtctgccttaaaatgtctgaattcctgtactgcatttcccagtgaagtttagtgtttatggcaatcctcccgatggggagagaaatgagccggcgaggccaaaagcagcatctgtgacttgctaggatcagctggctctgtgtgcatgatttccacttcaaagggtacacagacaacttggtgatagtccatttattgcagcctggtcttgtcaattagtcaaagttatcttctatacagctacagtaagtaatgtaaaatcatttacaatataggtgttagaacagcagagacccttagagttcatgtatttgacttcctccttgcacagttgaggaaattatgaaatgcatgtctttagcttcttcattctacagtatttattgagatttttttatgaagaagaaggataaaaagatacaaacttgtatgaagttagggaactggagaagctaactcattttctcttttttttcctgtgtctttggcacctctattagatctggtccgtagtgggtctaaataagtatttattgaagaagtaatacatgctttataaatgatggccaaatagctgtttgaatggataaaaaagcttcataaagaaagtgatacttgtactacgtcttgcaggatgtgggagaattggaaaatgagagagaatagagaaattaaccaatattatagtccagccaacagcaaagattgaactaaaattctggtctggtctagaggtaaaccaataggctcactttccaaaagaaaatctgaagcatttaagattatttaataaggaagaatttcctctggtgtcctgaatgaggaatctttggggcaagaagggtcctgtcctatttattatccttaagaaattccttgctatttttagttctcaacatcagctacttctcattactaagtaaaagccagattacttaacttgcactcaccctaattcatcttatccactggcagcaaattccttccttagaatacttccccactggtttttgagaagtgaaaaggattaacatatatggcagtggagtgttttatgtaatagtctttttattaaccccattatccagctgttggggtgctgggtagagaaggaagggaggaggaggaaagtagttgttggcactgggggttcagagccgccccagctccttgagatgaagggatgaaaataaatcctctgtattactgaagcatgtgaatgccatgaagtagtgggacctgaatcaatacattgcatttacagcagagcaaaagaaagaatagggttttcagagtttatttatcctgcttctctgaaaaatacccgtgtgaactattgggctgagagtgttgagtccattgaatttgactctttcactgccatatctttggagagaatgccttcccaaagagtcatatccaaatgtaatgtccctcccttctcttatgagtgacttacttttggtattccactgggtggaaaaaagcttttcttacaggatatatgaactaataatagttatacgactgcttcggatttgtcgcgctccccttggataagtttaatatgattttgtacacattaattaattatcttaataacagacaaaatagaaggaagccactaccgtcctttccagtgcatcagatgaatcaaaatgaatcaaagggctgggcatggtggcccacacttgcaatcccattactttgggaggctgacaccagtaaatcacttgaggccaagagttcaaaaccagcctcagcaatatagtgagaacccatcactacaaattcctttttttaaattagctggacatggtgacccatgcctgtagtcccagctacttgggtggctgagtcaggagggttgcttgagcgcaggggttctagactgcagtgagttatgatcaccactgcagtccaacctgggtgacagagtcagaccttgtctctaaaaaaataaatttaaaaataacattaattaattaaaatggatcaaataaacacatacatattgtggagattgtgagaaataagccttgttctatgtgtctcaggtttacctgaactccaagtagccctgatgactatatggcagttatcacaataagcaacagcataaaggactttgagaaatcaacagatcttatttttaaaaatgaattttcttaaacatgtattcactcagctggcagtggtggctcatgcctgtaatcccagcaattttagaggctgaggcgggcagatcacgaggtcaagagatcaagaccatcctggccaacatggtgaaaccccgtctctactaaaaatacaaaaattacccgggtgtggtgacacacacctgtagtcccagctactcgggaggctgaggcaggagaatcacttgaacccgggagtcagaggttgcagtgagccgagatcacgccactgcactccagcctggtgacagagcaagaccccatctcaaaaaaaaaaagaaagaaagaaaaaaagaaaaaaaatgtattcactcaatatgattaagtacctactctgggctagatattaattagatcattgagagtgtaggtgtaagccaggcagccagacatcaattctcatggacttgcattctagaaggagattgaagagatgaggcaacagttgtagagaacaccttactgctcatgggatagaaaattaccactgggatgagggaaagttgctacttttgattgtggtcaagaaaagcttttcaggagatcacccttggcttgaggctcattgataagaagaggccagccatgcaaacatctgggggaagaggaaagagcaagtgcaaagatcccaaagccacagagatgtttatgtgctgggagaacagaagaaatcccagtgcttgtagtgcagtgagcaaaaggaagtatgaggccaggtaaagtaagaaaggttggcaagggtcagatcatggagggcctttggggctgttgtaaagagtttcatttcattctaaggcaattggaatccatttgagaattgtgagcgggagagtggtagggaccaatggccagtatgtgatgacaggtaatgtgatctatgctcctatttttaggggcaggcctccttaaagatccatttattgatttaacaatattaaatgaaagttcactatatgccatgctatagtgttctagggtttcagcagtgactatgacaggtctccagctttattgagcttacatcttattgaggagaggcagacaaaaacgaataagaaccgtgaagaaaatatagagtttatatgataaaaattaatgggatgaagtgctggaaatttcactggattggagaccactagggctacttcagtaattagttttgaggtctcctgttgttgtttctcagccctgatggtcaagaaattctttcctgttttgcttgtttccatttctgtctactgctttttattctgttgtcctcttaggtagtacacagccctttttctgaaagtcttatctctgatgaagaaaacactttttctcttcaaacagtaacttagtcttttgctttatttcctagagactctgatttcctaaagtttttcatatttgttctatgtattcattcttttcattatttttgttgctctccacataaaaatataaaaacttatcctgtaaagaagtattaatttagacatcatttagccagaatatagcagaagaattattttacagttcttataaggtacctactaatcctccctcctccctgccccctccctgtcttctcttttctcctttccttcctttctttttctcctatcccaaaatactagttaaatagtttctctcctttaaagtactttaaagataacttcttcataatgaactcttgtgtgcataagcatttcttttcctgttaagaagcagtggacaatttttttgttttaaagacattctagaagattttaaaaaattattgtggtaagaacacctaactgtgagatctatcttcttaatagatttctaagtgtacaatacagtattagtaactgtagacattatgttgtgcaggagatctccataacttattcatcttgcattactgaaattttatacctgttgattaaaactaaagatccttttcaaaaaatacttcttaagccatggcttcccctggttgtggactgtaacccttgatgttattgaccatcttgggattaagttccattaagaaagacagtgttagacattgtggagaaataatagcaaggaaatgtttgttctggtccaccaaaatattgagggaccaattttaacctccacatcgttccttctggggttttcaggataagaaaaaaggagctgtggcttgctgctatttcagtagtcaaataaatatttttaaattgcttgtttcattagtaggatgtttttctgaaaagacagagtatatacccctcaggatatttctgccaatgtgttaaagtatttgtaaaaaaaaataaaataaatggctttgtagaatgttcttgtttcccaaatggctactgattttcttaagaaaaaggtagcagcaatttgctgaaaaacaaaaatgaccttttattagtcaagagaaataagataactaatttagattgaatgtgtttatcctaccagggtccaaaatttctattttcatgtattctccttttcttataaaggctccctttggaactatctaggaaggacctgccaacatccttgaacagtgaccattcagtctctactatactagaacccatctgatgatgaaattttgactatatttttggagatttcattctgtcattggatagctctaggaagtgcttttacaccttttgagctctggtcttgagtccagtaatttttacgtatcagtccttgttctgccttccaaaaccgcataatcctccttcaacttgacgtcctttatgtgttttgagatggcccccatgggcttccaagtgtttctggctaaatatcctgagctcatacatgtgttcttcatacagcagcactttgaggcctctctccatgctggttaccttcctcccaagtctgagttttaatgtcctgtttaaaatgttatgaacacagctacttagaaagctgtgcagtcatctcagagtagaatcagacaaggacctccttcacacgaagtgcttcctgtgaggacctatgtaatctgctctgtcttctgctatcatttgtttcttcccttctctcctttgcatcatccactccagcgacactggtttccttgctgttcctcacacaagccaagcaccctttaacttccttttaaagccctttacccttatttcctctgccttgaactctcctccttcagaagacatggggcattctccctctctgcactcagattactattgctgtcccctcagaggggcctgcccttcccaacccattctaaacagccctcccccatcatgactaccccttgtcatgcttttattagcccttgaaattcccagacattatgttatcattccatttatttgtttattgtctgctatcattattagagtatgatctctattaagtcaaggactttgctagttcctgaatgtcttttcagtacccagaaaagggtctagcatatagaaggagcataataaatatttgtgaatgtattgactaatttactatccatgcagattatctttaggcagaggatagagaataagactttttagtacatatttaacagtgtgtgtagccatccatacagtaaagaattctgcaactcacagtcaccccaaacagcatttgagcttttagatactatagagcaacctgtgtctgtgtgtgcatagatatgtgtgtacatgtacacacttatgtatatacatacacacatacattcgtatacatgcgtgtacatttatgtatgtattatgtgtatatctctgattaaatgggtgaacatgtggtttggggacccgtgtccaagccctctagattgtagaagctggaaatgacaaaagtgaatgaagtgagggaaagtgagccagcaggactgctcactgcacatgaatttccaaggatacagttgttcttgaacaatcacagtcagtatatcaaaataagcgctttattgagtagggtaaaaggagttgctggaaagactgtaaattctctcgcagaacaaatgataactgagcccaggagcccttttgttcttgggggagggggcataaattccctgaaagtatctgtcgcagggaattgctctgcattcatcatgtccgcctcctgcatcattcatgaatgtcataagactctaaagaattggcacttcatagtgaagatgattaaatagccactatacttgtcttttctgctgcacagtgctttttaaaggaattccatttaggttgtagcatgccccttcgaatcccttcgcatttcttgcaacctgaggtctctgacatcagaggaaggcccttgcttgttgggactggacagagctggtgggctagcacttcagtttgcttattttcctttgatggagacaataggatctggaaaaaaaaatgccataaagctcaaagcaaatcattttttagggagtatagaaattgctgtttagattctgcagtgaatgagctgtaatttttttcagatattttcacttctcttatcacttccttgtggactaagaataatgaatcagaacaagacacttttatatatgatttgctattttatatattcaaatataaggcctcaagtcattttgtagccaataaagcctatgtatgcagtgtaaatactgatgtaacagagtataagatatagaatcggccaggcgcagtggctcacgcctgcaatcccagctctctgggaggccgaggcgggcggatcacctgaggtcaggagtttgagaccagcctggctaacatggtgaaaccccgtctctactaaaaactataaaaattagccgggtgtggtggcaggtgcctgtaattccagctgcttgggaggctgaggcaggagaatcacttgaacctgggaggtggaggttgcagtgagctgagattgcaccactgcactccagcctgggcaacagagggaaactccatctcaaaaaaaaaaaaaaaaaaaaaaaagatatagaatcttacttctgtcctctcccctgcatgcatttcttgtcatgtatacatattctctttctctctctccctctctccacacatactcactccctctctctctctaagtgccctagagtaattcttacttcccaaacagcatccttaagtgacagagtgcaaatgattgaattaacatttatctactcaggtatatgtagaatctaaaacagttgaactcctagaagtacatagtagaatagtggttaccagaggcctcaggttgggggttggaaggagcagatgttggtcaaagggtacaaaatttcagttaggagaaatacatttttgagatctattgcatagcatggtgactacagctaataataatggattgtaaattgcaaaattgccaagaataaatttcaaaagttctcaccacaaaaaataataagtatctgaggtgatggatgtgttaattagcttgatttacatcattccacatagtttacatatatcataacatcacattgtaccccataattatatataattatgatttgtcaattaaaaataaggccaggggcggtggctcacgtctgtaatcccagcactttggtaggccgaggtgggaggatctcttgaggtcaggagtttgagaccagcctggccaacatggcgaaaatataaaagttatctctactaaaattataaaagttagctgagcatgagggcacatgcctgtaatcccagctacttgggaggctgaggcacgagaatcacttgaacttgagagacagaggttgcagtgggccgggctcacgccactgcactccagcctgggcaacagagtgagactctgtctcaaaaaaaaaaaaattaaaattaaattaaaaatataaagttggtcaataaacaaattttcataagcacttatgttagaggcaacagaaagtatttagagagaacagcagactgtaattaggagagaggagctctgatttgtttccaccagtcatcactgtcacctcagacaaattctgtaacttcccagggcctcaggatttgcatctgcaaatgaggacacaaatggtggctccaggattctccttccactcttatgacacatggctttatgtgtcaggaggggctcagccatcaggagggaacagaaaaaaaaaaaaaaaagctcaggatatcaccactatttctgaggaactcataatttaatgatctctgcaatctctaagctctgctgggaaatgagctccagcataacacgggttctgggtctgtagtggcatcgctgactgaaagataggtcatttttaaaatagtggtatgacctttggctgtgatttcctcataataaacataatatgatttttgtgccaattttctgttaattatgggcttctcctaaaagtttatgagtttaggaagaatgttctttttaaagtagaactttggacacatgttaggagatccaattaaatagatggatcatggaaattgggtcatcactggttgttaccagtaagaggatcccttagagataatgtgttcacctgttaccatagaagtcttatgagctgtgcctgtaagttaccagtggcttcaaggcaggtagaccttttgagctttaatttgttcctagaaggaacctcttcacttctcattatccagactttccctagaagtgggagggctgatcaaaatgccagccttggccctttgcattctgctgctccagccatgtgggtctgatttgttcttactgctggtttaagagagattaaaaggagcaaagctgttctctaagtttcttgatctgcaccgtggcagccagagtcagaggaaatggagacaatgggaaagggactaaatcctagagagtgatgtgtctgggatctcgggaagcagacccagcgttcaaatgcaggcttcaaatactaggtcattgctttggagaatcttcttgcacccaaaacaacttgccacaacctatgtggcccaatgtgcagcaaaagctgagcctgagataaggacagacaggatatatggctgaataaagaactttcaatttccttttcttagtagacggacaagtatcccatcattaaaaaaaaatagccacataaaaaagcagtttccaatctaagtgcacatggggtatgccaaaatctttgcacatgattgacttaatcagaaggcccaatctaatggagagaagtactgtattaatttaaatatggcaggtgctttctaagtttattgcaagagttaaagaccaattatcttgtatttttccataaaattgcattttctaaaaagagactggtgtgtctgaatacatccatcataataaatcttcaagcttggatggaagtgactgctgtttatttgcagcatgtcatatctgtactattgaatcaatgctaaagttatcatattagaactaagatgagggcccggaaaatgagtttttatagactcacagcgtgattttgtgaataaaagcataagaccaggaccaggtgtagaaagtgccttattccagggcctgatgacctggaaggcaattttcaaatgtagggattatgcagtcacctctcacaaggtccagggtgaagaacaagtaagaaactttctattttctggggaataggcacactttcaaaggaggaagaggtattgagatgagacagagaaattgagatggaaagtgtatttgaaatatgtgtaattaggcaggagaaatgagaatcacaaaacactagcaaaagtcattgtcttgctaaaaataataaaggaagaaaaacaaagtataagctaaggctttgaaggtgataaaatattaagaaattttgcttctgtatttataggaaatcagtttttaaaagtataaactaattactaatatattacataataatgcagtgatgttgcttgtccatgataaaaggtaataaataaaaatttgtttaatgaataatgaaaaatagctttcacatttggagttgattttgattcattttgatctcttatgtggctcttggctgtagactatctttgttttaagaagagcaaacccatttgtcctaatattcctggagaattatttcattcaaaagaataaaaatatcagccaggcgtggtggctcacacctgtaatcccagaactttgggaggcagaggcaggtggaacacctgaggtcaggagtttgagaccagcctggccaacatgctgaaacagagatggtgccactgcactccagcctggacgacagaacgagactctgtctcaaaaaaataaataaataaaaataaaagtaaaaatgtcatgtatataatatagagagaggttcaaatacgctaagagaaaaagaagccaagatcatgtaagcattatgattacaaccacatgcagactatgtttttcttctggctgaaggccagagagaaaggcaagtagctgtatattcagtgggtgttatttggtcaaatcgatttacatagtcttgcaggtcttccaaatactaaatattaagtacttggaaaatagctgagcaaaatctgagtgcattctatgatgatacagtagcacagtcttgcttgggacttaaaatcatggttgtttatggtcatggagttctaaccaaacccttgaacacaaaattcagtgagctcaaaatgaaactaacactttcacattctaatctgtatttccttttctatctactattttatttgtccaaatttgaaaactctgaaccaaccccagatccttctttttttactccccaaatatcaaatagatcacaaaaggcttttattcttcatgtctttcatatctgcttcccctgatttctcatgctcactgatccaattccaattttcatctctcgtgtctggggtattgcagcagtcttcctctaaatccccatggtcacacattatcctccctccatcttctctactgcagacaaagttatttttctcaaactgtgcattttcccactgatcaatgtagtcattctccaactttttaaatactaaaatcactctttgaaaaattgatatggaactttgtttttttttttaagacagagtctcgctctgtcaccaggctggagtgcagtggcgtgatctcggctcactgcaacctctgcctcccaggttcaagcgattctgttgcctcaaccttccaagaagctgggactacaggtgcatgccaccaagcccagttaatttttgtatttttagtagagacggggtttcaccatgttggccacgatggtctcgatctcctgaccttgtgatccacctgcctaggcctcccaaagtgatgggattacaagcatgcaccaccaggcctggctacttttgtatttttagtagagacagggtttctccatgttggtcaggctggtctcgaactcccaacctcaggtgatctgcccaccttggcctcccaaagtgctgggaatacaggcatgagtcaccgtgcccagcccaatcatatattctttaacattgttgtattatttcccagcagtttgtagcttattttgttttaatgctttattttcctagtaacaaattctaaaacgatgttgaataatattgtgataatgaacatctctattttcctgattttaatggcaaaggctatataattttgccatttagtatgacaatactttgctgttgataatctctatcatatttagaacatcttaattctatcttaattaaattttagagggaatggctgctgaattttttccaatacttaaaaaaaatcctgagtaaaattatattcaaattctactttaattaggtaaagtaatgaattttgttaacagatatctttaagctgaaatacactacttttcatgtttctgaaatcatatttttcttctaatataccattgaaatgctattcaaaaaatgtttatcaatttttgtaagtgaaattaaagtgttttgtttttgtgtagcatatttattaggtattggtattaagattatgttggatttacaaatgaattggaaaatttcttagtctgtttgggccactataacaaaataccataaactgagcagttttgtaaacaacagaattttgtatttcatagttctggcggctgagaagttcaagatctaggtagattgtattggtctctggtgagaatctcttttctcttcataggcaacatcttcttctataacctcacatggtgaaaccttacatggtgatgtctgttttataagatcgtttgtccccaccatctcccaaagaccttaccctataataggaacacattgaaagttaggatttcaacataggaatttgcagggggatcataggcattgcagtccatttcatgaagatttctaaccttgcctgtagtatggtataaaatggagtaatttagaaattatctcttatcttaaaagttatgttgaaaggtagatgaaaattacctgtaaaatcacctagatctgtattttttaattattaaaacttgaatctcctttccaatggtgtctatggtcattagcctattgagtttttctactttttcttataaatctttgacaagttatactttttcctagaaatgatccattccttctgactttcaaatatattgctttaaagttgtacaaagtatgattttatatttgtaatcttttctattgtgatggttatataatttctaatgttctatttttctcctttagtttttatttctgtttttttagaggtttatatattttctttgacattttaaagagcaaactttgggatatttttaacttttatattatttcaaatattatcgggtaaatttcagcttttatttttaatcatcaaaaaccatcttatttatcttatttttgtaatagtgcattaaggtgaaagttcagtttatttatgtttattttccttattattatttgagacattttcttctgagtttctgagtaaagctttatctgaagtttatatgacttgatatataaagctgtctcttcattaatactctaattattaggttttggtcttttttactgtatattttaagattgtatgtataaagagtactgtttgttcaataacttaattatagaaatcattaaggatttctttgtcaacaagaatattatcagtttaacaaatgttccaatttgaaatatatacgaattactgaatatgcttctttggtaaaattcctgagttgcttatcacccaatcatcatggtcattctttgccaatttatttaagcacttactgtgcccctatgtgttccaggcactgtgataggtaccaggaattctttcatatccaaactcttctagttgtgaaagaacccaaatttgaactagcttagactacatgagttagctattaaaagttgtgtataagaaagacctggccaggcacagtggctcatgcttataatcccagcattttgggaggccaagacgggcggatcacttgaacccaggagtttgagaccagcctggacaacatagtgaaaccctgtctctactaaaaatacaaaaattatccgagcatagtggcgggtgcctgtaatcccagctactctggaggctgagacaggagaatctcttgaacctggaggcagaggttgctgtgagccctgatcaccccactacactccagcctgggtgacagagcgagactctgtcaaaagaaaagaaaggagaagagaggagaggagaggagaggagaggaagagaagcagaggagaggagaggataggagaggagagggacaaaggcacaacttcacaatatagattataaaaactaggtattttaaaaatgataagatttttctctctgtggccagatctaaattcaacagcttgtctttactctttcagtcaggattgattttctcatgactttctccccataagcagaaatgtggccacggcagctgtgtgtctcttatgtcacagttttatcatcagagaggcactgatggagtgtttctctggttccaggtttaaaaaaaaaaaaaaaaagttcattgaagttctctagcctagcttgggttaattgattacaccttagtccatctgctgtatataagagcagaatcttttacggacatgacaatttcagttcaaatcacatgataaatatggaggaaaataataatttctttgtgaagaggcttaatgtttcaagatagagacagaggatgtgctgcgccgatagaataatgaaagtctcctatagtcaaaaaacaaacaaataaacttgaggcagattcttcacttcaaggtgctcaccataaaatggcaatactaaactatttctagaactctatatagagtgcctgttagttattttgatcctgttacaactctttcagatgatgaggtagaagtgttgtcgccttcttaatcatggagaaactgaggctcagtgaagataaatgattgttttagaacagaagcatggactttaatagttgggatttgttcttttcatccaattctgacctgggttctatgattaagaggtatgtgtctcatagaatcaaatcatcacccttcaaaaatattagccagcttttccagaaaaatcgtgttgtatgaattaaagccacaaatacaccaaagtcatccgtttacagcccctggcctcttgtaagtatgaggatcatataaatcaggcatttaaatcaaagcactggaaataagcaactgctttttatgtgtattgtttttccagagaatattcaatacttagctaccccttcattgttcttattaaaaaaggtatttcaaggctgtgaaataaaaggaggaaaagaagacaaatgtgtatgttccaaacttctcctttcctctaatcatgtctcatgtcatcagaaggaatgcacttctgaaaaataaaatgctacagaaaaggctgctgagtaattataaaatgattacttttgtttttcctttattcatttatattttgcttatgaacaaatgtatatatggtctttgcttttagttaatgctctgtaaaatagaataacgtggctatccttaaagatgtcacgttgcttttctgttgtacatccctgttaggttaaatctgagatgcacttatctatttatttttacaaaaacaatttgcaatgtgatttagaaatggaggagtaacataaaacaatttgactaaaaatgggtgtgattttcttatctgagactgccaaaaattcaccaaagaaaaatcattcaaatgtctttgtggttaggtttcttttataaattgaaagttgtgttctatttcatcatgagagatgctgtgagctctaactgatgagcatttataaaatatttccacgttgagatgaaatgacaaaaaggcaagatgaattaatgaacattgtatattcttattcctttattcccattctactccatgcctgaatggcaacgtgaagatatgtaagcataggtaagccaggtttcattgattagttcaacagcatttatttcctgtgcattcacagtgttgagagataaataaattaaacagccctggcttccaggagctcgtagtagagaagcattctggatttccattttgtttgacaataaaacttaatatttattttcttaagcctgaatactgtgcaatttcctagaacttattttgttttgctatataagaaactagcatggttatgaaagttaagttggctgtgagttaatttctcacatagacctcattataaatttacccttcagaatttagagttgtctgagtgtggtataattaatcaggaatggactattatctgaccttactttattcactttataagaggacaacctcatgtaaaaccactgtcatttaagtaagataaaatgagtacctctatactgccagttgcattgtgaaaggattgggttttcatcttgtttgctgtttttgttttgtttttaattttggccacatattagaaagccattgtccttctttccatcatcatcaggtaaatggtgagaatattagagatacagtttgacataatgaaaagaatgtagattgttgagttagacctggattaaagtcctaattccattcgatatttggtaaaagatcttggcaagtagttttaccttattctatagcttccctcatctttaaaaccaagatagtaactgttatgagctgaattatgtcccctctacaaattcagatattaaagtcataaccctcagtatctcagaatgtgactgcatttgaagatagggttttctgaatgtggtgtaattcatcgggagtgggctatttctgaccttgctttatttttcagtttcagaggttattttggtgggccctcatccaataagactgatgctcttataagaaaaggaaattagggcatagattggtacaaagggaaaaccatgggaagatacagggagaagatgattgtctacaagccaatagagaagctgtagaaaaagccagcactgctaacactttgatcttgaaattctagcctccagaattgcaagacaatgaatttctgttgttaaagttacccagcctgtggtacattttacacagccctagcaaactaacacagcaaaaaatatttcaagtgaaaaatatagagttttgaaatattatactgtatactaagatatataataaataatatatacacatagctggtattagtattaatattgatattaacattagtctagagttagtattgccaaacagtaccaaagagtttgtgaaagaaataattgtcccaaaggaaaaacaatgagcttatgaaaattcctttaagcaagagggaatttgagtgtgtccgtggaagctttatttttaggtcaattttagcgtctacagcattgcgtattctaccactaatcatctttttccttagcggaagtatcctgaaatttgatgagtaaaaatgactttcttttatatttttgtgatataacagcttctaaagtaatgtgtttctgaaaatgtcattacccctaagacttacttacaaagggtcatgatgtgtttgtcaaaactcatcagtgtgtccagaaactatgtgcgtgtgtattttagtcaaactttctgggagttaaagtatatataaggtaacacagcaatggaacatcgcaatagttggcatcagatttgcaaatggcacaattatttgtttcctcttcactggtccttgaaaaatacataatgttcccatcaaaagttccagccaagcatatttgtaagaacagggtttgaacataacctattatatcatgaagaatggctctcttccatggtatttaccaccagaattaagtagtggtagacttttttttattcatggaaaacatttagtgaatgggtagaatgttatttgttttatatttttctctcatcagctcctttggagactttggcatcgggcagaaaaagggtctcactctgcacaccaatttgagttcccatgttatcaaacagatttaatgctaaactaaactggtgtttgttctgcttataagtctttgagttgaagccttgtttctggaatattgggacatgctctgaaatgttgcctctgtagatcctagaaagtaatgatgttttctgctttcatgcgatttagttttaattattcttccttcaacagagagaaatagattgccccacagggagggaaccctcaccttgcttgagcattgtctaagaaatggctttttctcatgatgtacttaactgttaggcaatgttgtcagtttctcagcttactgagcagcaaatctgctcatttctttgccaaggaaaaagaatgttcttaaaaatagatgaactttctctcttaatgttcagtgcattcaatgttgctttatttaaggctgctttatcatcagttctggtgtttatttcaaaaaattcaaagtagataaaacagatcattcactaaattccatctattcaataaataatttgcagagctgtttttaaaatgtgtatcatttaccctgtactccctagtggctccctctgtaatgcagaggccttgtttgcagtttttccatctgttattcacctttctcccctccttttggagctcttgatctctagggatgtttttagggagtctttatcccattagtcattgggacagctttggagaagagggcatagttaagaaagggaggatctgattctattctcaactccactacttagcaacagatcaagttgtttaatctccttgagcatcaattttcttttttattaaaatagtaaccaaaatatttgccattaatatttcagtgagtgttgagggaagaggcatcagatgagacactccaaaagaaagcaatttgaaaatcatttaattctatggcaatataaggcccagctgttataaaatagtgaacattattcactcctaaaacagccagagagatgagcggcagaggaaaaccatagaacaaactaagtaaaagaaattgagaaaatgtattctttggaaaatcagatattacgagatccttcagttaaatttatgtctctatttgctagaagagatatttatcagttccaaagcaacaagcctttcccttttggttttattagctacatggtaattgatatgaatttaaaagataggtttaatttgatagcaataactacatctactggcaggatatattttatgtcattgatagtccttttattttccaaaaggatttaccagtttatagtaaaaaaacacgaatgtggataagcttgtgaaagagtaataaaaaagaaataaagaataagaaacctgaaatgatagaggaagaccaacataccttaccattatgagattttatactaagtcctgaggcaatgatcaaagagaactagagcaggagactgacatcttgtttctcatcctagtttatctatcatgtactttgcacataattgttatacttattttattacttaatttattgttctacttgttataattgtccacaagtaaattatccagttctccttaaatttaactctcagaggccgggtgtggtggctcatgcctgtaatcccagcactttgggaggctgaggtgggtggatcacctgaggtcaggagttcgagaccagcctgaccaacatggtgaaaccccgtctctactaaaaatacaaaattagccaggtgtggtggtgcatgcctgtaatcccagctacttgggaggctgagagaggagaatcgcttgaacccaggaggcagagtttacagtgagccaagatcatgccattgcactccagcctgggtgacaagagcaaaactccatctcaaaaaaaataaataaataagtaaaataataaatttaactctcagatttcccctgggagatgcttccaaaacttgttccattttaacatcaatagaattatttgagggaaggctattttgatatatatatatacacacatatatgtatatatatatataaaaaaatacatgaatgagaaaaaattatattcctcattctcttaaagaaacgatagatcactcacttaattagctatatatatatatacacacacatacatatattcacatatatatatacacacacacacaaccaatattgtattattgtattttagtacttttattaagccattttacctgtaattatttgatggggtaaataataaatgaattctagtctattgtattttttaactgaaccttttttgtttttcacacacatgcatgcacacacacatagacaaatatatatatgcttatgtatatgtatatgtgcatacacaatgaatgtatatgtatatgtacatacacatatgtatgtatatgtatatgtacatacacatatgtatgtatatattatttgtatatctaaagtgaatcttaagacaagaattctatttctgttgatagtctcccagaaaaagtaatatgctatttggctataagactggaaatagaacccatgccataaaggcagggccagggggtttctaagtcaaaacaacaacaacaataaaataattacctaagtgatcctaaataaagaaaaagtaaattgccatcaacaattatattctaatacaataagcaataaaatgcacccaaaatttaagaaccttggagaaatatgtggatgagaaaaaattatattcctcattctcttgaagaaactataggtcacccacttaattagcttgttccgtaactttcacccaggactcctttatgatcgcatggaagactgtttgatccttttcttctgctggatcaccatcccaagcacacactcacagaacacataccaaaacactctgtcaatatcaccatcagctccatcacagtaagtagttagccaattatgaaaacaataagccaggcccattatttgcaggttgtgagttaaaaaaaaaagagtcatccttgttgactatttgaagatgagatgtatcctcttaatctttgttagtggtgactgtgtagagatttcattcctggaatactgtgttggttaaaactcagcaaagcaacctcagctgcttgcaaacttgcaaatcctgcagtgttaaatggccaaaatgctactatagcaattttttcttcagttgaattggtcagtttttgccaacaaggatgaaatttacatgattctgaatataaacataagtagtatgatcttgcatcagcatactgaacacggtgagaaaccagcaatcagaagtacgaggctcaggggagaaagcatgtaatgtggtatagcatgcctcagaaatgaaaatctttgatgaattaagaggaggttcttatagttcccaggattttcccaagaagttgatttgtaatccacattttaaagtaacacaattaacttttttatttgaatatgtaaaacaaaataattctatgtttcctgtaggactctaggcattttatattaaaattaacacgaagtatgtatttacctttaaaaaccatgcaagatggcaaagcatgaaatgtaaagagaaaaaacaataacaacatcagagtagaaagttataattgttaattaccttcctctaatgtcccacagtattggactatgggagcattcagggcctttattcactcttaccagcaaatactttaccaagaatagatattttcatatttttttcttcatagcaaagtaatcatatgccaggtactttgtatcttttatgctttcttcacctataaagttagaatcatctaacatagtgacatcataaattcagaataacaaaagcaatacaaataattttaaatcaaatttttagtctatcctatcaaatattgtcatagtgaagttttgttttttgtttatttaaagattaaagccactgtgactttctaaccatatataagaaattatatatttatgtattaaaatattcttctcctttgtattggagcactgagaattactggtaggattgtggatgaaaactacaagtaaaatgcttaaagttgttgatatggtgagatggccagacaagcttttgaaaacatgccaaatttgggggctgtgactttgttttcattctgctttagtctgataaaaagatgtgaaaagaactaagtacagacaactgtttgccccattggtgtagtttattgatacagtttattgtgtaattacattggtatgtggtgaaaaaaggctttcagaggtagaaggctcaggctggagacttgaaagtggtactatttaaatcagataattgagtctctgtttccaaatctgtaaaacagtgttaagatataaaatatcccatacaattgttgcaaagattcagcaaatgaatttgaaaatattttgcaaactgtaaagcagcatgtatatgctgctatcaattttttgacttgttatttttgtagtgacaaaattatttcctgatagagtatgaatttatctctgtagcagaatccactatatatttaggatagaaaagtaaaagatttttataaattgccatgaaatgtcacaggctgatttgcattttctggtgattctatacattaatcactgagtaaccttcagttttccaaataaagaataaagagagtggtgatgacatttgtaaccatctacagaggaattatttaaattcttcacagatggagcgatatcaagggtaaatcattatagccacatttctaattttaagaagctttgagggtgtttgtggatggtaggaagtaaacattgttttgcatatagaattaatcatagactttgcataccacaattccaaatcctccagatgagtgtagagggctttcgagacaccatcccctaaggatcgagaaattcataaaaggaaaataatgttatgctacatgtaatatacaaattgagcaaattggagcaactagaatagtgacctttcaaagaagacaaattagattctgtatgcctcagaatttaatgagtcttagtgctttaggaaggatgacatatgacacatattcttaattctagtctcacaagagttaactttattatttctcaacaagatgaataactcacttcttctttggtcaacataattctacctaatattctctgtaaactagctctggaaatacatgcggaccagtgcttgagatttttagtaaatgtaaaaggtatctgaatggttgtataatgctgctttaaaagagttttaagggttggaacatggtcactgagaaatacacaagaaaatctgttaccaaatgtgctctgaattttgagatgagtaacccgtggaagtattcgctatgggtaacaccacttgcctaaaaccacagaggcaacaaatggcatagcctttctggtcaccaaatctaaatgattttctccaactgaaattaaaaatgtgtttcttgaaatgtactttttataatttctgaattacaaatattttctttatttttattcccatttgctttgtaagtagttctaaattaatatattcttagtaactcctgagttcatatggataatagtaaaaacacaagtaaagagtaaacatactggtaaacccactaatcataattgacaactaccacttgtcatgttcaaatctcattatcctgtgatgttttttctgtttcttgtatcttcttcctaagatttagtttgaaaaaggaaaagaaaatgtatttaatgccagataaataccaccactagggaacaaaaaaaaggtccatttttaaaggactcctggaggccaggtacggtggctcacgcctgtaatctcagcactttgggtggccaaggcagtcagatcacaaggtcaggagattgagaccattctggctaacatggtgaaactccgtctctactaaaaatacaaaaaaattagccgggcgtggtggcacgtgcctgtagtcccagctactcgggaagctaaggcaggagaattgcttgaacccaggaggcaaagggtgcagtgagccgaggttgcgccactgcactccagcctgggcaacagagagagactccatctcagaaagaaaaaaaaactcctagaaatcatttttgttaccatgtttatagcaacacaatagtgaaataggcaaatgcatttagtcacataacttggttttcttgggccactgctttctttcctgtgggagtgggagaaggtacaagcaggagagacatgatgcctttggactgctctgttaccttcagttttgtaaggctcctggctccactgaccagattatgctgatagataagagataggggactagttttctaccttgtgcctgtcctggccaagatgcaaaattaagcctactgttgaggaagaccagaaagttgtttattgcaatgtacccaggctcccagacttaggatgttatttaccctccaccgttatgcagcgggaacttaagatgttaagaacgactcttaccaacatctgctttgttatgcattcattctgcctgcatctttaatttggggtgatagctgccttcagaagctttgggagccgttcctctcagtaaccaaatactgtcccatgggggacatttcctctctgcagctgttctgtgtagggtctcaacagtgtgctacagctggctgtatgcaatgtagtgccttgatgtctccctctctccttgcttttgcagctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagtgagtacagggccttggcctggattttcttatgttactggtggtctgagttagtgattcaggtagacgcagcagaacattctagatcaatatggcaaaggtgcacatgcttataaaaattgttttcagatgtgaaccatcatatttacagggttcctgggggaaaaaaacttaaaaactcttccttcttccccatgtatatagggaggaaaaagaaattcattctttgcaggctcccttcccaactgtgtggcttggcctgtggcagaatatttagcagacttctagggtatatttaagagatttacctggtgtggatcttacctggtgcaagcagcaaagccaagtggaatgttaacaatctcctaggctgggatttggcaaaccttctgtaaagagacgtatagtaaatattttggactttgcaggtcagatagtctctctcagagctactcagttctgcctttgtaatgtgaaggcagccacagacaatacatttttttgaaatgcatgagactgtattccaataaaaatgcatctataaaaacaagctgcaggccgtaatttagtgacccctgtcctaggcttcaagcatcactgtaagagatgtaataaatgtgtgataaaaactgagaccagagtgccagagtgggcggggcaaaagggaaacagaacagtgatcaagagttgagtaattcatgtgtattgcatactcaacattttgcttttggtcttgtacatatgcacttaatagcactgcacccttaatccctgtagatcataagaacacagcaaaggctaagaaattaaaaatgatttagaagaaaaaattcttttgttataaggatggaaaatatttttacagcaacaattaacccattttatcacctgtgcagtctgcagttaagaaagtaggctaaagagagatatgattctcatccataagtacccaaagtgcagtctccaagagcaaagagaggaattgttctcattagttagcaatgacaaggctagaaagaatggatttaatttggagcaataagaatttagtttaaatagcaggaggaaaaggcagttaagaaaaaagatcaactggggattactaccaacctccaaaaaggaggaaaaggaacattgattaggaatctctgaatcagagttttgctaatgtgcaggtgtatagagagaagcagaggatacaatttcattgctggtctctggagttggagatggctggccggaatcatgcatgacaagcccagctcccacagcagtgcgcatgtctgacacttgctcttccagcatgccttggaaatgagagcagcttaaagtcctaggcttgagctggaagtcggtctagccccagtataagccagatcagggcaagactctgcttaggagcttaaggaagaactggttagagatgatcaccttcaaaatgtggtggaggagtcttgaatagagttgtgaacttttcaattttttctcagatgcttcaggaaccatatggtgctatgagcctgagctaacacattttaaaaagctatgccaaggagcaaaaagaaaggcagccatacttactacactttatctttatttggcctctaagaaccaccataatttacaaaactctgtgagatttatgctacatataacttaatgactatttcatggcagctataactaggctgttattaccagctcacttgcatttccacagtgatttatcttctttttttgttcattgtgactgcctaagaaaaatatgatttggcacagacatgagcatctttttgagtcaaatagtgtactattgttttatccattcctgctcattcatgttttgtagaacatctccacttttaagagagaggttttcctattttctgatggtttacttgaaattagcagtgttttaataaaattgtcatgcagattgtggtaacttctaggaggaaccagaacattccagtatattttaatataccattataaagctctgtcatttctttggggtctttgaaaagtgaatactctaaacatactttgagattcaggtaacatccattgtgtgcatttattagtgtgtgtattctgtataagcatacccattagatttgacatagtataatattattttctttgtatgagcaaaattaccagacattttatatcaaaatgtaaagagccccctgggatactgtagacacttgggtgatacagccgattgcttaaacgttctgtgaaagcccagtagattttcctccaaatcttagattaggaaatgatgtcacctgaccctttcagaaaaaaggaaaaaaggatcctatgctgtggggaatctgtgtgattctagagtgaccctgacatgttcatggccctctcgagcaccaggccccttcatgggtctagtcatttgaagccatattttatttccttgcagattatctctttgtctactctgaagaaggcaggtttctcatcatacttgaaagtaaagaaatctaagtagaagactaaatggcttaattatgaaaccagctttttgttttggacatttaagtagatacatcagggaaacaaagccataaatacttattaagatacttttataacttttacaatctgtaaaaggtggttctgtttgttgaatggtttgttttcttgtactaaagaaaattactgaagagagaaagagctttggggccattaatgaaagtggaagggattgagcataaggcagaagatgctatttctccttacagtttgcctagaagagaaacctcctgggaaaaagaaaaagtgatagaagacacaagggggagatgaaggcaggtggttttctcagtttttttactgctataacagaatatttgagatttggtaatttataaggaacataaattaatttctcacagttctggaggctgggaagtctaagatcaaggtactggcaggtctggtgtcttgtgagggcccagtcttcacctctaaggcgagcactgcatcctcaggaggggaggaaccccatgttttcacatggcagaagggcagaaagagtgaacccactcttgcaagccctttttaggatagcattaggcagagccctcatgacctaagcgctttccaaaggtcatacctcccaacactgtggcatcggtgatcaagtttccagcacatggaattttgggagacatattcagagcatagcagcagaatatatttgcagcagaatatattccagggataagggaagaggacagggctctgcctaccgatgtgcttcaacaagggattacatgggggcaaagcttcattctttgaatatgagtgttctttataaaataacaacaacaataaaaacctaaagtactttggtgctacttgtgagtggtggtcaggctagtaaagttggtcaaaaacaaagtacaaactccaaaattagccagcggtgtatatgtgtgtgtgtgtgagagagagagagaaagagagagagagagtgtgtgtgtgtgtgtgtgagagagagagagagagagaaagagagagagagtgtgtgtgtgtgtgtgtgtgtgtgtgtgtgtgtgtgtgtgtgtgttggggagaaggagaagagacaaagaaagtttgtatttttttaactttcaaagaagacaattcctagaaattcctgaagtgttttgagcaacatcaacattgtcgttggaatatttcctttttacccccaagtggacttatttgaaggaagagaaaatgctcttccaagaacactagagagcctgaccctggggtaagcacccactctagaatagccccagggcaggagtggcaaataggcttcatcttgcctgaaaattctcagtgcctcactctctctcttcaagctttacaccaggaagatttatgagaacagcgggcaaatccacaggtaggagatctagcttccattagtcatgtctgccacatgtgccgatgtgaggttttgtgaacgtgcactacacattcatcacatctgctttaagctccacagtattcctccacacgtgctccaattttcccatttcttttcctttgttatcctgaaatccctatgtattaaaatttctttggaaaagcagtatcttaagctcatgttgcactgcaagtcctggaatgatttatcaattcatctgaagtagtcaatcttattgccatccttctcataccagcctaaagtcagctcctgtgacagaatttaagttttgataggagagttggacagaaaggaagaaaagtggccatggctagtttggggatgtgcaatgttgtgtgggatggtagaaatgagtgggaaaacttgggcaaaatgaaggcatttgtgtcctagattgagtaactggggcaaatgaagaaagggtcaccaagacagttgagtgctatgagcacttttcttcttttatgtatgtattttaagttcaggggtacaagtgcaggtttgtaggcttgttacataggtaaactcgtgtcatgggggtttgttgtacagattatttcatcgcccaggtattaagcttaatatccattagttatttttcttgatcctctccctcctcccaccctccaccctcccaaaggcccagtgtgtgttgttctcctctatgtgtccatgtgttctcatcatttagcttccacttataagggagaacatgcagtatttggttttctgttcctgtgttactttgctaaagatgatggcctccagctccatccatgtccctgcaaagaacatgatttcattcttttttatggctgaagagcacattttttctatttcatgatttgctcagattgtctttcattctggccaagggagcagaggctcttatttctcttgctactttcttttaaacctaaagtcttcccactcatctgggccttataaaagttaaataggttttgacaaaaagtgttgaacaacacaggcctttggtcattttaaaaaatcagagagggccaggagataaaaatgatttagaaattgcttgcttcaaattaactaacatttctttgtttttggttcacattccatgatgcaatattttctgaatgaattataaactgttatattaataaaattttgaattaagcatgtttgaaaaaggcaaagagatctttattgaagtatatgtgcatgaaatgagattctgtagagcgagggtgtcttagggtagaggaattttttaaaatctatttcaaatgttagtttccttccattgaaatcgattgttgaggaattaaagctcaattttggagaaaagctgctatcgcttgcgagtgacatctgcctattgaccccacatctaggctttaaggagcggtgtcatgttacactcaccttcatttatacaacagggaaaaaaaactgaataggactagagaagagattggcatgaagtgcttgttattactatcatgaaactcttgtcaacctctttcaccatctgcaaaatagaaggtcggggagaactgggcaataattagcttccctttatgtagttaatgctgagtgtaaaaaagacatcctattaatttctttctctctgtatgtaatttacagtaaatcctcttggattcattttttaattatgagcctttcaggaacagtgaaaatttatgtgttaagatatctgttttgtttgacaagaatctataaccttccccaactatttccttcctgacttaaaatgtagattgttacatacacgaggatgaggggcagacaaagaactgctgtccagactgacccccatttcacggtggcaaagtgttctccttccaaaaactggaactttgaaaacagattgataatattctatcagtgtcatatttggggaaactggatatttattaagtttcacttgtatattattgtttttacatagtttatagcacccaacgagagtcctgtagaataaatggaagtaaagctgaatgatgatgaatggtctgttcctcccatctattgcatttataaattgccagcctggatgcttcatttgggctgtctctatgtgggatatttacagtaaacgatcagcatctgctgggatagtccttagtaaggttaggtggctgttagcttagattcatctctgggtttggccagtgacagaattggatttgagtcaagaactgtatttggggaactttccagtggagtacagaagaatgttggtgtttttgagactggtaacgcaaataaaaaaggaacgaacaagaaaacaacagaggtatccaacagatgcaatttcgtttcccatggagtgctgtgcactgcaggttgactccgtatttccttccatcgctatttgttcttagtgaaaaagacctctttgggatttctgagcttaggagtttttccagatcattagccacttatacggagaggacctgctgggcattgtctctccagctttcagcttagccatgctatcccagcagagtcggagaagaaggtgggagaagggagtagaagtgatgattggatgaagtgactgcttatgtaacctggactagaggcagctctctgcaggggagctggtgtgtgttttctcagatctctattattcccatgatatttctatctaaatctgtttactttgattccacacatggttttgagaggcagcaagccatagtagaaagatgtgcttaatttgaaaccaaaaaaaagttggatttgagttccatttttcaatccatttctgtcagtgagctatgtgactttcagcaagtcattctactacttggagcttcagcttcctcttcttataaatgggcataaaatattatgttgcagggttttctcaaagatcaagtgaaataaaatatttagaagctgttcattatcagcaaaacactgcactaatggagaatggtggttttcctaataaaatgggtgctgtagaggtgatgactgcattagagaaacatatatagaaggaaagttttagtttaattgtttgtataagtctgcttggactttttaggcaaaattttttaatttctgtttcatctgatcaaatgtcaattttatgaattaaccagattcacaatgaagacttttggagcatctctttagcataaagtgaagaagcagttacctctgagggaatttaggtcatgaccttggttaggtcaataggataagtgaccctatagcctccttggtgtctcattatatagcgttgtgtctctatccctgttacaagatgataatgcattgcgcttctattctctttagtataagcttccaaagggctctagactcagcagtgaaattgtcgcctgccttgccctgaagtttattctttaattttatcgaccatgggaaatgggaatatgccactttgcatgaaaacagggaaagaagagaagaaggaagagagggaaagaggaggaggaaggaggaggagaataaggaaaataaaagagcaagaagaagatgacaatagccatgaccatcaccaccaccaatagaagtagtagcagtaggaaagcaaaacctttctagataggcctagtatcaaaatggttttagactctccttgggtaccagataaagtcacaaagagcttggtcgtatactcggggatagagcccccacaaaatgttgctagaaccaaagtcctaatggaggtacagccagactgtggggagctaagtaggtcttgccaccaagtacactggaaacctaaaaccagaaatataaacagaaatacttcatagatttggattccccaaaatatgaaggaaaagtgaattataaatttactatgcaaatgaaatgtacaataatgcaatcataaaaatcaagctgacaaagtgtgtggaaaataggttatggctgataggaaattatgagaaggaaaggccaaatggctatatctttctcatttatggttcatacaagagcccttagactgttagttaatgacagttatgtttcagaatcctcaatgcatacaaataagaattttgaaaaactaagatgaagagaatttagctcctgagcatcattcattttatatatatataaattgagtttttattatgtgtcaggaaaagtgctgtgtgttgagggtactgtgaccaaccttggcttgcatagcataaacaggcttgagaggccacgacaattacaaaaacaagaaattaggttttctactcattatgaggtgatgtatatacaactcttgcacaactcctggcatatagtgagctttcaatcatggatagattttgatattattggtactcaaagatttttcttcaactaactcattttaactcaaaaacttgttatattttattttcctaagcaatgaataaactttaatcaggcctctgaaatttgaaatgaagcaatataaaattctaaggagctgggatattactgatttaaagacagctgggtggcacatatactgggttattgcagttatcaagctagctgaataagttctgaatagcagaagctttttagatatatgaatctaaaatgcaacaagcaaggcaaactctaagtgccatcacgtgaatgctggggctcacaggacttaatggcaagcctcccttaacaccatcagttggatgaattatctcattgacccaccgcttacactgctccttgtcattactcctggggtattgttcagtgcaacagggcaagaaataactcattgactccctgaagctatagatgatggattttagatccctagctgtattcagaaggcataggagctcagtgtattgatgggggaattcattagccacccactccacagaatcagtttcttagatcctggtgctgtcactgctgctgttgcaacttgttagtgtttcagggacagacgtcagagggaactgtataactacattagcctcacagatagtaccgacagccagacctgtcatttcctggcctgcgatgacacctctggagcctagaatcacttaaagatatttagataggccctgttgatacgaccaagctaaccttcatcctgaaatcaattcatactcaggatgacaggaaatgagttgtcattaaggctcatattctatttttgagtccttagttaacctcttataattcagtttatttttcctcctccatttctgtaaaatggcaggtaatttaatgacatagattattacttcctacatttactcgggagcatgtgtttcagagaccatcttacattgataccattactatcactttccgctaatattgattgacaaaataccaggtaccagacactgtgcaagaactttgtttacactgtcttataatgagctcatgaccactcagtgaggtagtcactattaatatcctcattttataattggggcaactaaagtttgaagaagctaaagcattttcccaagatagcactactaataaacagctgaatgggctttcaaatgcaattctgacccttaattactattacacccctaatgaaagttttagagtagaaagcatagtggtaataattttaactcaattcatacttatgaaacagcaatttacttgggattgttggagatgtgaagaaagttaatatctagccggggggtagaggggaatgaaaatcatatgtacgaatctttttaaaaacagaatcagctatataccaaagaaggtaaaaatactgctggttgctgagatttttttttttaatgtacatagatgggatgggacagattttgactagtggaatctgaagaaagagcatacctgatgaagataccagcatgagtgtcatatcaaaggaaatacaggatgtgttctcaaattcatgaattcaattggaccgtaatgaatggcataagaaaagaggcaggtaatatggattagcacaaagaacatatgatttaggggcaattggtctctgattcaaggtctagttctgcctccaactagttctgtagcctcggatgaattatttgactactccgtaaaatgcagatggcaataatgccaatttgtagctctgtgaatatttataacctatggaaaaatgcccagtgaattatctggtacatagtggatgttccattaatgatagccatgttcttgtgttttcttcccaggtactttagggacatagtgtagaagatttgagttttataccaatgatcgattgtttctgaaagcaaaaggaagacatttaaagatttttttagaagaagatgaaatgcccagcacttaatttttagggagattattttggctctgttaaaagaatgttgttcagtgggttcaaggaaaacagcagggtcttgagtaagtgtttctagagaaacgtctttaaagacttattctatgatgatgcatataggaaggtaatgaggataaaaccaaagaacagttcagagattgaatcggcaggtgttgtcagcaggttggattaaaaaggagagaactgagaaatgtctagattgggaaggttgtgatttcattaccaaaaacaaaacaggggacagataagtaaaacagataagagtttgactttagtgatgcaaaacataaggcatccaagagccaggctattgaaatttccaattggaaatacatgatgaactcagaggagagataagggctagaggtgggggcctagagaattcacagcttggcagtgacagtggaaggtttaaggagtgctaatgtctcaagggagatgaataggaacttgggaaatatatacatatttttatatatttaaatatatattattttatatatttatacaaatatatataatgtatattaaatatatacatatacaagataaaggaggaaaggaagagaactaaaaaggaaaggctagagggtaggggataacctagatagtgaagttttacagaaatcaaaacaaatgagagacttccaaacacaagttgttccagagctgttttttctatacctgttaggcctctttcatctgaaatcagtttacagagatgtcttcttcatctttattggtatttattatggtgtaatctttgccacttcagtcctcttaccagtattctgcatttcttctctgtcacgggcatcattaactttgagccagaggacccagcatctactcctagagagctgccaccaattagcagttaccctatgtaaatggtagaggtgtagctactattctgccaccctcgtaatattgtgggaaaaatccaatgacagaatgcaagtgagcatgccgtgtcatcattgaaaagtcctacaaaataaataaagtcgtttttatatcaatattggtatacctaccactcagcacagctcttggtacctaaggagatggtgattggagacctggaaatgaagaccaaagagatgctgagatggttgtagtttccaataggaagattagcaaccaggcaagtggcagatcagagcccaaatgtgagtggctcaactgctggaccctgtaagctgttgtggttctcaaatgatgtccttatcttgttcatctctcagctcttggcacctcaccttttggagcttcagtttggaaagggcaattcggatttaaatcatactgcagtttcctaaatagaacaaatcccctgatcctagtgatcatgtgcaatgaggcatggaatctgattacccttatcattatcttagcttggatagctacaaacgttactaaatggttatgaaattatctagccctttattaagtgcaaaaggtagtacttaggttactaaacttttttgaaaataattccgctggctgacttttcatggctaaaaacccatattcttatctgtggagtgtatctttttgtaatcacatctgtgtttgctgtttttttaattgtccaggcagtatgttagccattttgtgtctatcagcccatttggtcctgacaacactgttaaactagtggcattacctctattttatgaagtaaaaaattaagcctaagaggattaagtaaccatttgttaaaggtgttaaggaaagaaaagaggacttagacttaatcattgatatgtttgttttcagtgtcatagatatagatatatactgcttttcataattttctattcaatataatataatatatatgtaatatatgttggatgtgttgaatttagcaggacctgtaatatttatttaaatccacagttaagaatgataaacaggactagagaatggaacacagaattttggctaaagcagcatacataacttaaaataagtcactttctttttggattcaaagaaactcattttacattacattttttgcttcccagtatttgtttttctcaatgacgttaaggcacctaattacccccaagccactttcttaaatactcctatgcaaaatgaaaagattggcctggagactaatctgaggttttgaatgcagtgcggtagaataagtgttttagaggtaactttagttcccaaatctcaataaaaacacttccaaatttagtgtatcaaagaaaagattattggataatgcattctcatctttcggtgtatgataaatgccatatcagaagtcctcaaatactcttgattaaaaacgctaaatgatctcaaataacacaaaaacccatttattcctactggagtcagtatttaattttctatatttgtaatttaaatccagatgtgggtgtcttcacagcgaccatggcctgtcatcccttggtctgttagcttctaatgtctagcagcagagtatagtaaatacttgaaaggtagaccttcacactgaaaatcacatttattgaagtgggagcagattccatttaaattgtcccttacctgatgcctaattcctaaggttaacaggttttcatgtttgctacttatatcagcagtactggagctggtttttttgcatggctaaacagcaaagcttaaattcaatactagagcgtgaaagaggaaaatgagttttggtgtgacgtgtgaatgacgtggttttcctaaataccatgaatgcacaatgaatgatccacaaagcacagccgcctcttaaaagaagacaaaaatctccctgaggtttagttgagaaaagatacaggagcatatagcaaaaactacaacatgatacacttacgtaagatgcaggtgggaagaatagaatttccaaattaaaattagccaggccagcagaaatgagtaacctaatgttatggcttggatccgtgtccccatccaaatgtcctgttcaattgtaatccccagtattggaggtgggccttggagggaggtggttggatcatgggagtggtttttaatggtttagcaccgtccccctagtgctgtccttgtgatagagttctcataagatctggttgtgtaaaagtgtgtagcaccttcccctctctcttcctcttgctccagacatgtaagatgtgctagcttcccctttgcctcctgccatgattgtaagtttcctgaggcctccccagccatgcttcctatataccctatggaaccatgagccaattaaaccccttttcttataaattacccactctcaggtatttctttatatcaatgccagaaaggactaatacacttactttcgtgaaaacaacttttctcttaaccacctcctactgtctgtcaagtgtagttctaagtgcttgggatccaagagtgaaaaggatagacaaactccctgtcctcatggtacttacattctagtgggggagtccttaatgggcacaagcaatcagaacttcaatttgcagaattttgtgaaaatgtgctatcatatatattttattaattaactagttaacaggcagggaggatctccttcaaacttttgttttcatctttgtatttttctttctttgccaaatttccactttaatctctttcattctaatatgctcacgagtcacttaatgaggaggatatgttctgggaaatgccctgccaggcaatcttattgttgtgtgaacatcatagagtgtacttacacaaacctagatgttatagcctactacactcctagctatatggtatagcctattgcatccaggctataaacctgcacagcgtgttcctgtgacgaatactgtaggcaattgtaatgcagtggtatgtgtgtagctaaacatgtctaaataaaaaagcacagtaaaaatgcagtattgtaattttatgggaatgtaacaacccagtgggttctgtttgtccactgcccagatggagccaatttatcaagacaggtgaattgcagtagagaaagagtttaatacatgtagagctggctaaatgggagaccaaagtttgattatcactcaaatcagtctccttgaaaatttggaggctagggtttttccaagacagctcggcaggtaggggtctgggggatgggtgctgctgattggttagggatgcaattatgggatctggaaaatggtccttatgcactgagtctgcttctgggtgggggccacaggactggttgagtcaagagttgtgggcccaggtgggggacatctgattgtcagaagtgcaaaagcctgaaatgacatctcaaaaaggccaatcttagctgctacaattagggatgttcattataggagtaagtgggaaagttgcaaatcttgtgacctccggaataatggttggtaattatttaactctgcctgcatcttagcataattcaggtgtctctcatcctcttaacctggtggctttcattagttttacaaagcagtttagtttttgtgaatggttattatcatttaaactctaaactaaatttctcccaaagttagcttggcccatgcccaggaatgaccaaggtcaaagaagtttggaggttagggcaagatggaattggttagatcaggtctctttcactgtcataattttctcactgttatatattttgcaacagcagtttcaggaccaccttcacatactcagtctatcattaaccaaaatgtcactgtgttgctcatgactgtaatcaaaaaagcacagagagctctctcgctatctggttctatttctaccaccctgacaaccactatagtttgttttcaacaccaaaagaaaataacaaaaaaatagcatcttcaccctcgattctagtttcttttttcttgaaatgactatggccatttctattatttcattttgaaattgtgcagaattccttctgaacatccatctacatttcacagacaacaaattgctaaaaacacctaaacaccactaacctgggggggagaaaaaaaaacaaccaaaaacaaccaaacaaaccaaagaaaacaaatcaaccaaatgaaaacccaccctctctggtggaaagactgcaccatttttggtaaagactttgcaatcctgcctagactggatgactgcctattgccctaacactttccttcctacccccagttatttacaagatcaccccttatggtaacagtattagtacaaatgaggtttttccctttacttaactgaatgctagaagaaacagaatggaaccacatgttccctttgattcacacccaaacactgcaaaacacagagtattcgcttcctttttcaagctgtgtgtgcacattaaacacatgcaaacattggactgaaacagacacagtaagtcagctctaggggaaaactatagaagtctttttattttgtttctctaaatctcaatcttttatttaagctaggtctttgcagagattcaaagaatgatattttgtaatggttctccaaagagcagttagatgtgtctcatccaaatttgtgtatttaccttatcatcacagatactgttctggaactgggaacttagcattagctctcttcttagaaatgactattaatttttgataaaaagaataaaaaacaccacattacataatggatataagagaacatagacggcatgataggaatattctgcctgtgtttccatgaattgcttctttgttaaaaagtgtttggtataaattaggccagtggtgtcccagcactttgggaggccaaggcaggaggattgcttgaggtgaggtgtttggtataaacagtatattaacaaagaattctcctatggtataaaccctaactctagcaggaagatcaaatttctctttgaggcatgcagtctgagctccagtgactctctgcaagagaaaagctgatattgtcacattgtgagtcatagtgactcccaaggatgtatttgtgtggatgtggttggtcagaaggctttgtgtgcactgtgacatctttatgctgcagatgccaagatcacagggtccacacagagcagttcatttcacacagtgggaaatgatgcgtgtgtgtgtgtgggtgggtgtgtgtgtgtgttttaaaaaacctaaacagagcaacactgttctgtgcactcaaactctacagctaaccgccaagggccatcttataaatttggacattgaattgctaaaatttgaaaacacagccactcctattcacactctaccatctggaaataaaccctaagtcactgtgggtgtccatatggaagtcactgttctgcttccttttatcttcatggtagttcaaggttcgatttcctcctagggagactttctgttgttcccattgagccagctctgctgtccccactggtcacgaaccggatcagtacatggagattcctgagcatatgcagggcagcggcatgagagcatctaaaatagagtcattcccattgccccagcacatccttccttcctacattcctgggagaaaagagcagaaacaaaggcttttctttcttctctcttttggatgtttggtgatttgcatacagaagttaactcacttcatctactggattccaatcattcccttcctggttcctgatcttagagtacagggtgcttcttgccttccccttgtcaatataagggctttagaaaacgtgcccagctggtattctttaaacctcctccaacgcacaaatatatttttaaatgcagatatttcatatacaagttgatatttctagtttctttttgaaaatcggaaggtttaactctactgggccagtgttattcatagcattggtcaactggagctgaggagccattgccatttttatggatattcttttaagccccccaatctccaccactccctgtcacctcactcagcttcatccatctgcctgacccctggagacatttgattttgtgcttcctctcacacagaacttgtgttcacaatttggggtcataccttcacatattatatgtaaacagcactctggaacgttttcaaagtcacagctattttaggtatttagtttagaagaggttagaagttgacttttacattagtatcttaaaggaatatatttgcctgctcagaaacatctggggcccacatattcagatctttcgtacatataatttgctatatagcataacacattgaatgattttgactcagtagctcgacttattttttgtgttcttttaaaatctttcatattaagcatagaattgtaatttattgatgaatattttattttctgagaaaagttggttattattcttaaaatacattacctataatgttcatgtttcctatgttttaatatataatattacaatattgatgtgtcgtgattttttttggttgttctctaattaggggtctttatatgaatctctgattacttagcagttctctgaagggggcagtctttcagagatgcatttaagagctctgaattctgttaagaatattaaggaacacaatttttaatctttactttttactccagggctttgggctgtctgtatcaaaatgcttcagatacttcctctagggattgctttgcctgttccatccttaagagagtaaagaatttcttctccccaccaccccccaactcctgacaatttcagctaaatttttttcttccattgctttaggccattgcttcaagttatatcaccttctgagactatgaataattctttcccttcaattatattgttaccttgaaggtatttataggctgtgatcaaggcccctggagtcactgctttggcagactttataaatttagctcttaccacttctcctcacattttttatcttccagcctttgtagcactccttttgtgtgtgtgcgtgcctatctgtgtagcttctctgatattttaatatccttcctaaactagggaggtcagaatagcacatcatattccaggtattactgtgagtatcagattttagagagtgaaatcaagggagaggattaccttgaaattgaacttaatctattttgtgactcagaaaaatagacaaaatggtagaaaaagctaacggggcactgtcaacatgttttcatatattttaacgtactgttagagcaatcctggaagcttaagggggaaatgatgatttttcttagagagaattctggcttccattagatgcttgaacgtgtcctttagagtaagattttctttacaaatccaggcttcaaatatggctatgtaataagatgggttttttccatagtacatgagctcttaaatctgtattattgttattattattattattaatattatcagacctgtctttgtggcttaaaattaagaaacatcattaaacatttaattttacaatgaagaaaacaaattgctacgtaaaccatcttgctactagctttaagctctagtccaggtcattctgcattttgtcaatatagtaaattgagtaacagcctctgagggccctgcaaagagccaaggcccaatttaactccctagtgccagggtctccaaatgtttttggttgtctatacatactagaaaaaaattaactctgcaccaattaaaaatatgtatatatgtatgtagaatacacacattgcttatattatcacacatacagaaacatcaggcattttaaaagataagattagatacatatatatcccagtattattccctgaagttcccatgaaccaaccttggcacccctgtggatgcccaccccaacttggagaccactgctgtggtgggaaaaccatggtgacaaacggagccaccaccctcagcagttcccaggaggaaccccagtatcaatggttatgtactgcagagcctataagcgaatatttagttcagacactcattttagatatgaagatatggaggtgcagtgacttacctacctatggttacagagttggatgatgagaaagctgggtgtaaaatgccagccttctaatttatcagatttcaacacatgcagaaaatacatagtgttctgttttagctggaatctcaggaaaatggggactgaggtcctgaatgaatgatgaagaaggagagggtgaatcaatttccaatcggtggtcttaaaggtgaaatattgttagcctaagtaatctctactcttttgtgtcccttctattaaactctctttacaggttctctctctctctctctctctctctctctctctctctctctctctctcccacacacacacaccccaagataaaatccaaagcttctgattcaatagccaacctcttcagcaagaagagcaaaggttctgcagccagattgcctgggttcaaatcctgatcctatcactgaatagcagactttaggcaaattatttatctatgactcagtttcctcatccgttgaaattggggataaaaaagttccataggggttgatgtgagcattaaatgacacctgtaaagcactcggctcactgcctgatcccacgctaatggccctttatatgttagctatttttattattttattctaattcttcctaaaagcttaaagcacagtccttcatatcactgcatcgcatttcattttgtaacatgttcttgtgctacatgtttcaccatgtgctacatggtgaaaggcattttcctacccgctttacaaaaacagacaccgaggcccatgtttagggccaaaatcagtgctgaatgccaggacagactcccaattcagtgtctcgtatcaaactgcatttcctttcaagatgaaaattgttactcaaaaccctatgcagctgggcgggaacacagattccatggtttcctttttcttcctgtttccccaaagcaaagcatctcctctctttgcatgggggatctatccctccagaagtctacccagcctgaggataatggcagctgcagggttacaggggtaactgtccatctgtctgaattctcagttgtgtgagagcctgtgttacaaccttagtagcttctgcacctcactagcttttcccactcccttggagtgcttccattttctccagctttcggtatcagggagtgttattaaatgataaggagctggctggctggttgtgtattgtgagaggctgagaaacaatgagtgttacaacacattagattgcatgttagctctgattttgggaactttgtatcacagagctcatcatgcaacaggactgcatctgggatactgcctcccttccccagagggttattaatgggccttcatacctgggaggacagattacaggagagatgtgataattagagatacttcactgatcataagcaggcccccgagcaccaagggctagcagctgtgttacacatatgaggcaagctccatgctccagagacaaaagtgaagtagaatttgctgcagtgaccttacctaaaagaggtcatctcaaaaatggtcacccatggacattgattggcaattggtttgaatagagaaagagtgttctgagctgaggatcagaagacctgagtttcatttctagttctgccatcatagagctatagggtcttgatgaagagtcacttaacttgtgacagtttttttatataagaaaaatgggagctacatatgtcttacttatcacaagagattgcaactcaaatacttcttcttccaaggtagtagggtggcaacaagagtgtgtgtgtgttctgacgataaaggaaatataagaatattttgaagcaaaagaaggagccagtacaaaggcagaaattgacaacgcatgggagcagaagtggataaaattaaccaagctggggcagaagaaggcagggaagggtgagagaaaaacagtagacggcttaatgtcatcaccaccacaacaaatgatggtgataacttgatgctggtgatgatttggagctcttcctatggagtaagaaagaatgcaagaattgggtcattgaccagaaactctgaggaggaaattaaagaaaattcatatctaggtgtcttaaacttctcagtaaagaaagttttaagctcatcaatcaacaggggcaggggtagatttagggacttgaagaaagtataagatttttagaatgatctctttgggggatcccaaaataagtcaacaaggcatcttttcaatgttgtcttgatctcggagtcagaacaacttgggtttcaacctagctctatcttttttcctcctagagcacccttaagcagatagatgcccataccttacccatcagtactttagggttataatctatatcttgcaggcatgttatgaaaattaaatatgatcacatatgcagtgtgcataacatcatgtttggcacatagtagcctgtcattattttggaaaagtgaccataatgaaagagaatgcatcaaatatataggattgttaaataacaatgtccaatttagaagctgagttgtgttggcctatctgcttgcaccaagattaaataatattctttacaggtgtctacacctttttctctccaaggcatgtcttcagcctcagtgctttcatggctcatattttctcctctcatgctttcctacctgctcatatgatgaaccacatagaggaggtgattctccgaggatttataatgtgtttcctgtgctcctgaattggtgccaatggcacaccaatccagtcgggtgggcctcaaggcacaccttgctcctgactgagaaggaaaaaatctttgtggagtttgcacaggtataccaagtaattgagcatttgcattagtatggaaccacctactacagacaccgggctcgtttcactcaaaggatagcctagaataagcatgaaggacctcctttcagaatcttgtttatgtaaagcccttcttggatttcctctttattatattttacataattgatcacaaatgtgaacatctatggaaatgagttggagtataggcgataattaacctggaagggaagaaaacccttcaccagaagcaaatagatacccctgcaaatatctggtaatttcggccgggcgtggtggctcacacctgtagtcccagcactttgggaggctgagatgggcggatcacgagctcaggagatcaagaccatcctggctaacacgttgaaactccacctctactaaaaatacaaaaaattagccgggcatggtggcaggcacctgtagtcccagctactcgggaggctgaggcaggagaatggcgtgaacctgggaggcagagcttgcagtgagccgagatcacgccactgcactccagcgtgggggacagagcaatactccatctcaaaaaaaaaaaaaaaaaaaaaatctggtaatttctctttcattagaaagctccaagtgaggtacaaactcaattcaaatattctatgagaataaaaacaggcttatacccaaagataggcaataacaaatgctggtgataacatggagaaaagggaaccactgaacactgttggttggaatgtaaattagtacaatcactatagagaacagtttggaggttcctcaaaaactaaaaaattgagctaccatatgatctatcaatcccactgctgggtaaatacccaaaagaaagaaaatcagtatatcaaagagatatctgcagtcctatgtttgttgcagcacttttcacaatagctaatgaatggaagcaacctaagtgtccattaacagatgaatggatagaaaaaatgtggtacatatacacaatggagtactattcagtcataaaaaaagaataagatccagtcatttgcaatcatatggctggaactagagaacattatgttaagtgaaataagccaagcacagagagacaaatatcatacgttcttacatatttgtgggatctgaaaatcaaaacaattgaactcatgggcatagagaatagaaggatggttaccagaggctgggaagggaagtgggggttgggggaggtgggggtggttaatgagtattaaaaaaaaaatagaaggaatgaataaaacttatctggtagcacaacagggtgactgtagtcgataataactcatctgtacattttaaagtaaagagtataattggattgtttgcaactcaatggataaatgtttgaggggatggatactgcattcttcatgatgtgattattgcacattgcatgcctgtatcaaaacatctcacatacttcataaatatatacacctactatgtacccacaaatttaaaaaaaatgaataaaaacatccttcaaacgaagtggctattttgttgcaaaaaataactattacttctcaagcactgactgagtgccagggtgtatatgtatgtgagtatgtgcgtgtgtgtgttttgttctgttttttctcttgtaaatccgtcaaagattgcaaaggtaggaactattatcctgatttttcaagtcagaatccaaaatttagtgaggttaagtgacttgccaccatgcttgctgctcacaagtagctgaggcaaaatttgaatccattttgcctggagcccaagcccaggttctttctcctaactgggatgtcctgatgcctacacaatctgctcagtgaattactcagcctccatgtttttctattctatggcacccctacgtcatactagccactagagtgaaaagtgataagatgaaaccaagagattgtcttatcagcttctccattcacatgtcttaaatgatttctacctttactaacaagagaaaaatccaggtacattctggggaaaccattagtgcttagttggtaaaatcttgagacttttatcttactagtagaccctcaacatttttccaaagaggcactaatgtaccctgtaaagaaatgacatttttcgtctcaaaaaaaagcaaaaacaaaaaagaaatggctacttttcaccctaaaataaaaaagtgtgtgtgtgtgtgtgagagaaagagagagagagagagagaatgaatctatctccaaatgccaatgagcatgatggactagtggcaagactttctacagaatatgtaatttggtttaggcagggcaatctcctttgtatgaagtaaatagtaaattcagttacagtatatataaacattaagaagaatcttcttctgtttaaatattgcttcttaaaatttgttttgctatttaaaaaattcattttgaagttacaagtgtctctcctaaggagacaattctctgacaaacataaccaactggcaattacaaatcataattgtgactcagaccaatattaagtgagcaccttcctgctttctcgtagatgaatgtctataagttgttagtgcacatactgaactagaaagcccacatcaggaaggtactgctctttttttgttactgttaaatttgcttggccaactcagaatgaatatccagatttctcaactcttgagttagtggatatataaactccaaaaaaattaattaaaattgaagtttaaattttaatactgagaaaaatagttgattagctagaaaaatcaccctaaacataattatatgtatcagtaagtcaaggaaaaaattaaatttgtcaataggtccctattctccagtgctgtcttttcaaagttactttgcaaggtattcagttttagtgctaacgtatcaatcttttttttttggtgggcgggggatgggggcagggtctcactctgttgcccaggctggagtgcagtggcgccatctcgccttaccacaacccctgtcacccaggttcaagtgattctcctgccttagcctcttgagtagctgggattacaggcacgtgctaccatgcccagctaacttttgtacctttagtaaagatgggttttcgccgtgttggccaggatggtctcgaactccagacctcaatgatccacctgccttgtcctcccaaagtgctgggattacaggggttagccaccatgcctggctaatgtatcattttctagaatacatttatcaatgaaattttcaaagaaccttattggtatggtgaattatgtaaagtctcagaagattacttttgactttccacggccagatactcttgactcacttctatcaatcatgcattggaaatactctgacatcgtcaattctaccgtgatctactcaagcatctcacctgtttccttccagaaagcatgttttaatgttggagattcattggctagtaaatgtatagtgtcttaaatgatgtcaaatgaagaaatgccaaaaacatgcccaacaggaacagcaaagtatttaccttcatgtgtaaaatgccagtgtgagatagcccaatgtgatattgaactggatcaatggtggggtgccagcacatgaggaatcgacattaattcaagttgggacacagaagttggcattgtgaagatttttaaattctaggactaaatggatgatccactgggaggcaatgtccagacagatcaataccacacaaaacgttaattgcttttcttggtgaatcctaagaaagtgctggggctttagggaaattgagagagatttcttttcttccccctccacaaaaggtaattaatgagtacaacagacaattcaaagcaagaaaatagaatctgaaagcttgaaagccatacattcagaatccatttagagatttacagaagggctttagcccagaacagtgcctacaggagctacagtggtgacagtgtctccttgatagatgcatcctggaatcttctactgggcaagcatccaaaaatatttgaacaaatgaggtatgccttccagcatagctgggtagttagaaaagagtcaaacatatagaaaaaaagcatagtgactgaagtcatcttaaagctagtttacaaatgtagtctgaaatacactctatcacgggatgaataggtatggattttattccaactatgatctactgtgctttctgggactgtaaaaagtgactacaccatccattaataatatataggaaggcagtttgggaatgtcaacccaaagcctcttcgtaccttgaaattcccatgcaatttggttacacagagtatatcattactcaggttaatattataagacaagtattagcattatgtttgaacaaaggttttcacaaggtctatattaactttacaaaggttctgctgtatactgaatgacaaaggctgtcacagtagcgaccaatttgttccaatttgcttacttctccagatctctctgtcagactttaagttccttgaatatagggtcctagtcttcttgcccatccttgtatacatggtaggtgttccatcaatgtttcttgaatgaatgtataaaaagtgtattttaattgaaatcttaacaagtatgcattaaatgtatagttggtgcttggtactaattctctcaccagtttattgaaatttgactatatttgagcttgaaatggtatacctacagatatagatcattaaaaccaaacaaaaccctttctttatgatatcaagagatttgcctcctaacataaaaatgaataatcactgtctaccctaatggattagactttcttcattagcctcctgtttcttctgagaaatggctacattttcagaaactctgactcctaaagggggtcagtaactctgggaagactatttctattacgtgaaaatttcaaataatctcctagaaacttgaaaactggttatacacagaaagcaaaagaggtgaaaagtgagttgcagtttcattaaacatggtcatcctccaacaccgtctttcttaccagccttgcatgaaacgtcattaagatgcatcttttatgcaagggaccaaaaagggtactacttttaaaatatagcaaaaacaggggttgcagttgcccttttattgagggtcagtttatatatgtagtctgatatatatttcatccagaaatatagttttttaaactttttatcgtgaaataattttagatttgcagaaaagttgtaaagattatatagtttctttaaacccttcactgagcttccactaacgttaaaatattatgtaaccgtgatacatggtttgaaactaagaaattaacatctgtacaatacaatttgctcagataatcccagtttttccactactgtcctttgtatgtgtcagaatccaatccaggataccacattttatgtagctgtcctgtctccttagtttcttctaatttgtgataatctacaaatactttttaattgaaagaattatctaaacgtatatttgtcagatcaataccgtcctttctatctttcctttctccactgaacttgggcgtcagtctctttcttggctactaactctaatttatgcattggatattttactactttgggctcattattttaaaaatctgcaagcagacacagtagtctaggactgttcctgaggctggagggccagggtatagcatgtgcgcaggccaccaaggccagccttgtcattgattctgctttgttaccaagcaactgagatcgctcccactaaagaaaaagaagcaccacttccacttcaaaggtaaatgtgttgaaaaaagaacagaattgacacagcttcctttatcccttaggtacaaggatgccatgcctagtcagagttctgaattcaggttctcaaagcaggaacagggagatgcagcagctgcagttgggaactcttctttctttctacattttttttttctttttgaaagtccacatctctatcaatccagaatcctaattacatatgatataaagggccctcaaaagacccattacccctgttaaagtatgtaaattcaggggcaaattatatgaataatggctaacatttattgagcgcttattacatgtcaggcactgttcttctaagcattttacatttaatccttacaacaaccctgtgatgtaggactgattattaatactattttacagataagaaaactgaaatacacaatagataggaaaattgctcaaagttgcacagctagtaattgaataatcttccaaaatcttttttatttaggtaatagtatttttgataaataatttatatattttatgaagacctttacaatgatggtgttattccatttccaccctagattaaattagcatcttgagaaaaagccataaacccagtgatcaaagtcgatggtatttattttatgtttaaaaggtgtcatctctatcgagtagtcaagtgctaaaaaaaaaaaacaaaaaacaaaaaaacaaaaaatccagtcaacagaaacttaaacacttgagggcaaacattgagcaatgttggggttttgttaccttgcactaattttgggtttaagaagggaaggaaatgatgttcgtaatccagtgttctggaaggaggagtgcttttggtagattaatttacaaagttttctgctgacaaaagaaagggaaaggaaaaaaatcagataataattccctttacaggcctaatttgaacttaattctctctctctctctctctctctcacacacacacacacacagacacacacacacacacacacgacaactgtgagctgtaaatccatggtcatctagttactagcgcagtaagagcagttgtctgatctgatcaaagagtgtcatgctccaaaaaatctgatctgtggtgaaaatagattccccctggatactatccagggattagatattttcagagaccaaaaatacagtgaagtgccctcagcaagatagaacacagtgtagtcattcttggtgaattggaaggattttgccgcagggctgtcattatgaacatcagtgatcattgtaagaatatggaaaagtgctagtgaataggagtcccaattacagaacactgggtgatacagcctttgctataattatagtgtgtttagattgatgggcctaatgagcagtgttccttaatctaaatgttgattttggagcgagttaaaattagaggtaaaactgtgatagtaagtttgtttactagattgactatgtggctccacgtagaattcagattagttcaactaacacttcctcagcaccaaacccttgtcaggccttgggctaggtcctggagacccaaaagcagatgaagtcctcagggagttacagcccagcatgggagagggcatttcaacggcattagtaatagcagtggatatgaattgagcctttgccagatgctaaacacttgttctaaaccctctgcgggtattaatccatttactcactccaccataaccccacaaagttgggactaggtgagaggggagccaacaggcctggaagactacagtaacttttccaagcttatatgtgtgataagtggcagagcagagcttaaacctggtccggaccttgggttcttaactctaaccttagtattccagagaagatttcaatatacagtagttcactgtcctgggaccaagaagaggtacaattaaccatgttgcctatgctgctggtgatgaagccagaacgtaaacagaatgatttatcctcactcctttgttcgtgaacaaaggaaccataatcccccatgaaccattctggcctctttactatcctccagacaggttgatcttgtttctacctcagagcctttgctcttgttgacctgagtgtcccatcccagataccgttgtatggcccttccactcaatcctttcccacctccctccaaatgttaccttattaatgaagacttccctagctcattctattttatctgcctttcttccttatcccacctccctgcagttccttctcccttaccctgccttactttttcccacagattttaccattagcaatactattaatttctttttacttgggtttttgttggtttgtgtgtctgcctccccacactagaacacaggctcccaggggttagtgactttttaaatattgtttgtcactgaatttccaatgcctaaaataggacctgaccacatctgagtttaatatatacttttagatttagtgaattaaaaagccagaatgaggctgggcacggtggctcacgcctgtaatcccagcactttgggaggccgaggtgggtggatcacgaggtcaggagctcgagaccagcctggccaacatagtgaaaccccgtctctactaaaatacaaaaattaactgggcatagtggtgcgcccctgtagtcccagctacttggaaggctgaggcaagagaatcacttgaacccaggatgcagaggttgtggtgagccgagatcatgccactgcactccagcctaggcaacagagcgagattctgtctcagaaaacaaacaaacaaacaaacaaaaaaaaccaggaagaacatattccaaagtgtttaaaatagttatatctgagcgtcggaattatactattttaaatacacttttaccaagtttcctataatgagcatgcgttctatgagaaaagggctaaaaatagatgaaagttaaacattagtcactaattcatctcataaacctacttactcctgggaactattaacttctgtgttattattgcacattgggtttttatacatggtagatgctattatcgaggatcccttggggaaggtttgtgtatgaaatgatcatttctttcctgcttactccagattgagattgccagccttgactcacctgagcgggagactcacatgtgagactgcccgtgtgaagagcttccactgtgatacccagtaggcatctgaaaagcatcaggtccaaaatggaattcttgatcccccaacctgctccttacagagtgatccttgtctcagtaattccaacatccatcagttgtgtgatccaaaaacttagaactcatacctccctttcctcatgcccacagtttgttcatacaaagttctatagaatctacctcccgaatacattcaaaattagaccacttctcactgcaactcaataccatgctcctcacttccatctctactactcgaagccactcgagtcatctcttacctgaattgctgcaagcactttccagctggtatgtttgtttccaatcttttatttcattattttttaagagacagggtcttgctctgtgtcccatgctggagtgcagtggcacaatcatagctcactacagcctcaaactcctagagtcaagtgatgctcctgtctcagcctcttgagtagttgggactacaggcacacaccattatgcccagttaacttttttctttctatagaaatggaggtctcactatgttgctcagggtggtcttgaattcctctttctagttttctctgacactctcactccctgccaatcttttctcctcaaagaagccagaatggtattttttaaaaaatataatcagcctttattaccaaccacccccaattaaaatcctcatgtagctttatattatattaccaatccaatctaagtgcattaccaaagctttgaagaccctgtttgatcctacctctcaataccctccagaacatcctcctcgtctaccactttcctccacatctaccacaccctgggctgtttgtcaaacatgcctggtttgttctagctttgagcttttctctgtctgggagacttcttccttcagcaccagagctgacttttccttgttttatacatagtgagatgtcagctcagatgttacctcctcaaaatgatctttttgatcatcataacttagtaagctctctccctccaccagtcacactgtcccacatctcttcattctgtccagtattagtctgtaattaccatgtgcttacatgtttaatatctgcctcacttttgaatgaaagtatcaaggggaaaaggaatgtgactgtttaaatcactgctataacttcagtatccaaaacagtgcctggctcatagtgaacccttcataaatagtcactgaatgaaggaataaaggattggagcaatgaatgtttttgtgacatctagatgaaaattagagatgataaccggtgcaattttgatcatctatctcccttcataccagccaccctaatctaggggactagaataccgaaagaaaatttgcttctacgaacaaggtaatgtcatgatatggactgactcatttatttgttcatttgttcattcattccttcatcattcttcactcatcagacatgtagtgaggactttctttatattaggccccctgtgtttggttttctgtcagttatcttagggtcgtgtgtgtgtgtgtgtgtgtgtgtgtgtgtgtgtgttaaaggacgaataaagtaaataaactaatgcaatgtaagaagtgttgtggttttttagtaaaggttataaatctagacttatgtgcgtattgttttgagaatacaaagaaaggtgcttctgtttctgtttatgggaagtcactttacagacatttatctttaagtcatgatagatgaatttctcatatgggcagttttcctaaatctgagttttagcataatgagatctggagaaaaagaaggcaaaaaaaaaaaaaaaaaaaacccataggaaatgatacagagactaatgatcatttacccaaataaaacagataccattcaaagttagacactgagcctctggtaatccctgttcttctccttcatcttgagcgagggatactgaaaaagactgggctggctactgtttaatcagggaatgatgaatacttttcattagcccaagaaaagttagtttctattccagaaatattttgtaaagaccagttaaaattattaactattatgcatcacttgtcaactataggaagcattactgcaacctctccatagatgattagaataattgctgtcctttcatctttcccatctaacaatactcacccagtacctcccactttcgtttgtgtcttagtatgctgcatgtatctgctttgctaagagaacatcaaggcttggcataattgggctatttccctgtcatactggtttgcttctaaatctgcctcctctgtgggttgcagtgaggtcaatcagatgcagtcaaatggcagagaagatattaaaagtacatatatcctagaactaaatatacaccatctgtgaacttcagttacaaagggaaacttctcttaatatgaccttaggtaaagccattggcagttttattgtatctgtcagcaatcaccaatagctttgattaacaacatgactaatacataagttatgttggtctctttttttcataaataataagagatagggtttctaccaacacaacatttctcatacttgcctgatcattagaccaactgtggcacctgagaaaaatatgccacagacctactaaatcaaaagttccaacaggcctagggatctgtatagttcataaaaactccaggggatttgattatcaggcgaagtttggggagctttgtatgaataatattcaatgaattgtttgtatgtctgtccgatgctttccagactgggttaatgcctgggtctctttctttaattaagctttgattaagatgctcccagcaaatcccacactgaacatttccattgccccctccctcccccgcttctactatgagagaccgagatccatgtgaggtattctgtgatgaagatcttgttctgtttttattattaagcgtacatcttccccttttctgatattaccactatgcatcatcagttaagctgtcaccaacctgacctctgaggcattggaatcattcacttgatgaagcttactttggcataagctaagggttaggaaaaccaacagatttctaaaatattgtgcatggaagggccactggaagtcctccatcacagcctgatagctacaaaaatgagggaacaaaggcccttgagggacttgccaaagtcaaatagtcaattacagtgagagtttggactaaatctcctggttccaattattacattcttcctatgacaccattccctgattcctacaaccaaattagcctcctctttgagctttagttttccctctaggaaaaaaaaaaaaagcatgttagacgaggtcagggactctaaaactgagaccctaggttcagttaaaatgctgggaaggctactgtgataggggtggatgtcggagaggaaggacagaggtggggcttcccctagttatatttttatctgattgggatattgaaattatattaagaatttatttggaaaagccacttctgttactttttaaaaaaagatgtagaggcacaaggctagatgttgatccttgagtgcagatctgattcttacatttggagatccttagaaaagaagtctgtgaaggcaagcatttgtccttttttgtcataaaacctgattcttgggtattcagtgaatgacactcattgaccaactgcaggtctggcatgatcatcacaaagaattggcactttgaaagtgagagaacagtgggaagagaaattcttaggaagcaagctatcttttctaatcctctttaaaaggccaaaatgttcacaactttcccctaaaacagaaaggtgacattgctccttaagcagcagtatcatgcatgctgtcctctgccttcctaagaagtgcagacagagggcagaccctccgagtgaagtacctttttttcttatttgagcctgctctgcattgagggagagtttgacacacctctttagggttctgagaatagttaacagctctaagaaagagatttttgttcataagaaaaaacaagagaaactggaagcagttctcattcatattctctctctcgccacaccccccaccccacctcctcccgcctctccctctccctcttcctctctctccctctcttcagtatctaatgtaaacccaggctttctttatgttctgtgcagttggcctgagttctcttctgttttggtcaagattcaagtggaaaagacctgagcctgtgtctgcctcctttctcctaattttggtttctaatgttttacccaagaagggactagacctttgtttccctactcctttatcatagcatgctggttctcagaccttttctgcacactgctaacatccttctcacctttctttgcttggctttttttttcactgcaagctctcccatgttcatttctcatttgccatcagatttagagtaactggcttatggcatcaaagaatgaatcagatgggagcagctaagtaaactgaatgaagctgcttcctttctcttttcccatccacaaatgataaaatagcctgcccagccaagtgacgtggcattcaggggttatggtggcttggccatttgtttaagtttgcttatttgcagtcacagttctttagtatttcagtgatttggttatcactcaacagtgcacacatttcttctataaaatttgatagttacttatctatctctgatttttccctctgtgttttattatatctagtttaatttttcccctttgttgatttctgttttgtatatcttgttgcgggatatacatggaagggagacgagtttccaaagataatatagatcccagtttgcctgtaaattgataacaccatttggaaacaaatcttaaaacctcactgacacagcataaatagaatttacagatcttcttgaagcaaatccaaatctccagactctactttctccattctcccccactcatcctaaccttcacgtacagggaccgcgttaccaagtgagccaactagactctttcacacctctctgcctctgcacatgctgttccttggccagaaatgccttttttttctgctttacctgacacatttagattagtcttttaagacctaatagaaatgtcaagtgctctgatatgccttcccagatgcccatgagcaaagtcagatgttctgccttctgttcccctatggtactttactgatgtccctgtgacagcttcctgccactccagcccactcagttgggagaacttcaagaggtgaacaaagttttattcctttttggattcccagtgtctcatagaccttctgggacatatggcacattcagtctagctgaatgaggtgatgaatcaatccacttactctctccagtgcctgaaacttctcaaggagcttgtgctctcctttgctcctctcttttcaaccaatctgaaaatgcttttaaaagataatgtctgttttccagtgcagtcttctcacttggcatgtaatttctccatttttatttcctttgtgaatatcaaggtacaatttccatagctaccagtctaacctggaatcttttcatctcagttttggagttccacaacagtgtcctggtggatctatcttctatatattcctactataatgtacactcttaccaggtaccaatcagttgtttcaaaccacatttctactaaatgacctctctgaagtgattctgaactggcttccctattagatgaagaccaaacctctactctaagcacttaagacaaatggttgcattcatctcaatgctccttactcctcaatattatccattacatttttttgagacagattgttattctctgacagattgttattccttcatcgtccaaaaggagtcctcactttgcttagactggaacacaaaattttatctattttaatgttccgtcatataattataattatattctgttatctattccaaattttcagaattttatctattgcaaattttaagtattccaagttataaacttacgtcttccaaaaagactaccaggattaaaccaaccactgaatcatcatttcattacttcatattactacaagttagatttgggacactgtaatattttagccctgattttgccctttttatagtgtccatagataatttaacttctttgtataaacttccattataaaatgaagttttttatatatatatatgtatatatatatatatatataaaacattacacatttaggacatttcatgatgaaataaaagtgtttcaaatagaaaatgatggtttatttgggtttataaatcaagaattctcaagagggtatgaaacccacttctcccttatcaactctagggattttctgtagttttgaaatttgaaaagcataaagtaaaattattatcattttgatttgcttgtagtcataatatttaattcacttagaaatatcaaataacattaaaagaaaggtgtgaaaatggctgcgctcagtggctcacacttgtaatcccagcactttgggaggcccaggtgggcagatcacctgaggtcaggagtttgagaccagcctgaacaacatggcgaaagcccatctctactaaaaatacaaaaattagccaggtgtggtggtgcatgcctgtaatcccagctactggggaggccgaggcaggagaatcgcttgaacttaggaggtgaaggttgcagtgagccaagatcatgccgttgctctccagcctgggcaacaagagtgaaactccatctcaaaaaaaaaaaaaaaaggtgtgaaaaatagggtagaccacgtgtgctgttacagtagaccccaaacataaaagatgtttatctcactcatatacacagtccaatatggttccagttggtgagggttagggttgtcattctgggagttggccagtagagatgctaccatcttcagcatgtcttccaaaagcttcctggtatcaaaatccaattgttgaaagcagagagaacatgaataagttcatatggaaggattttatggactaagactaaaagtagtccacattaattcagttcacattccactaaccacatggacacccctaacttcattggtgactaagaaatgtagtctagactattcccaggaataagaggaaatggttatactggagaactagatgtctaatatatattaccttacatagttatcaaagtcatttttagtttggacatggtctttactaatgggttgcaaatgctctttatgcagatgttttatgttttatattactttcctatgcccaacagcataaaatatagaagtctggatggattaggcacttgatgtgtgtattagcttttgattgctatgtaacaaatgaccacaatgttagtggcataaaacaacatatgtttattgtgtcacagtttctgtgggtcaggagtctaggcacagtgtgactaggtccccagcaaggctgtaatccagtcgttgatcaagactgtatttctcatctaaagactcaacaggggaagggtctgcttccaagctagctcaggttgttgtcagattttactttcttgtggcagcatgattctttgaagaatcaagaattcatggttgcttgcttcttcaaagccagcaacagagactaaatcaaatctagccagatggtcttatataatgtaagataactacaggagtgacatcccaacacctttgtaatattggttaagcaaattacaggtctcatatacattcaaggggaggggattttacaaaagaatgactaccaagaagcaggatcactggagcctgtccaccacagtaaatgactgaaaaaatctgggtattccagagaactaccactttacctgaacatagctctttacacaaaactacacagaattatgaaagatctcaagagaaaagtgttccttattgccaagagctggttattatgctagtaaaatcagcagtgctcaggaacaatatttgctaagtttcacagttatcaaccttaacccacacaatcatctttagaattggatccagaacaagatgggaccatcttaaacctggtacattctcataaggttcattctcataagaccctaaagccttcattatatggcatttttgaaactcctttgtcattttaaatttttgtctttcctagctcccttttcctctactattctatctaacttaggcagcattgaatttcatttttttttctccttagtctttctgtttgacattttcccttctagcttcatttgtcctttaagacaaccccataacctttcatctaggggaaagaaatctaaaagaaagctctagaatgagattttagttgacatattcaatttgctttagaggggcatcacccatacctcttcttccactagtgagatctcctgagaggtgaaaatatgagagaatcagagctgcttatttatatatcaactatggaaagatctttcctgcctaatctgacctcttctttgaaactccaaaagtgactttttgtggttaattcttccaggatatctatgatgcagtcccacagatattaaaggttcagggcatcaaactgaaagatataacagctctaatagacagagtcacatttctaaaaaggaaaaccaaattctgaagatattttctggctctgtgaacagctaaaaatacaaggataatcgttcctatagtcctggacttttaacacggaagctaacttggaaggaaaaatgacactgagctataggaagagaagaatagaacagacttcagtgaaatcggccgcttttcttttcaaggcacttattcctagattagctcatctatctttaagtttcatatgatttttactatttggcatgacttaaaactaccaagttggtgaaaggtacataggaactctctgtactattttgcaacttctatgtgtctaaaattattttaaaataaaaggtagcaaacatacaaacaaaacaaattattgagctgggaagtgttccccttgcaaaagtctagcaactggggtaaaattgtttctttgaatacaaatgcctagtctctgattaataaaataccaggaagaggaaaagaaggagctgaagaaagagagaaagaaatagagaaatggggatttccagttgctgtagatcttgagtaggcaggaccttagcacatggtatctaggtgcatattgcctgtcacttttcaattatctttgctggccctgcctcaatcaaagcccaaaccataccccaagggcactctgcatcgttgaatttatagatgagatctttcttttgggataaagagctattctcaacttgactattataccttggccttcattccctaaagaaaatgggcagggaggcttgcagacagaagtatatagtgtggaaaatgaaccacctcttttgactctttgcaagatttgtgatgtcctactgggatgcctgggcccaggcacattcaccttgattctacatcagagacttctgtgtcttctttctcatagtatgggttattgggttgagcaaatactttgtcatcagtgtgtcttatggagtaattgagagccttggatttgaactcatatctatttgggctctattttgggctgtgtcacttatgaactgcatgaccttgagcaaatcactgaaactctctacagtccagattcgtaatctattaaatggggctaataatacctcatgcatatggctgccaacgggagttagtgaaataatgtacatgaaatatttaacactaaacttggtgcctaatgtatcttcagtaaatgataactattgtcatagtcatcattgcttttatacttttcggcttccagtgatttccagtgactacagccctaaggccattgggggatatcttttttataactgaattttctttataaaacaataactgattttttttttttttttaagacagagtctcgctcttcttgcccaggttggagtgcagtggcacgatcttggctcactgcaaccttcatctcccgggtacaagtgattctcctgcctcagcctcccaagtaactgggattacaggtgcctgctaccacgcccggctagtttttttgtatttttagtagagatggggtttcaccatgttggccaggctggtcttgaactcctgacctcaggtgatccgcccgcctcggccttccaaagtgctgggattacaggtgtgagccaccgcgcctggcctaaaacaataactgattttttaaagaaacatactcatgactatttgtcattttagtcaaagaggatggagaaaaacagggttcagttttattttcagttcaatgtttcgaccatgacatccagtgctggcttgattacattttaggaaactgaattccttctctaaagaaatagtccaaaattaaacacatatggttactgtaatcaataataatgctaaccaagcatgctggctcatgcctataatcacagcactttgggaggcagaggcgggtggatcatttgaggatcacaggagtttgagatcagcctggccaacatggtgaaaccccgtctctactaaaaatacaaaaattagccggttctggtggcacggacctgtaatctcagctagtcagatggctgaggcacaagacttgcttgaacctgggaggcggagttggagtgagccaaaatcgtgccactgcactcaagtctgggtgacagagcaagactctgtctcaaaaataataataataataataatgctttgtgcatttcaaaattactaaaagagtgtaatcccaggacttttggaggccaaagcgagcagatcacttgagatcaggagtttgagaccagcttgccaatatggtgaaaccatgtctctactaaaaatacacacacgcaaaaatattagccaggcatcatggcgtgtgcctgtagtcccagctacttgggaggctgaggcaggagaatggcttgaactcaggaggcggaggctgcagtgagccaagatcccaccactgctctacagcctggccaatagaggaaggctctgtctcaaaaaaatatatatatattatatatatgtgtgtgtgtgtgtgcatgtatgtatatatatatgtgtgtatatatgtatatatgtgtatatatgtatatatgaaaagagcagaatttaaatgtttttaccactaaaaaagatatgtgaagtgatagatgtattaattagcttgatttaatcatttcacaatgtcaacatatataaaaaatcacatcatactccgtaaatatataaaattgtaagtcaactaaaaataaaattttaaaaagggaaacataataacttttattattttgtatttttaaaaatcaaagttaggacacatattgagtttctctgctactcaatgaactgaaggttttggaaaacaagaccaaaaaacaacaacctccaaaaaagaaataaaagaagatcatagttaaggcctttcatgcagtcagctcagggatcaagggtagatctcaacccgcctgtcactgagtatgcagtgctcacagatgtggggaatacctatgtacatcacagtcctcagggaactgtaaaaccagttgcattgaccaaaccaaaacacgtgccattagaaagcatataattgtaaaccaagagcttcttttccgtttacctaagataattgcagaggctttagtctaagagaatcaaagttaagtgatagcactgtcaaaaaggtttcttaaggaagaagatctaggggttctcgggattcgttgaatttgatgccatggctgaaaaattaagtggagatacactgtatgccattggagtcaggcactcatgtgaaagatcagcactcacatttaggaattggatacagctaacagcaggggaattgataggctcatgaaaagagcatgggtagaggatgacatagaaaattaagcacagttagggaagacttaccagccaggttacaagaagcaaacacctatcccaccgattcagaataccttgcctcactcctgcatgacaggacatgtgtgttctttacgttaactgagaaactgaggccagataggaagacagatgtggccagaagaagttgacattagtaatgagagaaataaacgaagtgattttggggctggcgttaactatctagaactacccaggagggtagatttagagacacttccatctttgaaatacccagaagtctgtttctccaatgccttgactctgcctaaagcagtctaccattaatctctgaggaatctcttcaaacagctttctgccaatgtatcactgaagccttttgagaaataagtgctgttccagcttagtcatatctcaaggcagcgtggcatgggaggtggagactacgagtaattaaaaataactcccagctcaagcagggagagggctgtccctgcctcatctgtattcccatcacaggctccccagtgagaccccagctgttgagcaagagactctgtagtgtctgatgcactcaatcttgagttgatcacaaaagaatgttaacaacgttaagggcatggagttctaggttttggaagaattcttaatgattctgttaaagaggaagaaataggaaaaagaccaaaaagacagggacaaacaggaaaaacggacccagctctactgcagtaatagccattgatcactttacctcccttggcagtctgatcagtttcactggaaagatagcaagtggaaaaagtgtgcagagatatgatgtgaaaattatattcaagctttagctccccagcacgtctctaaggaaagcactataggaacagctgctggagatataaacaaaggcccaggaacatctctgccattcatgtcaggatctgagagagccaagggaaggacaagaggggaattagctcccagacatgcttgagtctctaagctgttactccgtgatccccatgttctaggtgcagaagcattgcgtctctaagcaattcccttaccaccagctatctaatgctgtcagaggaccaactatttgctgttaacagtaatgctcatttgaagctattcagcctagattttctttgtattaggtaactgtttaataaattaattccaaacagtacctcccatctctctcagtctgaccattgagcgctcttagtcaatctttgcaaacttgtccccatttagttgttaaacctgctccatcaacccaataatgaatcaacctatatttgaggactatggtttgtgcctgctccaaatcctatgttttctctgatttcagaccccttgcctcaactggatgaacttttcaagctcagaacaaataagtgttaaaaaacattattaaacaaacatattcacctttctacaagtttggaaaataacagctaaggaaaaagcttgtaatcaatattttttgttgttgttcttgttgttgtttgagacagttttgctcttgttgcccaggctggagtgcaatggtgcgatctcagctcactgcaacctctgcctcccgggttcaagtgattctcctgtctcagcctcccaagtagctgggattacaggtgtgtgccaccatgcccggctaattttgtatttttagtagagatggggtttcaccatgttggtcaggctgatcttgaactcctgacctcaggtgatctgcctgactcggcctcccaaagggctgaaattacaggcgagagccactgtgcccggccttataataaatagatgtatcaattgtagcttaccagcaccaaaaacaatagttagtaagagtgtggagtctagaatttgactgtttagagaaattatgcctcatcttggggaaaatttcctaatgtgtccaatctcctgtttccttatccataaaatggagataattgtaggacctcctccagatgactattaggaagagatgatacatataaaactcacagcactgtgtcaggcataaaataagtaatctataaacaatgttatttaacacttttatgataaaaatatagaaatagaaaataatagtttcagtgacagatcaatgttgaagcctcaattcaaaacataataaaattgctctttatggttcttacgatgtacatttatttcaaatagtaacaatgctgttcatggtgaaacgtattgattttaagattgagaaattggacaaacaaggctagtccacaatagtgggattgcagtagaccctagaatatgtataccactttggaaggtataattaatatgtttatatgtgtcgtccccaatctttccattctttattaccaccattatacctccatttactccacagtccgtctcttctagaatgaaagctcccacaaatcagcaattgcatctgtataacctattctgtatggcataacacctatatacttttccaaaaagaggtggagagaatatttattgacttaggtatgtctgtgatgatctaatgaaatgtcatggaacaacttaaagtcatagccaaaggaagaggaatgttaatatgtaagaatttgcagatagattattaacatggaatgatgccaaaatagcacagtagaaaaactaaaataaattaaataggcctggatttgctgggtaacctggggtataaccccataaggatggtgtatgtagaagaaaagtcagtgaatcattagtaattcataaactgtgttttttctcaggtgttcaaacattggaaagctatcttttgcaacctgatgctttccctggaatatgcagtgtttcttgactcgtgcagtaatggctgatggagtaggtgttcagacattttatttgttggttttatgtatccaggtagagaactcctgtctaaaattatcaagagttggtggtgcattcaggacaggaatttagattttctgactccaaggacatttcaccacccactaaaccaccctttgccatgagctcccaggaagagcaattgttcagtctggtacagtgagggaataatctgtccctagcacaggaggctgaacacagcagtgaataaaagaagacaaaaccagttctacaatataaatgacacattccattaatacaagtggatccaaatgaactaatttcattcaatagtactttcacattctgtagctatatgggcttggatacaaattgtaatgtcagtctgtcaggagagtggatggcagtgcataattacaagttcttgttcagcacttcaggagctaatcagagcaaggatgtgaatctgtaatttgcaaatgtgcaaagacagaggttactatggcactaacgactctgctgataacattcttgccaccacatcataggactgtgagcacaaattctacaaaatcatttgacctcctgtttagtcgtttgcaagaaacagcctgctggcagtacctagggacatttataagtttaatgttgttcaaaaatctaaaatgtcactatacaataaattaatacttacattctaagggactatacacaatcgtaaagcaatatatagagcaaattaatacataaaatacagagaaatatagaaaattaatatactacatcatgcaacctgcttctaaacaagtgtttctttcataggactgaatcaggaaagattaaataaggagttgagtagaaacatatatagatatgtagagatagagatataggcaatgttttctttttttttatttttatccaccaccccctccccccgctccccaccatagcatttctgctttaaacacttattctctttctctaacaattttattcattttcgttcttggggcagtagaaaaacaaagcagcattttagagttcagtactggcctaaaattcaagcctctctctaaaagattatagaatttcgctgtcctctcagttcacagcagcaagcagaataatttctgcttgccattttcctcaacttagtcctgcaaaagtaacatcattggtctctgcttctttcctcccattattacctgatcctgctctacagcagatgcttcctcagagaaagaaatacctcgaacatctccatcaacttcttcatggtagtaacccttaaccctaaacttttcttgtgtagagatgggtgcatcatgttgaggattcattgaccattctgttaatatatgaatttaatcaattttaattttaaagaatcaggagtgattacgtgcatcacaactttcaggttaaataattttatcatgggtgctaagctagaaccatggctcacctggtcagatggctataggagagtcagcacaatagaagcttcaggcaatgtgaatcctgctgctccctaccagggatcaaaactgaggtcactgtgtggtatgtggaagtcaaatgactgcttctctttaaaaagtgttggaatgatgcgttttctctcaccgattctgtctagggggtaatgtgctagggtgcagtaagttaagtgttagtcacatatttgcagggttaaatcttagttccacagctgactcactgcacactctaggcagaattatttaactccttcagtctttgtttcctcattcaaaaaagaaagagagatactatctgtggcagagcctcagaggattgagggagttaaatgtaaaaatgacacactggtgcctgttacagggagggctccctgagaagcagacctgtgggctaagtttagcatgcaggatgtttattaaggtgtgcctttgagatcaatacctgtgaaaagtagggaaagaaagcagatgaggcatagggaaaaggtggactgccacaggcaacccagcgaacctcaccagcagctctggagctaaaatagctcttcagaattgtccagagttgggctgaggaggccagaattttatttgtgttcccacgatgatgactcagtggatggggtcatttcaggaagagagcagggcatcaaccttgagcaagaaaggtcactgcagcttagtctaaccctgaagaggctggcagctcagggcatctgttgacagtattccaaggaggcagggcgactagaactttagcaaaggaagatggcacatcacagtgatcatcacagtccccagtcataaagagtagtttcttacatgtgcataccccttagccttgttttcatttctcctcctcccgccttcctgtcttcctcttcctctcccttccttttcttctttttcttcttattttgattttgttttactttatggaattaaacctccataattctgtagtgtgccaagtatgagggggaaaaagtctctttcccccattaatagataatgacaccttgacagataagtgagcaattctgcattgattcattggggaaaactatggcaggaagtgggtagcagtgtttagcgtggcataaaatacatatgctatctaaagaggtggcttctttcccttctgggggatttatgtgcttaaatcagggcccacaaactcaaagcacgcatttgggctaaaggaagcttggctaagagtaaaaggagagccaacagggaaagggccttgtaggctgtgacctttcaagctaaactgcccctagagaaagagagacttatttgaatttacagatgccttaggactccagtgagccacagctctggctcttttcctctggggcactacaaagcttaggtctttgcagatcaattaaagtcattagcgctccatctaatgaatgttgatttccatgaggaggctgagccagctggcctgccctaaacagcgcaaaggcaagcagggtaccagagttagagcaaatggcaataagccacttgaattagaaggcccccagcttgcagcagagttaatgctgcctgttttccaggtgacctcaatcactgcctggggcagacactggactcagatgctctccagtcacaagagagtttgtaaatatgatttaaaaattgtcactggctgctcaactagcaggagtgttcagaaagctgcaaggtatgagacactggatgcacagatgtgttttcatctggggaatgttgcatttttacaattttctctcctggctattatgatgggagatttctagtttttaaattcagtgtgctttttaaatttttgaatagataataagatgattgcaaaaaaaattaatgctgcctctcatttctgttcttcatctactcaagaaaccagttattctttttgtgtgattctagagttttctgatatatgtacaagcaaaggaaagtgtatagtctcatattctcatagtcccacctactaaacaaataacaacatactgtatatataattctgcatctcgcttttcttctcttttaatatatcacagctgccttaccgtatcagaacaaagagaaattctttttttttacagctctgtcatatttcattgaatgaacatgccttatttacttaactgttcctttactgtttgcagttacaaataatactgcaggtaacctcaaatatgtttcattttttacgcatgtttgagagtatgtgttgaatacaatctcagaagtagaatgacttctaggaggtatatgcatttgtaatttcaatagatagaaggattgccaaattgtccttgagaagtattacacaaatgtacagccccccccccctcaacgaatgggagcgcttccccacacctcaccaatagagactgtggtcacacttttagaaatttgtccatctggtatgtgaaaatggaatttcagtgtagttttattttctttttcttatgatgagtgagattgtacatctgtttatatgtttaggaactttttagaaatcgtttgtatgaactttctattgatattttttgaccacttttgtagtagtttgctgcttttgtttttaattgatttctactagagagactaatctccatgatatgggatgcaaatatccttttcctcccctagttttttgtttgccttttgattttccttacagcttttgcccctgagcttttagattttataatgttgaagttatcagacttttcttttatggcatccttatttcgacacttaattagaagggaggacttcatattctagagtggtaaagtaattcttcatggttttctcttagcactaccatgttttgctttatattattcattttcataatttttaatgtattcctgtagaggacgtgaggtattgatacaaatttaatattttttttcaggtggctacccaattatttcaataactatgtttctataagtcatcatttcccatttaagcctctgttatgatattttaaattcatttctgcacttttattctgctgtattggtctgtcagtgcacatttttcaattctgaaacctgtacaatagatttcagaatctaaaagggctaattctcccttattactttttctttcagagttttcctgactttcctttttttttttttttttttttttttttgagacagtgtctcagtttgtcatccaggctggagtacagtggtgcgatctcggttcactgcaacctccacctcctgggttcaagcaattttcctgcctcagcctgctgagtagctgggattacaggcaagcgccaccacacctggctaatttttgcattttagcagagacagggtttcatcatgttggtcaggcaggtctcaaactcctgacctcatgtgatccacccgcttcagcctcccaaagtgttgggattacaggcgtgagccacggcacccagcccacttttcttttatatttttttatagaagcattagagtatataagcagtttcttttaataatttgtatatgttagcatatgtatatataaattagataatgttaatttacaaattaaggagagctataacttctatgacctatatgtgtctttctatttagtgacatgatctgtctctccttttgcttaaattttattttatataatttcatatgtctcatattttgttaggtttatctctaaaagttttttcttctctgtacctaattatgaatggttcttttctgttattacttctactaatgagctgtgtgtgtatatatacatgaagatcatgaattaaggcatactaattctgcatcctgcttccttacagaatcttcttgttaatagtaatcattttcagttgtttcttctgagaactccaggtgctcagtcatatcatctaaacataattttatcactctctttccagttttatatctccaatttctcttgtttaattgcattagataataatcctatctaataatatagtaatgatattgtggatactttagcctcgttactgactttagtaagagtgattctgatgtttccacaatcattatgagcctggcttttgcaaacatatacatccctatggtttcttaacactgaatggtctggtccttacattctcaagttaaatcccgttagcattgagtattctttataatatagaactagatccttgtaaacaatttaattattttctttttctatgccacagaacaattaacttggcattaaaattctctactctttaaaagcttggaatgatttatctgtgaccttttctgggcctcgtgctttctttttctaagggtggctcaggtgacagacaacttcctccatttcatcaatggaaatgaataggttttgaatatgtatcccctttagaattatttttaggcaattacacttttctaggatattctctatctcccaagttttcatatatatttgcacagagttagccaagactatttttgtcatttttctgtgcttattttccacttactatttttaaattttatgtatctgcaattttcttcctctttttcatgatgagataatctaatgtttaccctttttaatttttttgtaacagaaactttaaatatattaattttaccacttttgcatttcctagaatattaaattctccttttccctatatgaattggccctttatgtttttcttaaacatattttatgtttgtttaaaaattttgtattaaaaatattgaattgattttgttattttctcctgtcaatataaatatgtaagaccaaagatttcctctaagcatggcttttcctgtttcccatagattatagaatatgagtgcttttacatttttattgttctaggaaacctgcaaaatgggctgtattacattcgacccaagaattaagagagagttttaaaatttctgattggaatgggattctgtttccgatcttgttgttaacatctagttattacactgtgatcagaaaatgtgtacaatagtatttcttttttttttttttttttgaaaaagttgcagttttctttttggactgcatacagttacatttgtgattatcatgtggattcttaaaaagatttttttaattttcaatgcataagtctttaagtgtactgtttgatataccttataaattatgctatttaggtcaattatagtcttacttttgactacttcatctatcattgaataagcaagatgatttaaagtgtcttatttctgttttttggctgaatgtttcttcagataactcttaagttttctgttttttgaatgttatttttatttcatttggttcataactagttataattctgacaccttcattgcgaatttcatcttttaacattttaaacaaaaaggtcttttctcaattatttaaaacctgaataccactttctctgattttaagatccctatcgctgatttatttttgtttgcattcttccggcatgccttggttgaacctcttattttcaacgtgattaacaaatttaattgttttatttatttacttatttattttaattatactttaagttctgggatacttgtgcagaacatacaggtttgttacataggtatacacctgccatggtggtttgctgcacccatcaacctgtcatctacattaggtatttcacctaatgctgtccctcccctagccctctaccctctgacagtccccagtgtatgatgttcccctccctgttccatgtgttctcattgttcaactcccacttatgagaacatgcagtgtttagtttctgttcctgtgttagtttgctgagaatgatggtttccagcttcatccatgtccctgcaaaggacatgaactcatccttttttatgcctgcatagtattccatgttgtatatgtgccacattttctttatcactggtcattagagaaatgcaaatcaaaaccacaatgagataccatctcatgcaagttagaatgacagtcatcgaaaagtcaggaaacagcagatgctggagaggatgtggagaagtaggaatgcttttacactttggtgggagtgtaaattagttcaaccattgtggaaaacagtgtggcgattcctcaaggatctagaacaagaaataccatttgacccagcaatgccattactgggtatatacccaaaggattataaattattctactataaagacacatgcacatgtatgtttattgcagcactgtttacaatagcaaagacttggaaccaacccaaatgcccatcaatgatagactggataatgagttgttttttaaagcaagtctcttgttcatagcacaaagttggttctgctttgtgatctattgtaaaagttgaaagtctttgtcttttaataggtatattaagccagtttatatctaattatgtgatagatatatttgttcctggtcctctcctgttactttatcatatagtttctctttttcttattttgtttgtttgcttgtttgtaatgtgttctatgcatgtctatatgtatgttttgctatttaagagtttgcattttctcccttgtcatttttacagttataatgtattatatttttagtgctcaatatatttaaaccagagcttctcatccaatataccacactcagggcttttggatagaccctctggccatgaacaatcttgtcttctcctctcagtctcgacaaatatattatttgctttttgacctatcatttgaaaaatattgggaaatgtcactttaaggaatatgcactagctctttactatgagcagtgaatcatctttcttaatatttaatacagaaaaaaacatgcatgtattaaaattaattgagttgatactttatatattatcctttgactcctagcaatcagataatttacttcctactttctgtcctcttctaactatttttagttgtattacttctgtattgtcagggtttattccattttcattctggtcttcagcatattattcccattaggttagacatagttcttctttaaaaactatactctgtgcttaccttcaatttcattgtcatagttattctaattatgttttggttgatcaaagtcatttcctagtagtttcctcaatattcccagtgttcctgaaggtaaataccatttgtaaactatcattgagtatagtttggctggatataaaatgttgggtcatattttgctttttgttgggaggatgtttctataaacttattaatacagtcctggtgagtcagagaagcctttcttgaagaggcattgtctatgtttaatctctaatggatgatcgtcacagaaacatagacagaggaaatggttccaggcagaatcaatggaattgaaaaaaatcatggtacttctgtggaacaggtagttggatgactgtaatgcacaggggaaaaggtagacacaagttgacactggagaagtaggaggggatagagcaagaagaacttgacagaccgaggagtctggattgcttccaggacaataatctaaactgcagagtggtatgaagcaagaaagggatatccggttgtaactgttcatattaagaggggtgcacaggggtatatgagctttctcttccaaggagcctttgagtcctcatctctgctgttacagtacagacccagaatttcttatgtaggagagtaaatacatttatgaaataataatggaattcattttatgctagggccatatttctaactaccttccaatgtagcaggagatagcaagacttaaggatatcttagtctgactcttttaaaaaagaaaaaataaagaattacagttcttgggtatatagtcttgtacctctgtaatctgtgaactgtctttcttccaaggatcccatggaaacctttacaaatctagctgatattcactatagttctaaaacatttccttccttagctgttccatggggagttttctgtgatctcgcagtttcaagctactttttggggaccttccatacttcattcaggtgggagctgccatagttaactagtttcggagcacaactctttatcaaacactatatatgtaaaaaactgccatgttaaataccacttgttgctctttcatcttcagtcagctatatgcaaaataggtctttacaggcaaatttacattctatcacagaaacagtgactatcagataaccaactcccttctcaattcttttttttggcttgttttcttgcttacttgcttggttgctttctctctttcctagctgaatagcattacaggccacttctaaaataaactgggttgtggaatttccactgaaggctggagatgaaaaacatactcatttacactgtgtgcgaacttggtggactaacattggttaaactttgaaattaagagatttttttttcctgatttttggccatctctttaatgcaatttcaggtagccacatggttcttaaaaccccaaatgcagctatcttcagtaagtacaaaatgaaaatatgttgcatcctaacagataagaatttcttctttctcatgatgagagctgttacctaaaggagcaaagctttaatggggtctcagcttgattttgccatgtttatatacaaaagagatgaggcaagctttgttttgaagatgttaattgattctgtccaccatgctgtctaacagccaattccctgaaaatgtagtgatggaaaaaaaatctgttccaattactgtataagtaaaatgcttcccttccacctccactaaagaaaaaaatggcactcactgctcaggatctgagatcgacagctgattctgcacatgcaaagccctgctgccatttgtcatttcaggaactgctttatttttgtcaaaatggaaggaaaaaaaaggagagagacattatacagacatcagaattcaaatcatttgcaacctgatttgggtaatgaaggctcaaggcggagttgagatttagggactaaggtggttgtataagtatgtaacttcacaagaatctgttttagacccagagcagattaatagccagattacaatggcatttcctgggcttaggaatctcattatcctcttctttcatatttctttaaagtggaagacccttccactacggtggtgtcatttgaactcaagtgtcaggttcacatccttgtgccctgaagtttcaaagtgtccagttgctgtaggagctttttctattctgatattactgatactgagactggataggaagcataccctgtttagctgcacatctaaataatcggtaatgagaacatccttgacaaaactatcttgcggaggagaggtcaggtcttacctgcatgcctgcgaccttcagcaaacaaaggcagagatctaaggagaaaacaggatgtgggatgtttccagtggaccttggcagtggacttgctttgtgtttgcaatggaagaaggaactagaggggggataacctcatggttgtcttttcttctaaatttctaagacaaccagtgaagcttgaggccttttctccagaactatacaatctttgcctccagcaagctctgtttttactaataaccagattgtcaggtggaaaactttttctaagtggaccttacttctctaagtaaaaaaacaaatcccctgaggcatgaagacctccattttacacttttgttatatacttcacaggtacctgaaatggttctggacaaaggatatgatgatcgacaataaagaaatcaaagatcatattcataattataaccaacaaaaaataattctggggataatattgtcaaaatggattccactgcaaacaggcagtaggatttactttgacaatattctccccagaattattctggatatcactgtagggaccaaaggagagtttttcccttggccttccaaagattctctgaaaaatcaacttgcaaaatgcaaattgatcagagaaaaagtgtacacatttatttaatgtgtatacacaggagccttcaaaatgaagacccaaagatacaggagaaattgttcatttttatgcttaggttcaaccaagtgtggacatctgtgtagaaatatgattggacaaaaagggtatgatctaatggtaatggactgaggcagaaaacccagcgaggcctggccgtgtagactcttcttggcctctctgagcccacattcctttttttctgggtagggggcaaaactttttctgaaatgggggtcttatgacctataatcaaacaaggtagtcaggcagtttctgcgtggtcagtttttacacagaaaggcagagggaaattggagtaatatttttaggtcttatgactagctttgaggaagagggatcctagtttctatggctagcattggggaagaatgggactgagaaacaggagggcaggggaaggtcagaaaaacttttgcttctgaggccttcattttggggtattgtttactgagccccaacaccacctcgagggtttccaggtatattttttaaagaccttctaacaaatgttccttttatttatacatccatttaattattggtgctagttccaatgcaagacttaaaaaattccacttctaattccccacctgcatggagggcacaaatctccaactcatgatcagaatttcctgcaatccgtatgtcatttaatgaattccactctattcttctggaaatcgaacactctagaaacatagttttccttttagctgcaaacctattaatgctggcagccataaaataaatgcagtcacaactattccccacaaatgaatcagtcagctcagattaaaatatactctttgcatatcactgaagggctcttcctggtcagcttgtaagtgttctgttttcattgcgtggtattcattttccttttagcattgcacttgatttgtgaagtagtgttgactgctagattcccatcattaacattaagttttattgccttaaatctctgtcttatgttcactataaatgttttaagtcaacataatgctagcaagaggtgctgggttaacagactacagttggcatatgattctcatttggggcagggaattgtgcagggttattaggagctttctacctttttatttatttatttagggacagggtctcactctgttgctcaggctggagtgcagtggcacaatcatagctcactgcagcttctgacccctgggctcaagggatcctctcaactccgcctccagagtagttaggaccacaggcacatgccaccatacccacctaattttttttctttttttgagacggagttttgcttttgttgcccaggctggagtgcaatggcgtgatctcggctcactgcaacctccacctcctgggttcaagcaattctcctgcctcagcctcccgagtagctgggattacaggcatgtgccaccacgcccagctaattttgtatttttagtagagacggggtttcttcatgttggtcaggctggtctcaacctcgcaacctcaggtgatctgcctgccttggcctcccaaagtgctgcgattacaagtgtgagctgccacctggccccatatccacctaatttaaaaaaatttttttgcagagatgtgatcttgatatattgcccagcctggtctcaagctcctggcctcaagtgattctcctgtgtaggtttcccaaagcatgtggctaacattttttaatcctatacaatgttagcactggcctcatctagtcctaagaagtttgctcctaatcatgtattcattagaattgaggaggagaatatttcccatggtgaatttatatgttccgccaattcaaccaacatcaaatatttattagctgcataccgtgtgccagatacagagccagacactcaattttgcagacacagtatacctgctgtcctagagtttagactctaatgagggagagagataataaacaaggaaataagtgtatgtaacaatgtacagctagaaacgctgggaaagaaacgaacgtgagagacacttattggaatttaaatgcaagccactccactatatctactaggtgtgtgtgttacaaaatacaaaaaaagaaaagcctcctgggagggtagcaggagttaaattactcaaaattaagccacagtttaagacagcaaaacataacagaacccagagatgccccaaggcaatacaaagttaattatctaagtagtagtaacaagaataactgctggccaggcacagtggctcacgcctgtaatcccagcagtttgggaggctgaggcaggtggatcaccctgtcaaaactctcaggagttcgagaccagcctggcaaacatggtgaaaccccgtctctactaaaaatacaaaaattagccgggcatggtggcagaagcctgtaatcctagctactcgggaggctgaggcaggagaatcatttgaaccggggtggcagaggttgcagtgagctgagatggagccactgcactccagcctgggcgacagagtgagactctgtctcaaaaaaaaaaaaaaaaaaaaaaagactgctttaggatttaaggaagagtagtgtggcgggttagagatggtggttagaagaggctttctagaggatcccaaaatgatgaggagattgtggatggaaagtggtctcttaagcagaagaaaaagcatggaagaaatactagggtcagggaagataaaaaatattacgctgttatgaacaatcaattatatagggaaagtaaataatgttagaaaggtagtttaaaattttccttttttgcttatcatgttagaaagaatttaaaatagtggccaggcatggtggctcatgcctgtaatcccagcactttggggggccaaggtgggaggatcacttgagttcaggagttcaagcccagcctggccaacatggtgaaaccccgtctctactaaaaatacaaaaattagctgggcgtggtggtgcacctgtagtcccagctacttgggaggttgaggcaggagaatcgcttcaacccgggaggcagaggttgcagtgagccgagtttgtgccactgtactccagcctgggcgacagaatgagactccttcgccaaaaaaaaaaaaaaaaaaagaaagaaaaaagtaatggcagtagtagcaggagtagtagtagtaacagataaaacctatcattggcagcaacccaggcaagcatttatttctatatcttgctgatggggttgatggggttagcaattgctatagtctccctagtaggggatttaggagacagatgaaaaactgttagactatttacgtatttaaccaaaaggttccattttggggtattcatcctatggaaatagtcatgaaagtaggtaaagatttagttccagagatgtttattatagtttcttgtgaacattcttatttgaaaagaagataagtgcccaataatatcagattgattacagtacactcaagcggttagcacagatattcatcatagctgtacttgataacagttgttactattatcatgttcttgtgtgagaggtaaagggagataagattaaactttttgatgttataaacaccatcacatacttcaatctaatattttagaagaatatttaatactattttaggtttactgttgaattacatcaacagatgtttgtaaaacacagagcaaaaagtagagtaagttatacaagatcaatttagtcacatctctatgtgagtatgtttgcatcaaataaatactggaatgatatatgtgtgtgtatatatatgtatatacagtatattcaaatgtgaacagtgagtagtgagattacaggtaattttgattctttttgtttgtttgtttaacattatgttctaaaatgtgtatggtaaaaaaaaaaagtagtttttttttatttctaagactagaaaattatttagcaaacaagtggaccaaagatattacagatagcatttcctaaacatgatgtgccttttgtcatggaaaaaatggatgattttgttttcttcttcagcttaatatgcgatataataagctcagtcatcgaagagtgaagtgcagcatactgaaaaagtatgatttggtttcacacagatcttggtttaaatcccagcttcatctctcattaatgatcacatcctgaacaagttaatatgtatgtctcggtcttctctttagaaagctgacaatggggacatgtatgttaagtgactagcacagcgcttaccagaggaccattctcccgctgtagcaggacgagccgcagacgaaacctctcagacaccaaattgtaaaaggaagggctttattcagctgggagtatgggccagctactctctcaaaatccgagctctctgagtgcacaatttctgtcccttttaatggctcacaacactaaagatttcacgtgaaagggtggtgattgatttgagcaagcaggcggtacgtgacaggggctgcatgcaccggtggtcagagagaaacagaacagggcagggagtttcaaaatgttcttctatacaatgtctggaatctatgagtaacatcggtttctaagttatgagttgatttttagctactgggtttaggccaggcaggcccaggcctggtttcgggcctggcgccgggctgcctgtctttgattttacttccttgttgttttttcttaaaacaggtactgagtataaaacaatataaaacaatatgagagggtctctctcttccctcaccacatatgtgagaaaagagaaaatatggctaagtcatgtacttaactgagtattaaaacacatgtcttaccagaaatagcaatttttcaagtgtgtgaaacacattaaaaataaactttgaaactccaaaaatctttaaaatatgtaaattcatttagactttactagaaaaataaagttatctctctgaaattttgttgttaaatatttgtagaaaaggatgtaaagtggaatgaggtctagagagagaattttgatggatgtgtgtatttgagtcagttttcatcccactgaatctttagtcaaatcaaataaaaatgaaggtaatttgtcagcttgcagaatcatgccaagcaaagtcgaaaactgccagcctatgttcattctcatggtttgaacaaaccgaactccaagtaattcattgtttggttttgaattacttatattcactctgttgatcccattttgctttgaaattgtactttcatgtttattttctgtagtccagaatggaggtaggaggaggaaatatctggaaatacctaaaaacatcttgaacataccttaaaagtaacatgtttaggaggtccctgagttagttttattagcacctctgagtgttacagaaatgattgcaaatctccaaactcacagacatttgcccagagtccccacctataatcatgtgctgggagagctttagtataattattaggccagtgtaggacaagcagcagcgtgcacatagtcacatttaaagtgaggatttaaatgacaacaaaaagcaaagcaaaatgacactctatataacttgggattgtttttatttaaatcaaaatttaaaaaattttaattatacatatgtcctggggtatgagtggaggggtggctatggggatgggtacacaggcatgaatgaacacaggagactatgaaagatgcttcagatgccccccggacaaagatggagaaggaaatgttttctgtaccatctctatatgggcagttcagctttctctctgtgcttgttttctctgctctctctgtttggatttgaagaaaaagaggttttttgttttttttttttcctttttcttttgtctctatcttatttattttttaagtagactgtcaaaattttagctgtgattgaagaaaagaaataagacaaataaaattagtgggaaaccaaggagggggaaatgggattgccacttcctcttgtacagagtcagcagttttaatacctgtaaacaaaaagttctttgctggaactctttttagaatggaaaatgggatgaataggtacagcattatcaaaccatttgttgtgctccctttttcttgaattgatggaaaatatagaaataacacaaaccaaagttgacactcttgaaatgacttgtccttagaatttattgtttatctcacggaaacatgaagaaatgtcttcattaatgtttttgatctcagagccccatttccttttatctcccagcagaagtgttgcagtgtcctcacatttggattgagaatttagatagataagaattcaaccctctagtcccatttactgcaattgtatttaaataccagcttaattagctgtactcatcctccttcccaatcctctttgaagtaggaaagtcccattgcttccgtttagctaatgctatgctcataccctagtttttaagctttgtagaaagtacagatatgactgccccatgtgatctctaagaagtctagatatttgatccacagaagcattttgttccatggaggacgtggagtttgttgctttggatttgagcttcatttaaagcatttgcttatttttcatcttgcaaaattaatctaaatcaacttaatgaagggtagaacattgagatatatacctgttaatagtagaataatatgacatggcacagtatccaggtatggaaaaggtgaatagggatagtgttatgagatttttagagtacgttaattttataaagcatgcttatgggaaaagccaaacattgatgacatttcgcagaaaatgttatgttcaggtttggcaaataccaataaggtcagagaaaaagcaatatgaatcagtattaagaaaattataagatagtgtatgtctaggtcatgatctttagtatcatcaataaaaccactaaggatgcctcactatagctgtgagatgggttcggaccatgatatccagtttaatactatttgggagcagaagtaactagatatatttatcctatgatattttacacttattggacacctgttgaatctctgttggcttgagatttaatttgctaagagaaaagcaactgaagttactaaggtaatagacataacatatgatctaaaaattgagagtacgttaatcaaggggagtgagcagaaattattctcgtcaatcatccatgtgtccctctatatccttcacctttattgctgttagatttggaggaaattctgagcaatgttccgtgatcaggggtgaaaagtgtcatttctgggctgaggcagtttatagtcatttgcaccttttctataccactctctttccctgccttctcttctcaatgttctgaaaatcttgtgttctaaagggacttgaataagatggagatagagtgccaacccacattagcatttatagcatatatggagcaagaaatgaacacgtgtgtatgtctttatgtaagttacagatacttatctatgatacctatcctgactattgcaacatgttaagctttccactgataattaaatttcatatataaatagataattaattttgatatttaaaaaatgtaagttacaaaagcactatgctactctgagaggaaattgagaaatactaaagttttctttcatggagccccatagttggaccttcacaaaggcttcaaaagctagtttcctaaccagtaaaagtcagcatgagacacagtgggctgagataacaggcccctcagcctaggggtggtttgctgaagtaggaggccagagcctctggatgagtcatcttcagttgttacgacggcttactctgtggaccatgcaaataatatcattttcgatgtgttccatgatgcgaaaaagttagagaagtaccataggtctttgtatcaggcaccaatataaccacccctacactccagatcttctttccccatactcatttctccactctcctccaagtcctgcctcaaacgagttattattttcacataaaactgagaaggaactgttgaaatgactgacatcttcagcaaataaaatagttgtcaaattaataaataaatgtcacttgaggcacttctgagcttctcaatatgtcttcttttggaggactatttgttggcataggagaagatttcctagcaaccctcaaaatctttccaattaggaacctaaattctattcccaaaggttatgatataaagaggaaacttgaaaatttgtaactgaactctattgaagtatggggtatttcaattgagtaagcccaatatttacctgcatcacaaaaaaactagattttaataatttcttatcaagtgtttatgccatgtaccatatttaacatatatttactcattagtttttcaaaattcttatgaaatgatattgtttttatacccattttacagatgagaaaactgagagagaccttaaggagctttctcatgatgcatggctagttaatggcagaactcatgttaaagcaagcagtccaaccctgcctgggctcttaaacagtggagtctgctgtctccttttaataggatgaaggtgaagttctcagcttgatatttttgtttcattcagtgcaaagtgtcatcttctaccccagtgccaaaaattacttcaaagaaaacagctttttgactaccgacagttatgtacaagaggtgtgatttggggttttaagagcttactttgacacagctcagatcccttttttggtagtgaaaattatgctgttatctcctaaaaaacatcatctgctctgtccccacctctttaatttgacaggtgattccatatccatgtaagagcattttggtgtctgaaaaacaataaaaatcgtcccagtaaacccatgttctattcaaaaaattttggcatattgattgtctggggtaaggttcaaaattgcataaacttccttgccccacaaatcactttgttgcatcgacaataataatcacaattattgatagtaaaataatttggccattctatgaatagtaaggactgcacatgttaaaaagaggcaaaagaatggatagatgatcagaatccattctcagtaaccagagctaaggaaacagctcaagtaaaaacgctcagcttacttaatgctctatagtaattaatagtaattgataacaacttgtagcaattaagatctaatgcacttaatttgcaaatgtactccttaactttgaatacacttttttctctaaggcgaaagtctagaattggagactcttggattcttcttcccattcttttccttcttccttggaaaaaatcagaaacaatctcgaaatgtggcctgttggagctggaaaagagcttagagattgttctagtacagttgtgtcaaactacaggtgaaaactttgaatcttggagaagaccactggtttattccacctctctagccatcggcatgaatgtctattggtatacttggtttagctgcccaatttatggccaagactgggacatgatatggtacaaaatatggtgtttttgtataaagagctatctcttgttccttcgttgtaaggggactgagggcacaagagttctaagactgataatcccatcaacttaatatattaaaagaggttttatatctaaagcatccaacacagtgtctggcctagaggaggcactatatctatagaacaaataaacgaatgttcgaacatagcctctctaaattctatttgaatgacttaacacaaagatcagaaatttgcatagctgtttgtgttagccctttaaaacaaaactctcctaggggaacatatgtgaattctattcagagtttaaaaacagattcatgggagagccccaaaccaatcaaaaacatggcaaggtttaaaaaacaaaaaagacaaaaaacaaaccagaaaaaaaaaattatgaaaagaccctgcctgccaagagtgacttgtttgcaattgaaaacctggagatatgagtacataatagaaacgtggcaatgatcatctgggcaaaaacacaatttgtatgacaatgaatcaggaaatgtcctggaacaccagaagatgaaaaacctgggattttataaggcacattcaagttgctgcgcatgcgtcacaccatgaattttcctgtggtctgacatcctgttaaaagcattggtctctttctaaacattggtagtagaagtgtaccacaacaggcaaccttacatttaaagaaagaatgtaatagatacctgtggaaactgtcaaaagtgtcttctagagctatttttgaggtctcttttattccttcattcctgatctgaaattcattaaggctaagagtgccccttaaattacgttctgctgtatcctggaggaacacctgaagaagttaataataaaccctagagattaggcaagtggaaagaattatgaaataaaacaaagcaaagaaattgtgtaaacaaattaattaattgtctgaaagtgaaagcatgtttgtaattttgcccttgtcaaagaaaaattggagttcattatgctcgctgactgatttaaaagcttcttcccgcgtagcatcaccgggagaatgagtgtgttgtgagtgcaaagcatggatcggttgcagcatcaattaaaatagaaattcattattgaaacctccagagtaaaaggtttgtgctttctgctttgaggatgggaggaagcttttcttttcttatttttaagttttgtttattttttttctctcctctctccaattggtataggaacatttattttggatttccagtagcaggcattctacctttttgtaataaattatattaatacctgttatacattgagcacatgctatataccaggcattctatatactttatcatctttaaccctcagagcaatcatgtggtgaaaggtatccatcagtatcacttgaggaaactgaagctcacggaggtaaaattgaacagctactaagtgatgatgccaaggatttaacacaccctaggtttgtctgactaggaacttctggtctctccaggacacaacagagccttctaaggcaggtttactgtgttgagttgggtttgcccctataacaaggctatcaaagatatatgtgtgtatccaggataggcattctgtattcagttacgtgttggagtgctatcgagagcccagtgggattataggtggaataagataccttcaacacagccatctgctgcatatggtgacccttgtgctctccaaatgagcagaagctcaaccagctttgctgaaatgtgtttgatgagaggatggtgtgttttacttttgtgacatctttccccagaggtggttgcctgaagagttgaactttagagaacaaaaagaaagaaatgtaggatccatttatggtctctcctagaatcatgccatatgttggactctatatggaaagggaggaggaataaaatgaagaaagaggagtacacagagcatggaaaaccataagtacgtgtgatccatgattacatcattgcaccttgcaaaaacttgttgattttagctctggggaggatgagtgaaaatcatggagtcagagcagaatcatgaaaagagattggttttggagccaagggaactcagatttacatctggtcacaacattttttttttaatattccctttttttattaattattttttttttaatttaagttccaggatacatgtgcaggatgtgaaggtttatttcgtaggtaaatgcattccatggtggtttgcagtacctatcaacccatcacctaagtattaagccctgcatgcattaactatttatcctgatgctctctctccttctactccccagcaggccccagtgagttttgttcccctctctgtgtccatgtgttctcattgttcagctcccacttataagtgagaatatgcagtgtttggttttctattcctgcattagtttgctgaggataatggcttccagctccctccatgtccctgaaaaggacatgatcttattgcttttaatggctgcatagtattccatggtatctatataccacattgtctttgtccagtctatcattgatgggcatttaggttgattctgtgtctttgctgttgtgaatagtgctccaatgaacatatgtgtgcatgtatccttataacagaatgatttatgttcctttgggtatacatcttgtaataggattgctgggtctaatggtatttctggttctagatctttgaggaattgccacactgttttccataatgtttgaactaatttacattcccaccaacagtgtaaaagcattcctacttctccacagcctcactagcatctgttgtttcttgactttttaataatcaccattctgactgtcatgagatggagtctcattgtggttttgattttcatttctctaatgatcagtgatgttgttgagctttttttcatgtttgtcggctgcataaatgttttcttttgagaagtgtctgttcgtgtcctttgcccacttttttttttattatactttaagctttagggtacatgtgcccaacgtgcaggttagttacatatgtatacatgtgccatgttggtgtgctgcacccattaacttgtcatttaacattaggtatatctcctaatgctatccctccccctccctgcaccccacaacaggccccggtgtgtgatgttccccttcctgtgcccatgtgttctcattgttcaattcccacctatgagtgacaacatgcagtgtttggtttttttgtccttgcaatagtttgctgagaatgatggtttccagcttcatccatgtccctacaaaggacatgaactcatcattttctatggctgcatagtattccatggtgtatatgtgccacattttcttaatccagtctatcattgttggacatttgggttggttccaagtctttgctattgtgaatagtgccgcaataaacatatgtgtgcatgtgtctttatagcaccatgatttataatcctttgggtatatacccactaatgggattgctgggtcaaatggtatttctagttcaagatccctgaggaatcgccacactgacttccacaatggttgaactagtttacagtcccaccaacagtgtcaaagtgttcctatttctccacatcctctccagcacctgttgtttcctaactttttaatgattaccattctaactggtatgagatggtgtctcattgtggttttgatttgcatttctctgatggccggtgatgatgagcattttttcatgtgtctttcagctgcataaatgtcttcttttgagaagtgtctgttcatatcctttgcccactttttgatggggttgtttgtttttttcttgtaaatttgtttgagttcattgtagattctggatattagccctttgtcagatgagtagattacagaaattttctcccattttgtaggttgcttgttcactctgatggtagtttcttttgctgtgcagaagctctttagtttaattagatcccatttgttagttttggcttttgttgccattgctttttgtgttttagacatgaagtccttgcccatgcctatgtcctgaatggtattgcctaggttttcttctagggtttttatggtttcaggtctaacatttaagtctttaatccatcttgaatatcttgaattaatttttgtataaggtgtaaggaagggatccagtttcagctttctacatatggctagccagttttcccagcaccatttattaaatagggaatcgtttccccacttcttaatggggtggtttgtttttttcttgtgaatttgtttacgttccttgtagattctggatattagacctctgtcagatggatagtttgcaacatttttctcccattctctaggttgcctgttcactgtgatgatagtttagtttgccaatcgcagccacttttaacactgttactctgggtaggttatttggtctgagtgtcagtccctccttctgtaaaatggggggaattcctgaaggacagtgttaggatgaaatcacattacttataatgtcgaattcctctgtcaatgcttatatgcttctcattcattatttctaagtcaagcatttttaaagcatttaacatgcaattattcatttttgtttataaagtgaccctgtgaacttatccctattttacagttgatgaatctgagacactgagagattaaataacctacctaagatcatccagctataaagtgatcgagacaggttttgtttgttggttggttggttttgagatggagtcttgctctgtcacccagcctggagtgcagtggcacgatcttggctcactgcaacctccacctcccagtaatggtgcaattacaggcatgcaccaccacacctggctaattttttttttgtatttttagcagagactgggtttcaccacgttggccaggttggtcttgaactcctgacctcaaatcatccacccacctgggcctcccaaagtgctgggactacaggtgccccgctcaagacagattttaaacctagcattcttgctccagaattcatgctgttaatcactgctattctgcctctctgttgactctcagaacctctcttggtcaaagcaagaaggtatcgaacagacttcctgtgctgttttataagctgcctcaaatccttccaggacagggcaatgtctatataaatagatgttataaaaagtataatctaggccctatttatttttctctcagattcatgtctaattcataccagttgagccttgctatttgagtttcacttaaaagcattctgacatagctcacctcccctctttctcttatattgctacccataaggactagagaaaagatggataacataatcctgagtctatgagttgctagaaattcctcattataattgtgtgtcttctggcaaaaataaataaataactttctcttttaaagccacttataggagacaatgcacattctgtgttttttctctgtggctgtgcatggacacagactcttctgcccttctcttgcctgttccttgattcctcatgtttctgtctggtgcctacctgagatccaggtattcctctttacctcgtcgtcttgctattttttctagggacttttcttctcccaaagttatgttgaaacaggcaaaacacctagaaatgggtcatgtgggtgagtagaggggagtgagaaggagagggaaaaaattcccaaagctcatattaggcaattacagttctaatgaatagaagcagtctattcaggcttctggcaatattttatgctcacctagtgtagtctgtattcccttaaatgggtaaaagatgccttaaaaagattgctttgaaggatgaagagacttgaaacaactctctgaacaaaagaacttgtttattcattcatttattcagcttgcatttattatgtgctgggtattatgcatataaatattttcttaagttttgtttttaattaacacataatagtatatatttatggggcacagtgagatgtttgatacatgtagacattatgtaaaaatcaaaccagtgtgtttagcgtattcatcacctcatatatttacctttttcttctggtgagagcattcaaaatcttctcttctagctattttgaaatacaacaatacaatatttttatccctagtcaccctgctgtgcagtagaacaccggagcttattccctccatttaactgtaactttgtacctgttgaccaatcatggtccctattctaaaagtgtcacagcctaggtaggttgacaaacaggtaaatcaggattacaatacaaaagtaaaatagcctggatcaaggaaagcacaggttgttatggaaacacaagagaggacatgtaaataagattgagggaggttcaagaaggcttttcaggagagatgacttttgaactgagttttaaagaccactgggtagacaataggagaaaaaaacatttctggctaagaggttagtgtggatgagcaagtggctctgtatagctggaggagtgtctgaattttccaacatgaaaaggaccacaaacttggtggaatcaaacaaagattttttttttcttttgtcacagttctggaggttggaagtccaaaatcaaggtgtcagcaaggctggttccttctggaggttctgaaaatgaatcccttccatgcctctctcccagcttctggtgctggtggatgcatcactctgatctctggctgtctttacattgccttctctgtgtttctccttttctgcctgtatcttctcttcttctaaagacacttgccaggccaggagcggtggctcaaacctgtaatcccagcactttgggaggccaaggcaggcagaccacctgagtttgagaccagcctggccactgtggtgaaaccctgtctctactaaaaatacaaaaattagccgggtgtggtggcgcatgcctgtaatcccaacgattcaggaggccatggcaaaagaatcgcttgaaacccaggaggcggaggttgcagtgagccaagattgtgccattgcactccagcctgggcaacaagagcgaaactcatctcaaaaaaaaagatacttgccattggattcagagcccacctagataatccaggatgatctcatctagacagcctttactaattccatcttgcaaagactcttttttcaaataatgacacattcatacattccatatcttttggggagacactatttaacccactacaaggtataaagatgagctataggcctgatgaggtaggaaagaggcagggcaaggtctcccagacactcatgtacctgacaaggtgagtctcaagagacacaagaaaaccttggaactgtaattgtgaaattgacatctatctctggaaaatgactattactcctaatgcctctagccaaagactatcagaaacccacctgtagctgatggagttgcatttgttactcattgtttcgatgaggacacacatcatgaggaaccatcatgtctcagctagagggtgttggagaaaacctattgtaggaatttgactttggttgggtaatatgaggaagcgtccaagaaagcctagttcactttagattagatgctgtcagaaagcagaggcaattctaaaaatgtgtatcttgattaaatcttctctgtatggaacaagagtgaggataaagttgtaaatgataaagaagtagcaatcactagccaagagaggggactgtttgctattttgtgggtgaagcagtgactttgtttttctgtgcattgattaaattaagatgtagctttgttttgactcagtttatcatggtctcagagtgacttcttctgagattggtattctgtgacattgctcatgtgcaatagaagaataacaagatctagccatgagtgccaggttacgttccagatgtcacaggctgctcttttgttttgtttttctttttcaataccaagtgataagaatgagcatgcctaaaattccagcagttgtaataaaatacatcaaccaaaaggttcagactgtcctgtaagacccataataagagtctcaatgtgttcttaaaagaacattctttcttagcctacgtgaacatccttctctagacttaaattacttctgacccacatgttgggccgtatctattttaaagacaagaggagctaactgcaaagttccttgtctggtaagctgtttcatctgatagttgtaatagcattttctcccgtctcactgtagggcctaaccccacaagcatccttgtgaagaaagaccccacagtcctctttttaagctttctccctccctttcctggggtgccttatctatttaaatattagaggtgagtcaaatgtaattctctttaatgaaaaacaaacaagtgatagaaccctaaacgctcttttggcaaagatcccttcagaacaaacaatcttcttttaaaagaagtcagagctaggaaagggccacaggagagcagggatagccaactaaactatgcagcaggcttctctgaaaaaaagtgagtgacttttttggtgtggcaagaaaaaaaaaaagtaaagtttgatataactagtagtccttggaatgacaagtgacaagagaggtctcttccctccctatagtcccaaggagaaaagggctctgtaaaattaaaggcacaggtattcagttgaaaggacatatttttctcctctaacttataattagcctgcgatactggcttctgtaggctcttatgaaggcaaattgctcaggacagtgactctggcgatgtcagtcatacaggcaagcactgggatatctatcacaaacacatgccagttgtcatcttccaaggcatcacctgattgccaactcaggtcaggaagaaatcattcctctttcttcttctgtgatgttacttatctgttgcaacagaggagagggttagcacctttcatgacatattccagcatcctgttaaattgatcagaagaccaattgcacacagtgtcttctaccattgagattggaaacacagccaagggtggagatggtcagtgaggcttcccagtgtcttgcaagttccaggtcagttgtttatgcttagagtcccctgacagagagatggatgtgttagcaggttctagggcctgtggtttcccttgtggaaatgccagtggaccatgtgtgctccttgggtatcagggtgattgggcttgggttggttgtggccacagcatgaactggagagtcggctgtatttggcatgacaaggttggcacaggccagctgagaccttgaaaaatttggagctgatgcagaggtgaataaacacattgaaaacagaagctgcaacctcaaatttctacagggaccagacaggtaatatgcctgagtgaagcaggccaggtggcaaattgtacagtgcaggccccaatcaaagtgcacagtggccactcagctgccactggattataattgtgtagagatgtgagtttagagttgtcagcttttcaagagaagccaacagtctggtgtgtatgttaaatcccctgattctggcatctaattaatgcccttagcagtccaaaccaaacaatgtgtgagctgccatttttgcaaccttgagctaatggtgttaacgtccagtttctttgtttcataacatctatggaatggctttgtgaatgcaaatgttgaaacattgtgagtctcatccccaacagtgaaaataaatacaaaatttaggcaaaaaataaaaataaaaataaaaatacttcttaaatgtcacagcgcccccatggggctggctggggcaacaaattaagggacacagctgagctttcgattctgtcagtaactaagtagtaatggtgcctcagggggtctgagtcattgaacaagcgctacaggatagcacaatactaggtacacaaagtaggcgagcacaggctccctacctttgaaaagtttataagttcattaacagtattatgtttccatgcactggagcattagaggaaaaatgccacgataacatctaaacaagagtgcagtgggccctgagaagtatgatgattctgtttccttctttaaagcatctcttcttaataatgtgcagtagtagagagaatagaaaagcagcatgatggccatgtgacttgctggatggatgccatttctgttggatgagattggacatcaataggtaaaaccaataagaggttgtgtgcattttcagattctggaattctggaatctatgacatttttggaaaaatagctctcctaagacactggttctaaatatagcagtgggtttcaatagttctatgaattgaaatcaatagtactaaggagcgaagagcctagatcactctcccaagaatcattgcttagatgagtggttctcaaagtgtagtctctggccaccagcatcacctggcaacttgttacaaacgcatattgttgattctcattccacaactattgaatcagaaattctgggactgagtcctagcaatctgtgttttaaacaagccctccaagtgatttaatgcatgccaaatactaagaatcactgttatccttggaagaggggaaagctcagataacccacaattgaggtctagagatgttcatagtctcttctacaagtaagtcttaccagtgagctatagtagagataaccaagatagcatgtagctggaggagctgttgcttatttgactggattttttggtcattttttctttctcacttatgtgtttgttctccacttgttttcaagccccattgatttctgtattagctttctattgctgctatgataaattaccacacattttcatggcttaaagcaacacaaatttatgagagttctgaaggttagaagtccaatacaggtatctctggataaaatcaaggtgtcagaattagagcaaatcccttcttggggcctctcgggaacaatctacttccttgctttttccagcttctaaaggccacctgctttctttggctcatgggcccttttcttataaatgcagatgttgtttttaaaaatgaacaatgttaggctgccttcctcgaggggctgtctctcttgttctcactcttctgcctccccttccacctttaagtatcctgtgattacattgggtgcacctggatgataggcaagctccctattttaagatcaactgattagcaaatttattcccctgtgctatagaaggtaccatattcacatgcttcaagaattagaatatattgtatctttcatgggggaggtacattattctgcctaccataagagattgtattcggagggcttgtttttttttttgttgttgttgttttttcaccaggaaatggagcctggtgaaaaatgtaatatatagcctcttcctccacactactaaactacctttctgtgtcctacagagactgtgtaatattcactggtgaagacataagctttgtagtcacaaacctgagttgacgttcctactctggcacttactagattgatatggtttggctgtgtccccacccaaatctcatcttgaattcccatgtgttgtgggagggacccggtgggaggtaattgaatcatgggggtaggtatttcccagggtgttctcctgatagtgagtaagtctcatgaggtctgatggttattataagggggagcttctctgcacaagctctctttgcctgctgccatttcacgtaaggtgtgacttgctcctccttgccttctgccatgattgtgaggcctccccagccacatggaactgtaagtccaattaaacctctttcttttgtaaattgcccagtcttggatatgtctttatcagcaccatgaaaatggactaatatatagatgtaataactttttgcaagttatgcaattttgggccatagattcctttattctgaagtggagaaaatactttccttatacaattgttatgtttacataaaataaggtgccagatacatagtagaaataaaataaatgatgttactacttcctaaaatcctaaaagtttcatttcagattgctgagtaaacccagttaaagaaaccagcctctgtgttttggtgttgtcattaatgctaagttacatttccttagggtatctgcattaagcaaatgtaagatgtttgagtttcaaagatgaacaagtgacttgtaagtgtaaagtggtatggctgtttttaataaataggtaataccacccttttggcgggtagtagagaaaagaagatgagtttttagaaaaagactcagagttactcagaattaagaaaatgaatccttactgtcaatatgagtctcccaactgctagcgcaagtggtggatagattttcttttccactagatttacttcctgatatacacatttatcactcaagcatggactgttcatcaagtcattttccatctataaccccagctgaagcctgacaggttgtgtgtttattatgtactcttaaaaaactggagctcatttgcccctgctgcggggagagcagactcagacagatagagggataaggtcattcagtggaatgcccattcactgcagtcaagcctaaataatagagaggtgtaaaacaaccaggaaaagctctgattattgccagaaatcaaatattgatcagatagtcccctaacttaccaacttccctcttaatgatctgattcccatgtattcattcatcagttagttgagcccctcctatagaccaagccctgtgcatggctataaaaaacagtatgtccatgcccacttccccctctacactcaatctggagccatgagaaattaaataacctttaatttctgaagatcgggtgctcttataaaacatcagtacttataattgtatcctgcagtggaaaattgtgcaataatctttttctgaaggcatggccatgaattgtactatattactccatctatcttcttttaacactaaacaaaatgaagagaatacattgtgcatggcccctagaaatttaccttcaaatagaaacaaagctgctaactccacacacacatgatatgctgaaaactgaataaatattgaagaatctaaattcaattaattagcaagccaaatcttgcctcaaattatgttgacattatttattcctttgttgattaaatgagttgcctcttaagccaaaagagaagatcttaagctcttgtttcttcattccaggtctcttctctccaaggaatttgggaaggagcaagcacagcagaggccagttttactgcatgctggtgctcagagggaatagggttcatagagtagaagacagtgaggagagaaccagtaaggaggttggggagctggatagcatttacagcatgggttcattgattcattgggaggcttataaatttcctatgcatagaagcacctgtttttaaacagagacatgtattcaacacatgccttcgagaactaattggaaagagtctttgatggcctatcgttttgaatttgcatgaccagaactccactatccatgcaaacacagtggacttgctgcaattgtcctttgacttaggcaactttaacaatgcaggggaggaggggtgagaagaggctaggagaggaagtgtcagtgggagaagccaagaataattgaagtagtgtgttatttcttttttttttaactattaattttttttattattatactttaagttctgggatacatgtgcagaaggtgcaggtttgttacataggtatacatatgccatggtggtttgctgcactcatcaacccatcatctacattaggtatttctcctaatactatccctcccctagccctccacccacctgacaggtctcagtgtgtgatgttcccctccttgtgtccacgtattctcgttgttcaactcccacttatgagtgagaacatgcagtgtttggttttctgttcctgtgttagtttgctgagaatgatggtttccagcttcaccagtgtccctgcaaaggacatgaagtcattcttttttatggctgcataatattccatggtgtatatgtgccacattttctttatccagtctatcattgatagacatttgggtttgttccaagtctttgctattgtgaacagtgctacaataaacatacatgtgcatgtgtctttatagtagaatgatttataatcctttgggtatataccctgcaatcccattactaggtagtatggcatttctaaccaccctttccttccatgagcttaggcctgggagttgcagtgagtgggagccttaaatctaccaagccgcaaatttctgtgttcctgaggcctctcaaggcatcaacatcttgaatagaaaataagtctatccttaaagatacagtacatttaaagattaaaaaaaaaaaaaacaaaaaaaatcatgttccctaaacacaaataacttcatctgctgcccaagcaaagaaacaaagagatgtctactaaaggcaaaaatgccaatgtcgtgcttcctgagcacagacattgcactgcacagaatggaccattttggagactttcaaagacagttttgactcagtaatctcctatgctgactttattacctaactgtgtcctgtggaggattaggtgatagtggcaggttaggtccatgggagattggattccactgtgatcagcaaacagaataaccagcatgtgtgaagtgacttttgtcagaggagtgatgaggagtgctctctgaattcagtgttttccctctttaatttttgctaatcatgggtcatttatctgtgagctactgcattgtttccactgcctgctttccaaccagggataggttttatctcaaaaaacagaagacaaaacctcttaacctaaaactaagactccctctgggagattccaaagagagacggctttgatgtaatgggaagggagctgatttagggtctaataaagtcttctaccagctgtgtgatctttggcagtttctagttccctaggtactatttgcctatctatagaaatggggttaacagcacctactgctgaagttggtatggacataatgagataccatacatgtaaggaaatgaaaagtattccacaaatactccttccctgagcttgttccttcctttcaccaaaacacacatattccatctttcaactctcctgctctacacgtgtatgcttgagtttagggccctggaataagcaatcctgggtcaacatctgctctgcaaacatcaaaaagtgtgagcaggggcagcctagccttggtattgatgtgtttcccatccacagccacattcaccattagacccagtattagtcactgggtccccggggccagcatttactgttgccttcaaaaatgcagactcattactaacaaaagtggtatgtccattattatgacctatttagtggcccagcaaatccccaaattctattgagccacatctgtctaccgaggggctctgcggttgattgtctgagacggatctgcttgcaaagaggctgatttgggaaagttcaacagccccacttagttgctctgtgacatcctgacttcctacaggttacttctcatattgttgggtgtttgtttgtttgttagtttgtttgtttgacagaggtctcactctgtcaccaggctggagtgcagtggcatgatctcggctcactgcaacctcctcctcccaggttcaagggattctcctgcctcagcctcccgaatagctgggactacatgcacaccccaccacaccaagctaatttttttattttttagtagagacgaggtttcaccatattggccaggatggtcttgatctcttgacctcatgatccacccgcctcagccttccaaagtgctgggattacaggcatgagccaccatgcctggcctcaatgttgtgttttaaagttcagctggaagatacccttattcctaagaaatccactaaagaaaactgttcttccaggagttccatttcattctctgggaagggtccatcccttgttcctgttccctttcctctgaattctataggacatatcacagcaccttcttgctgcctccttgtttgtgtctttcattaaactgtaagctccacacatgcagggactgtatttattttttcagagatgtgtcttcaacactgaatgcaacagtgacacttgacaaatatttttcaaacacattgaaatgagtttgatcaccacctgggcattcacagtagtccagaggtcccctgcactgtgagtgtgactaaagctcaggaaagtcagaaaggccagccaaggaaggaagatgctggcaagactcggaaagtgcaggagtgtatgagattgaatcacctggacaggggcacccaaacaaaggcgtctgctggctacgtgactttggttaagttgctgaacttctttgtccacagtttcctcaacactaaaacaaggagtaatcattatatctactttatagggctgttctggggattaaattagttaatatttataaagcatttaaaattatacatggtatgaaatgagcacaaataagtgggatgagggagacataaacaaaagttcctaaagtggaggttaattcagagccaaagacattgcctgggcattagaagtagtcagacatgaatttgagtcccagctaaggcatttatcaactgggtcggccttgaagaagccgcttgcattctgagtcttgctttccatagctatgaaatgttctcaatcacagttatctcccaggattgttaagagaagtttcctttaaatgttcagaatagtgaatggcatttcttatgtgcctaataaatattaactcatctactgccatcccttcctttctttccctctcattctttctcttttcctggcccataactttctgctcagaactggaaacatctttgaaggagggagaaggagcatgagagtcaggggcttgtttacaaaacaaaacatggaaatagtaaaaacaacaaatctaatagtctctgaaatgattttgtctcccactaggaccagaaaaagcagcagaattttatgttaatggattcggtggaaaatacggctttaatgaaacattgactatgattactctgttgtcatttctctgaatttctggtcctctttccatctctcttttaagaagatctgaatggttatttctcaacacaccaggattatgttttcttcgtcaagagtttgaggaacctagggtgcagcttgagctgctgagctgtctgtctttattctgacaggcgtggactccagtgtttagctcaagccccagggactggcttttgaacagcagctgttctcagtgaaactgaaatgcgcagaggggaggggaatagtacaccctgggaagtacagggagcaggtaagttgttttgctaatacatccctggggaagtttctagtgtttctgggcatggctgagcgcacagctcataaaaaatgcaccagatcattgttggcatttgatgtcagaagaagctacagtaccaagagacatggactgtctggtttcctgtgacatccaggtgacacaccaggtttccactgcttttcgtcattagcccagatgttcccagttacttggacagagagccttgtagatccctgtatatggagtcttccttcccgtggttcattagaaatggcaaagccaaactggcagtattcttcaatttgttgataagagtgcttcagtgcatgtatttacaaatacacattgttgttttcaatttgtttattcagtgaatcaaaatagcaaaacacattaactataagacaagagaaggataaggaagtaacatctattgggtacctgctatgttccaggcaatgacagagctgcttgacagaaaatgtttaatgtcttcctcattgtagctacatgtggtgtttcaggtatgattactgcatgttacagtgggaagtagcccagcattcttgaaagagtatagggtcctcactatctgtgtgaatttgagtagttacttaaaccctctgagctttattttatttctgtaaaggaatttaacaaagtggctaatagggtgtgtagggatgaagggacttttaagtttgctgaaataaactggaaatagattagcaggagagaaggcgtacaaatttattaacatgcagatgtgcacaggatccacacaaaatgggaagactcaaagaaaggccagatagttgaaggttaaatacccttttcataggggagagggaaatgggggacattgccaattttagagaaagagtaaataatttttagaggagatgagtggcctggaagaacagatgatagcctgggacaaagttcctctgcactatggggcaggtgatgacaagctataggaaagtgagggacagaactgcgcttcaaacaaaggttgttttattatacagataaagtctctaaggtaatggcccttagaagaataatgggaagaacaggtgaaaactctgtctgggtgtgttgtgggtgccctggaggtagagacttcttcttatctctcctgcatcagagttaatcttctctggttagtgtagatttcagggagcggtcaaagaccattgcattccttctggataaactttcttctggtgagagaacttcagagagagcccctccctacacttaggaaaggaatgtggggggtggggaaagctgtgcaggagaaagtcagagaaagaccttggttctgaggcctttcaaccttctttgttcaaagcaatcagtatgccaaagtaccatattttggggtatcattttctgagcctcaacaattgtcatgaagattgagtatgattgtaatataaagggctaacatttttacttgacctacatgagctgatcagtactgagagctcctcttacaagaaatggaccagagagggagggaaggggaaggggaggaaagggaagggaagggacaaaaagaaagaaaataaagaattgaggttcaggaaggttgaataatttaattcgcccaaaggcttacagctgctaggacgttcagccaaaaattacacccaggtctgatttcaaagacactaaaaccactgtttacttatagctacttagtgcaccccatctcatcccacccaatgccacctaactcccacctctattgtgagataactacatgcacgcactcatttggtaagtgggatcctggtgcctatttgactgacatttgagagttagcacatacaggtggcacaggtggtatctgcacagaaggaggaaggtggtgctgacacctctggatcttacacttgggtttagaacatagctggtcactaaagccacagggtagtggcagaacatttggatacatctttaaagactcaattagtatcccctcactgagtccccatcttattcattggttagccccctagactgaactgtcaaaaatgttctaagtctccttgtgttctctttatctttgtttttacaatcacaacacaataacaggagatactttttaatgaatgggcaggaactctccactgagatgtaaacatgttatactgggaattctgctgcagggttaatttatgatgatggagtcatctatatcatagctgaaagcaaggctttggggaagtgaaacccaggaaaggtcagttgtaatgcgcattgtctatattttaatgtaaaataccaattttgttgggaaaagggtggtcgggaaagaggtttgatccaaaaggttggaagttggggaaataattcaaaaagaaaactccaaataaacaacagagttggctggtcagttagccaaaggacaccggaggattcctgaaggtctgcatgtggtgagcacaaacttggtagggaaaaggcaggaatctgggtggggagaaggtactagaattcacaaggaagactcgtaaaatggaaactacggttgctgaaacacgttgtctactctattaattttctgccaaacatttcatgtgcttttagttcttcattgagcatgacatacttcaaatactcaaacctatttccttcttgtaggaatagctaggcatttcctcccacggtccaaggtgagactgaagataagtagaatctccacacttatttgtttactttggtccagactatagagtcaggttaaaagccatctggggaaatagccagtagccaatgcttattagcgtactacttgggtaggtgggaggatgcaagagctgtcaaacagcagccatcctgatgagaaagtgaagaaagccagaagcagcgtctcttctgtggcagtcacacagggtcccttgatactcagcccccaacatgagattgcctcttaggagaattctagaggttaggctaggcttgagacattatagagaacaggttacagcaccccatttttactttattggtaactgagaaagtaagatatattcctagcctcccagtcttagtagtaagaggtacttttaaactgttaatttttatgagcaacacagtggtatggccggcccttcctcctccttcagggagttcatttgatgtagtttggttgattcccatgcatgtggaatagctatgacatcatcaaattaagtgtacactatgtgctaacaattatcggggtgtcaagagtgaaacattcaggtcctattggcagttctaataggtgaatctcatctcactgttttatgtgttcagtgaagtaaatcttcagtaagtctggagtagctggggaagccttcgccaagaggtgaggtctgagctgggccttgagcattgctgagatctgaatgggtggaaaacagaagagaggtcattccagtcaaaagcaagatgtactcaaaaaatagcaaggaaaaacagatcacctggatgagatagcatttggggaagggtaagactatagtatggttggatttattgaacaggcacagtgtcaggaatccaactggctactttatatacactacttggtgttttatcctgcaaagtaaccctaataaccagtagcatttgctgagagtgtatgtgggtagcaggcaatgtatgagatgccgggaatacagagaaggatgattcgatgtttgccctcaagacctcagaatgtaagtctaggatatagtaacaaaataagtttattctagtataataggaatatatacactttaccaaggaagcatagagagcagaaccatttgctttgcctgctagatttcaaaatgacttctcagagatggtgagttctgagctgggtggtgaaggatgtgtaggagtttgtcagataaggagatgaaacaggcattccaggaaaagggaatagcaagttcagagacttggtatagtcctaaattatgtttgtcttcatttcagctagtgctatttcattgttgctggagataacacacacttggattccgttacgtattttcaccttgccaacttgctttgtttgcagaccataatttctgagtttatctctacagcaggttttcagccaaattgctctactaaaataaccctaaaaatctatcacctctgttttctgctgctgtcactggctgtttgtgtccttacttttcagtcaacctcaatggagactggaaagagaaatacaaattgccccagaaagagaacacaggcccctctcttcagcaacagggtgtgagtggatggggaccattatcacattatctacacagacaccgttttaatccacattgccaaggaggagaggaaaatgcatggccttcacagaacatcattaggagggtgggccattgtgcagcatctattgttaatgtcaatacctacaaacatgtccagactcttccattctttagcatactcattctctgagtggtattttatgtgtattattctctgagaggtaagcacggacaagtataattccatttttatgtaagggaaagctgagtaaagaagatgcttaaagaataggtggatagaaaaatgaaatgacttcagctcataagcattttgagtacctattatgttttagtcattatggtagaaacatggcaaatggatataaacaaaaaacatataattccatgcctctgttcagattgttgtctgcccctgagattcctctttttcccactccccttgactaactcaactagccctgctttttgtttgcctgtttgttctatttattttttggaggacagggtctcactctgtcacccaggctagagtgtagtgatgcaatcacaacccactgcagcctcaccctcctgggttcaagtgatcctcctgcctcagcctcccaagtagctgggactacaggcatgcaccatcacacctggataaaaattattttttgtgtaaagatgaggtctcactatgttgcccaggttggtctcaaacttctgggctcaagcagtcctcctggcttggcctcctaaagttctgggattataggcaccagccactgcacccagtcaactagccatgtcttttggtccaacccaatgttgcacctttgcataacaaaggcaattaaagaccacttcttccctcctgccccctgcaaaaacctaatagttctcaaacacattggttcatggaactcattatatatgaaaacccatcaacatccacacaattagcaaacttaaccctctgcagggttgacattgagttggaccttaagatatattcaaggctagttggctgggcttggcttgactcccccttagctctctctataaaagcaatgattactgtattatattggttttcaaagaattctgtcccacattctgttctacttattaccttctttgcttgactgtgatagattgaggccatctttctgtctgtccctgtattaatacattcaggctgctgtagcacaataccttagcgtgagcaaaggaagttaaagaccacctcctccccctgccccctgcaaaaacctagtagttctcagactcattggttcatagaactcattatatatgaaaacccatcaacatccatgtaattagcaaacttaacacacttgaaaatgctacctttcaagtcagtattcatattaggcagactttggagatgttgtggattctgcttcataccaccacaataacgtgattattgccataaagtgagtcacacaaattttttcgtttcccagtgcatataaaatttacgttgacattctactgtagtctattaaatgtgcaatagcattatatgtaaaagtaatgtacaaaccttaattataaatatttattgctaaaataatgctaaaaaattatcagagccttcagagagtcataaccttttggctgatggagggtcttgtcttgatgttgatagctactgacagggtggcagttgctggaggttggggtggctgtggaaatttcataaaataagacaataataaagtttggtgcatcaactgactcttcctttcatgaaagttttctctgtagcatgtaatgctgtttgatagcattttctaaatttatttcaaaattggagtccatcctctcaaacccagctgctcccttatcaactaagtttatgaaatattctacatcctttgttgtcatttcaacagtgttcacgacatgtttaccaaaagtagattccattttaagaaaccacttttcctcatccataagcagaaactcctcatccattcaaggtttctcatgagattgcagcaattccatcatatcttcaggctctacttctagttaccttgttctttccatcacatctgcaattccttcccccactgaagccttgaacccctgaaactcatccgtgagggttggaatcaacttttttcaaagtcttagtaatgttgatattttgacctcccatgaatcattgatgttcttcatggcatctagaatggtgaatcctttctagaagaatatttcaatgtacttcgtccagatccattagaagaatcagtgtctatggcacctatagccttatgaaaatatttcttgcatgataagacatgaaagtcaaaattattccttgatccatgaactgcagaatggatgctatgttatcagatatgaaagcaatcataatcttcctgtatatctctttcagagctcttgggtgattaggtacattgtcaatgatcagtaaaattttgataggatgttcttttctctctctctttttttttttttttctgagcagtagctctcaacagtaggcttaaataaaccatgatgtaaacagatgtgttgtcatccagactttattgttcctttgatagaacacaggcagagtaaatttatcacaattcttaagggagccctaggattttgggaatggcaaatgagcattgacttcaacttaatcaccaactgcagtagcctaaaacaagagagtcagcccaagactacaccttcgtccagcagaagactgttttgtctgcattgaaaatctagtgcagccatctttatcaatgatcttagctagaacttctgaatagcttgctgcagcttctccattagcatgtgctacttcaccttgcacttttatgtatggaggtgacttctttccttaaacctcatgaacaaacttctgctaagcttcctacttttttttcctacagcttcctcactcttcttagccttcatagacttgaagagagctagggccttgttctgggttaggctttggcttaaggaaagattgaggctggttggatattctgtccagacaactaaaactttctcatgtcagcaatcaggctgttttgctttcttatcatttgagtcttcactagagtaggactttcacttttctttaagaactttttctttgcatccactacttggctcagtgcttggcttagcttttagtctatcctggcttttgatatgtcttcctcaccaagcttactcacttctagctttttgtttaaagtgagagacatgagactcttcctttccctgaatacttacaggccattgtagggtcattattgacctacattcaatattgttgtgtctcagagaatagggagacccaaggaaaggggaagagattagcgagtggctggtcagtggagcagtcagaaaacacacatttatcaatccagtttgggcaaggtgtgtggcaccccaaaacagttacaatagtaacctcaaagatcactgatcacaggtcaccataacagatataataataatgaaaacatttgaaatattgtgagaattaccaagatgtgacacagagatgtgaagtgagcccatgctgttgaaaaaaaatagtgtggatagatttagatttgcctaacttaaggttgctacaaactttcaatttgtaaaaagcataatatctacaaagtgcaataaagaaaagtgcaataaaatgatgtttgcttgtagttttaaagttttgtatgaaaacagtagttggataaattgtttgcctaagcctcttttgtagtcagagggctattgtatgtacttggaaaaagtgtacatgctagggacttccagggcagcttgcatccctgaggacgggactaaaaataacagagtcccctgctttgtgggacctaaagcttgtacaatttgtgtgtgtgtgtgtgtaacgtcttgagtaaaaagaattcaaaatataaaaatgatttcatttaaaatgaaaaaagataatgaaaaattacagattttaagaagttggtaaatatcaccgaaatggataaattaatttactatttgcaactaactgcttgacattcttctataacacttttttctataaaattaataatgttcgctatgaatgccttttcatgtgaaaattctgtaatattcctttctacagataggatagaaaggtaattcagtctttcctctggcctggttcgtcaaactttctaaaaaattatggatagtttttagagtttatattggtaaatttaagtgaatttttaaaaaatgttataacttctggcaaacctctatcaaagtacaaattctggtcctgggtgaccagagaggacccctaggtaagacagcactgggggtgggaggagcatttctggaagccattttgacacctggacagtagcaataacttaattctacaaggacaagattgtaagcttttttttttttttttttttttttgagatggagtctctctctgttgcccaggctggagtgcaatggcacaatctcggctcactgcaacctccgcctcttgggttgaagccattcccctccctcagcctcccaaatagctagtactacaggcatgcacctccacgcctgggattacaagcatgtgccaccaggcctggctaatttttttgtatttttagtagagacagggtttcaccatgttggccaggctggtcttgaacccctgacctcaagtgatctgcctgccttgccctcccaaagtgctgggattacaggcataagccatcacacctggccgattgtgagctacttaaagataccccaccaaagaacttaaagtgttccatctcagcaccctggccctgtgttgtcaagctgctcccccttccatcatactgtgcactgtatggtgcctctttatgaaccagacgctgcttgtgcaacagaggctgatcccactgcagagactgtatttgtcttctctttattttactggaagtctttgccaccatccggctggtaattgctccacaccacttctgaatcgattgcttttagagttgttgagcttttattactactactcattggggagagaagagagaaagaagcaggttggcctgggctctgcaagagacggatgttgtcaaattgtctttctccagctgttgaatacaactcataatgctattcaataaaaccagaaagaaaatgagagtacaagggaaagaagagatgtcagaaagagagaacaagagaacatacgagtctgccttctcttggaatagacagcaaagccatattgtgatgttgactatatcatgcagtaatggtgaacaaatgtagcaagaagtaaaagacagagctatttaaatatatctgtgggcaattgcacaaatctgccacttttgtaggtatactgatgtttcctcattcctggagctgagaaaaagggtctatgttttgctttattttatttctttcatttagtttggtaggctatgtaatttgattcaagtatgatagaatttctccttagttatacacattactgttattttgctagtaagtggctttgtatccacaatcaggacactcttatgaactgtttacatctgctattgactgatctcgttgcgtttcctcatgctttcatcaaaaggtagcagttggcagggccattcactggagaatgaggaacacgcataattagatttagtgaagaacaccctcattccaattggaatctgtctttaagaaaagaaaagaaaaaaagctccaggttaaggagcttcgaaagactgaatactgatgtaacttttgttcatgctaattactcacaacccagataatacttcgtttaatgattttatcccatttgttatcccctataacattcatctgcataaattagtttcttgtcaacctttcagaaagggtttaatgacagttcatggtgtttacttattttctaaaagtagtctaagtgagtcattataaattgaacattcaagttaaatttgtctgaaacatatataagtatcatataaatttcagattttacacagggttctcctctactaagcaggtggaatataccccccatttcagaatgccagtttaaattacttgcctggggtaaaataccaaatcagagttggacataaaacccaggtatccttattctcattctactattctaataaccagatccaatgctataatgctgcaaattataggccctatttttcgagtaggatgcatgtgaatgtcatttgtctcttaaatgcatgaatagtgtcttcccttgtggtcgctctactgcttccagcctgtcatgtcaagcagcattgcctttattattgaaatgaagacgatacttagatcattgatctcaatggcatttggcaccataagaactaccagtctgttgtatcatataaaatgatactgcctggtatgcaaatcagccagtgtgtcaacaaaaatgctggcatcagatagaatgtccaaattgctatcactctgccagttttacacctacatccctattagttcctgtctaattaccaatgataaaagtactttgaagtcccactgatttccatgtaaatatcatacaaatttggatttgctttaacattataattccatcagcttagaagttaaaatttagaaaagctgtagttcattagtttaagtcacttcaaaacttaccttgcttagttttcagatagactcccatcctatacttctaggactgtacaaataaaaaaatgaattaaaagacatttcttgatgggtttaatgttttctactaattattttgacagacagtcataatctgttctgagttcttcttttctccttccatttcaattcttcataaaacatggaaaaaactttggagactgaataagatctatggtaatccacaatagatgaggccctgaacacaacatagggaaaacatataacccacccccaataagctcaacttactgtaaactcttgaggagtaattagggacttcagcagtctctctgaaaaagccaacgcattgtaaaacccttttagtttttacatgaatattaattctttgaaagtagatgaaagactttctttaatgctaaattcttatccatagagaataatattagagcgaggatctagtgtattattcccatttcatgaataggaaacggagaagtagagaattttagggaccataaaagtgacccaagtgccatgtgtcaaagctaatatacttaactcaagcctattccagtgggttctcacccttcacttgtgccctaaggcctggcagcttatttcaggagggacacccgttgttggtgtaaagagcaagatcttttatgggtatcagttttaaggggcttatgggaataatcaatatgctatggaagtaatgaagatatttaacgtcctgaaaattctagtctaagctttgagaatgtgaccataaaattgacagggattaactttaatatttgactagttaacggtaggattttttccgttacagtgcactgtgtcaaaatttggtctcgttaaataaattcctattctatcagggatgagcttcccacaaataatgttaaaaaaaaaaaaaaaaggagaaagcatgataaaccttttttcctgtttctcttcttctaaccacagggtgcactatggcagttgcagggcttggtaattgaattcagttctgcaacctgaatacatttctactgtaagtggatctccctcctctaccagagaaagaaaatggcctcaaatgattctgactggaacacagcagccacctctcttgtaaatagctgggtcttattgacttatcttggtagggagccaaaattgctgcccagatgagtccaagcagtagccagaagagaaccagctacttatggggtctctgtctttgtgaaataagtattaagagggtccatcttaaagaaggaagagaagtatggtcaggtgagtcaggcaatgatgcttagtgaagtacaacctcagagttacggtttttaataatacgcaaaattacatgtgtaagtgtattgatatgttttataatacagcatgcccagaatctcaaaaagattaaaaaaaaaaaaagatgttcctaggttctaagtatttttctttgcatagtggtttgagggcgagtcaagtttataggtgtgctgacctttaagagagttaggaataaaagagggcattgagagaaagtggtttgggtcgcagacaccatccctcaaatagctgacaatgaaggtctataataataattggcattatctcaatttgccaggtatctttagtagaatgtgctttatctaatacccaaggtagggtttcaacaatgttgagaatctatttatgaaaaggccaagatgataatgttagctaagtgctaaatataataaaaagtagtcatgaccaccattctagacaagcttcattgtcccgcacactttatctggacctgtggtttctggatggttaagcggcttgtactcacaaagacaaattgtgcattcttggaatacattcttggaggtctgagagttttctgtgagtggtgctgaaagtgtatatttcatctcaatgacaatctcaaaaaattataatgcaagcatattctgaatgatcttgttgaccacctaataaccaggtatttttatagaattttaatgcttgtgttgagttgtgttcatggggaacaaacctgtcataccttatttggtaaggactattgagaaaagagcagagccaggttgagaacataaggaatgcatttatgtcaaggaaaaaataaaatgatgccagagtctgattttaaaaacaaagctatctcacgatttcaaatggagaaaacagggagggagaataaaatcacagcaagcttaattaggtgtgagcatcatgacctcaggagaacctgggccagagaagtcaggagtattaatgtttaccatggaactggtaatttcatttaaaccaagcagcatcagctgtcacattaaattaatattattgaaattttatagcatttatatttatttgtatttaatttataaatgggtgttggttgtgtaagtgctataagtataaatggattgtagctagttttatgtttgtgtatatatatgtgtgtgtatatatacatatatgtgtgtgtatatatacatatacacatgtgtgtgtgtatacatatacgcacacatgtgtatatacatatacacacacatgtgtgtgtatatatatatacatatgtgtgcgtatatgtatacacacacacatatgtatatatatgtaatgctaacaaaaaataatttgaatgattgccaggggtccccaagaatgagctttttcttttaaaattggcctgtactttctttgagaagccttgccacgggtagaggagctattcagtgcctattgagtcaaaatttggccttaatataaatggggaggttttcccttgccatgtttggtgcctgctaggtatagtcacttgctctaatttcagtagggtggtggaaattaccaataggcagaaaaagacagctttgctgacacctatttggttgaattttacaaaatggaaggatgaataatacctcaaaggcaatctggtagattctttgagggaaagagatgtgtctatttacagggaataaagctaagcacattgactgttcttaggttaatggaaaagaataaggctagtgtaggagccagcaaattatgtttcctccataattagagtcttataaaaatatcagcgtgaattacttgctaaatacaaattacaattgttaatgtttgttaagaaaaataattcaatttagagcaagaatgaaagaaatacaggcacccaagaacaggcacagaatacaatcactttaaccaaagcttagcatggattattttcccccacttcagcttcaagtttattctaatctttttctggggggcaggagacagtcggaggggaatgcatctgtatgtcccagctgtgtggcttctgagcctgacacccctgtgctctaacaagacccagggaagaaatccttagcaggctcttacccttatcagaacaaagctatttagttgccaccttaactccagtaattaactcagtggagcaaatttccttatttcatgtaagatgtgagccaaaactctccttgctgcacttcttctatctctgggataaagccaaacagagaagaaactcaaggaccatagaatctttccttgcttttagttttcctttgaggccctacctcccaactccctcctcacctctctccttgaccactgagtagtaccactactcagttaatactgaattttcttcttttccaagccctgcagtttactctagaatttctactgacaaagccaaatcttgctgtgatttttgcccccatggagaagcatgtattataggaacaactaaccctttataacttaggaggccctggggcttcattgcattacagagtcatacaaccataaatgcccagacatacatcaccagggttaaatcattttcagtatgaaatgatgtaatccaatttgaacactgcctcaaacccagtgcccttcatgtggtaagtattcaatacatacctaatattttaactttatttatttttacctcctccgatacaaaaaaatgtaaataaccctcaatgatctgtaaaaaatcacttagttggaacactttgttcatcctctagcaatgtctgataagttagttatcattacatcatgaatcatgatactcctcatcaggcagtaaaaatacagtaatttcgtttaattgaagggaaatacatgtttaccttggtaaaacttatatattatctttaaataaataaagggttatcttgttcaaatagcttaaacccataatcaaatgttgcttatagaggtcctgctttaaggatctcataatgatttgcatatcattagcttgtcagaataccatcctaaaccttgctgatatctgctctctttgcagttcattctttgttgcatccaagtattacagtaagttgttctctggcaatttgtttatactaatgatttgacagttattttttgacccttgaatgacataattatgttaaatacagtttaggctagcttgtgttcaaattgacatgaatttttaaattagtaatgttggtatctagtatatgacagaaatgaaaaataacgtattttgtatttatgcaagaaattatctgtaccgatcaaaactgacctccggacacaagaccagactggacttgcatatgttaatgggaaacaaaatggggaaggggctcctaattacttaagtttattaagaatcccaggatacctcttagaatggtagaggtgatgttagcccttatgtcctggacatgatccagtttaggtaattgctaattacaatctgtctacttaattcccacggcccttgcttctgaatgttattttcttcacttagcaatatttaactattatttgctcttggtgtgtgactgttggaacatctgctgattcctccttctacgttcggcatgatttgcttttcatttggttatttgataattattattttcatattatttttgttctaaatatgtctatagatagaaaacagaagccctgtaaaagttttagatattttttaactgcgtgggctggactatgctttgtcaatcgagcatacagactttctggatgtaagtttgggaacagtgggcataccactggcccatgaaacactcactataagatagtgtcaactcagaggtgaatcacagatagaccagggttttcagtgtcttcaaaactagggctgaaatcacagcacttaggggcttataagtagatccctctaaggatctatcctattctggagccattccaaaacaagagtacctctgttttgggtgctagagcatgctttatttcaatcacaattcaatggaactgaagaacagaattagaaagtgatgagtcaaaaattcttattcaccgcaaatacagggctagataaactccaggtattccacacagtttccatccctctgaaggaagcgagattactcttgtgtccgctcagctatgagcaccttgatttgggatatattgcttggagttcagatggagaagacatccaggttttatctataaactaccctccatatctctaaaagttacttagaggaaatcactgagttgaaacttcattcattccctagcattgtcagatgaactgaagcatctttttcaatagtcaatatatcctgagccttcttagtgaacacagtgcttagaactttcaatgaattcacctctctaagattatggactacatattccaaatgtgtagattttgacctaaattttacccattctacagaaaaccaacaaactccacctcagagagatgttctcactatatctacccaccagggtaccagtctaaaaggccccaatattttctcctgtgttttctgaataattgtgtttgagctagagccgggagactcctcctgtggcttttattaatggaccaaagtttggttcctgtgaggactgcaatgtgtgattcaaatgcccagtccatgattcagctagtgaggggagtaacccattttatcagttgtgctgtcttccactgctgttctctatattccatcagaggaaacaaatggcttctattgtgcataagaatgccatttagtcccaagcaccatttgaaatggaaatgaggagtaacagtaacagaagaacattggctaataattgtgctctgaatagccatttggccatgtgggcagggtaaaggtaattgtgtcctagagtaatacatcttctgagcattccctgagactataattgctatgttgatgggatgcatttttaaacatgtgattgcggctcttagacttaaaaaaaaatggctattttcagaatgatctgactttaagatgtcaggcaagattttgaagtcagaataacaacacacaaacacagatctaagatgtattattgtgtagctacttgtctaactgcatttttttttcttaagtctcaccctgtcttggtgatacacagattaatactaacctcctaccaaacaatccctgttgccactctactgaaaatacattcttgccttccacaagcagaaggctgagtgtctttgtggcttaggagagaacaaaaacacatctatgtattcattgccttgttcacttgcacaaacggagaaaactctttgaaaacatcttcctttctcctgagtgaaagaatgagcaggcgctgcctcccctgatttactgcacccatcctaatcagggtagatgattctgatcttgcattaaacaattactatgcaggctctgggcttaagttttgacttaagtttagaaattgagtagttcccacaatgccctccatttctaaatgtatgagaagaggatcaacaaagaaaaaaattaatgggcttttgaatgagcaacgtgtgtgtgtgtgtgtgtgtgtgtgtgtgagagagagagagagagagacagagagacagagagaggcatgatcttggctccctgcaacctccgtctcccgggttcaagtgattctcatgcctcagcctcctgagtagctgggattacaggtgcccgccaccacacctggctaatttttgtattttttgtagagaccgggttttgccatgttggccaggatggtcttgaactcttgagctcaagtgatccgcccacctcagcatcccaaagtgttgggcttacaggcgtgagccactgtgcctggccaacagaacatattttaatgtctgaaaaaaaagaagaatctactttaaacatcaccagaagggatacacccttcggtgtccccaggccttgctggcttgctgtgggtataaagcattaattcttgtcatttgctggttatagtcctccaccaaaactcttcagttcttggcctctaattcaagctttcttccaagtttctctccactctcactgtgtcatttctaggaggcctcagagttttccacgctagaacacagtcggtactctcatgtgtgttttcattttagcctctttgttgatgtctgctgcctgtcaatccacctgggtttgtaaagtccctgaagcaattcctgccatgagaatgttccttcatccagaatgctgccttctatgctccccaaactcaaagaccttcagggaccagtaaactcaactgcccaaagccaagcacagctgtccacagaattggggcagagattcttctccataggactctggcctggtgcataggtttggctgaggaaaagacatgcttttctccttccccttttcacttctatcccttttcaccaggactcttgaagaatattctcacaggcctcgtttcccctcaggtcagaaaatatgtgcggaacagaccctgagatgctgactgtgcaaggctgttcagacccagtcaggtcaggccctgaatccttgtgatatggaatgagatatgataaattggaaattgtctttaataaattgccattcgtgataattctagtgataattaatctgctgaggctgctataaaatatcatagactgagaggcttaaccaatgtatttccacatagttttggaggctggaagtccaggatcaagaacaaggtgctagccaattggctttctgtgagggatcacttcctggcttgcagtcagctgccttcttgctgtattctcatatcacctttcctaggcagatgcatgcagagagggcaagtgagctgagcaagctcactggagtcttttcttgtaagaacactaatcctattggatcagggccttcacttttgtgacctcatttatcctcaattccttagaggccccatctccaaattcagccatattaggggttagggcttcaacagatgatttttggggcaagtattcagtctatgacaatcctcatttaaactcatcagggaccattgataaaatgctattcattcttccctatgctggtgtggaaatttgccacccaatggatgcctgcaatatatgccagagactttaggtacgctgtggcatggcttagtgactatgagaagactgacatattagcttggactagcttttgttaagcaaatggactattttacaatccaagaaaatgaacaaaattccgttttacttactcaagataaaaatgcattgatactgcaagacatatcctcactgaaagatagggtcacttaaaatatcccatttaaatgcaaaggacactagaaagtatagcaagacaaggtaaagaaaataacaaccttgctaacatatgactaaaataggaactggcagctgggggtgatgagagaaatgaaggcagtcagctacacactgactgccggggagcatcctgcacctcagataagggagcttccgcaatgaatgcctgggcctttggctttgtttcaagtcttttgatctagcggagtccataggatcatttttcccgtgggccagacctctggagaagcaattggcattgttagtttgcactgttagttctgaagctagtttggtaacaaaaagttattgtagtaagtgcacttgtgtgtgtatgtgaggggtgtggatagatgatcatgttcaagtctgtagtagaaaatttctaattattgagtctagagaactaagaatacttataggaggtaattaatccttacccgacatgtggaaaatgtcttataacccttctgtttaatttaacaaaaatatagtctactgttcagatggttaccactcggagcaactcaaactatttccctacagattttcctgtagagaatgaatgagaaatttttttgtttgtttaaggcctgaaattttactaccaaagtcaaattttgagtattgattgttgagtcctgaggatggttatattatcatgacaaatcttgcttattgtttttaattagacaaaattttcaaataactgtgagttattacatatctcttttattatagtgttctatagattgtattttgtttcattacccacactacacacacaaaccacatatacacatgcacaacacacacacattctttctatacttcatgtgaatgctttgagacaatcctatttaacattgacaatgaacaggacagctggtctctcaataaaatctaagataccacagtagtatctgcaaataatatataaattagaaatatttggaatgtttagtttatttgctaaagctcttcagaactataaattacaatattaatgaacttatttttaattcccatcactttcatttttatagaatccagaaataatgcatgtaacttgccattcctccccattagtacacttgagtccaaaggagaggttcacagcatcgtgctcttttgtgatgtggtttagaagaaaaccagctcaggacaagtggactctgaaaatagcagactttcctttactcatcttttgagttttcagagaagagtagagattcagttcattggatattttctttgtactaggctccatgctagaaattggagaaaataataaatgagaacctatctttaattaccattctagaaagaagacatgtacattaaggataatatgtaatggatgtcataatataaatatgtacaaagacaaggtgtagcatagaaggcagatgaattgttatgttgattggagtgtggtttctgttaagggatgacattaatgaggtatcgcctttgcaacttcaagaatgaatagaagttaatcagacaagaaaagaaccatttcacaaggaacaatatgtacacataattcaagacagccagaatgtgaagtaagaggagactcaagttttgtcagcatattatataagtaagggtgagttttggctttgagagttgctttgttgtgtttttccagatagatgtttttcagatatcttctcccctgtgagaaatttctgcaggtttgattgatcctttcagatgctttttaaatatatattagtttcatcactttaccacattgagagtccatgtatctttgactcaaatgcctaggaacagaagatgtgaggaaagggagagagagagattctgtcatttaacaattattattcaagtacctaaaccaaatcgaaatgcctaaaggaatgcagtgggtgatgtaaaagaaggtgtagggcaggtgtaacaacacagaatggtagagaggtgggaggtggggggacgggagagtacgcagctcttctaaggtgggcagctgccttatagcttcagccagttgtcacacagcactggttttgtcagttttcagttctttgaaaaaattggaaatgtgaaattttatatggaactgtcaatttgtggaagttagaaaccactcgcaggccagcactgggaaggccatatccagcctgacttgctctgttttatacaccatgcactctcagtggttgcctcaagggctttagaaagaaggtcaaccctttgccttgtggcttttgtgcattgctttcttaagaggaacataaggaaactctactgttctcagctgctgttgtggttacttggccatttgtaagacttatatataataatgaagttgtcttggagggctgccatgtccgtgatgtagttgcttatctaattttgtaatcttttatcaattccctctacagcttgaaggccaggctgagggtatggtacagaatactaagtggtttcaaatcaagtccaatctctgttgcaatttttattgtgataacaagatatattattaataacaataaaagacaataataatgtattattatattgtaagcttaccatgaagtgtatgggcaacccaaaaagatattcagccatcattaaaatcttttctaatcacagccacacatttcatattatattaaggaaaaacataaaagcaatcttgatgttaagtagaattagtaaagacctaaaggagtataaccgaataaacacaaagtagaataagtaggccagaatatgattgtattctatcaacaatgttatatttgcttagaaatctcttatatttcttcctccaaatatgcgtgcatgcacccacacacacacacacacacatacatatatacatatatgtatatctgcaattgtctaaaggtagatggtatagcataaaggttaagagtgtaaatttggggttcatactactagagtttcacaactgcctatgtagccttccaaaaatatttagcatcctgagctgcagttttctcatctataaacaaggattaataatagtatttatctttgtactattagatatgattgaataagatatttcatgtaaatcatctagcgtactgccagatatattttatagtcattattaatgcaaatcattattgtatcattattattactggagttttaactctctggctgttggcaggaggcctcagttcttctacccatgggcctctccacagagctgcttgagtatcctcagacgtggtggctggctttacccagggtgagtggactggggggtttggggaacaaactaggtagaagaacacctctaccatgtctattctttagaagcgagtcacgatgtttggcccacaataaagaagaatggaaatatttgctaaagattttgcagatgtattttaaagccacaacaaggcaaagggttattattcttaatttgcagaagtaattgagactcaatgagattagataacatacccaagaaaacacagtaaattgcataacttatttactggagctcctccccaaacccctaaactatgtgacattcttgctttaaaaaaaaatggattatacagcacgtgtcaccactgcattctcttttttatgttgttcatgtgtgtctgtgaaatgtgccttctaataaaaatttgaggatcttatacttttccagaatcattttgttgaagtcatgttttggagtacatttgtatgcaatccgtctgataagggaagtatatttctcactggaattagtataggcggaaaacaccatcaatcatagtcatcacaaagcaattaagtacctaattgttcatggctctgagtttgctactgaaacagaaaacttcttaggcttgctaagaaaacttcttaggcttctaagccctcctggggcttggaatccaagaattcagtagaagacggaagcgtggtaaggagaacaagaactgaagacataaacaaatttatttgaaatatggttgcagtggagcagggagagtgaattcaggggaaagaaaaataaaatgaaataagatgctgaggttcaagaaaggataaaaggtaaagtggctgaatttaaatgacctgggtttcagtttttaacaaaacataaaaataactgaagaaaggctctatattttatttaacaataacaacaacaaaaatcaaagtgcttgtttatcattgggactcaacttttgcagagtttttgccttaatttttttctctctaaagcagaatttcccatcactttagattcctttccgtgtcaatgatggcttttaatcccaatttccatcattacccctcagtgaaatgattgcttccatgtttgagtatatatacatatgtctgagacttaggtcaattattttcatgcagaaatcggggagggtgctcctgtttttcatatgcatttgtaaatattttcaatcaatcatgcatttataatccaattgggaagatatgattcagacacaatagcccgtctgctgcaagagtctgttataaaattgatcagttggccaagttatgctatttttttaagttactttgctttctttcagggaagaagaaagacaaaaaagtccagaaaccagcagcagcaggtgctgccaaaatggtattcttcttatctgtgctgatttcaaggggtgtgcaaaagaatgtgtagttgcttttctctctggctgttgggatggcgtctgtctctctggcattatccacttatttgatctagctaagtataggagcagaaataaattaaaaatgctttttcccagaagccccaaggatgttattcacacattctcccttctactgatctctgccagtggtgtgtaaatatatatttagggggaagtggctgaagtcaaaagctctgttggatattctttccctttcagttacttaccttcttatgcacaaatagaaagagagaaatcagaatagcagagaaattaacagacatgacagcacaacaccttctttcccatgtgctgatttgaagaggctcatgtatttatgtcacaaatgtcaaaattcaagtttctaagcaaaagaaaaaaggaaaaactgctaaatgttaagtgatttgcttatttgaagagttgtattacaaagcaatggaatgggagagctctcccagcccaggaaagacaaatgggaagacgggtctattttcattttggcattggacagaaggcagccttctggcctgctgtcacttcctatctgttcagtcttcgttttgcttccccgctgaccatggatcggattctgactcatatcagagactccctcttctgatcctatttatttatctgaggattttttcttttctttttccatagactcctagaatccagaggaaactcagtggcatctctcatattatcctaagctttctcagaaatgtgacatcaatattttaaaattttcagtagttatcaatatttcttaaatctagcagtaaggatggtctttgaaatatcttttctaaattccttctgttataataaaagtcagtgctcttttatatggtttggctgtatccccacccaaatcttgccttgaattgtaatgactcccacgtcaagatggggccaggtggaggtaataggatcatgggggcagtttcccccatactgttctcatggtagtgaataagtctcatgagatctgatggttttataaatgggggttcccctgcacgagctatcttgcctgctgccatgactttgctcctcattcaccttccatcatgatagtgaggcctcccaagccttgtggaactgtgagtccattaaacctgtttttctttatcaattacccggtctcagatatgtctttattagcaccatgagaacagacaaatacactgtttatcatattcttgacagcaataaaacaattgcttactgtcagctcttaacaatctttagtataattaagatagtctatttggattctttttcagagccttctatttttcagtcttttgaatgtactcttattgctaaatttggaatatttttagttttgctgcatcattttttgaatttacctttctcccctcttttgcctattcattattcaaaaccagatcaaacactctttctgtgaagtcagtaacttactccttcagaaatgtaggtacattgaaattggtaaacattatcacactttgtacatacttttacagtgactatgtatatgtgtgtgtttgcaaaactttctgcctcattggacaataaactcctcaagtgcagagatcttgtgttatttatctatgtgtcttcagatactaaatgtggcacatagtagagctccatacatgtgtattgagtaataaattaatgaataaatatgatgctggtggcaggtaaattcttggtgtttactttgaggtccggatcaatacaggatcaggatagtgcttctcttacatctgtttgcacagcagaactgtactgcactgaccagatgtctcaaagtaatgtccatcttgcctggaagtgtctttccttacttggggtcttttaccttcagaaatccaggtgcattcacaatctgcactgttattataccaactctaggtgaaggatgcatgatccaaaggtccagagtttgaaagcttgcagtctgcaaaactgccctcacttctgatttgaattgcaagttcaggggtttctccaaatcactttcagatttgataatttgctcataggacttacaggactaactgaaagctgttggactcatcattgtgatttattgtaaggacaggatacagattaaactcatccaaggaaagggacacatggggcaaagtgagagagctccagatgtgtagcttccagttgccctctcccatggggtcaaataactcctccaggcaacagtgtgcgacaataggcacgatgttgctgacaacagagctctcctaagctttggtgtctgcggtttttggaggttgggtgggtgcttcagcacatacacatgattgcccatatatatatagctaatctcggtctccagcccctcaggagatagacctgagaccatgcgccccaagtcccacaacctaagccgcatcgttggtgtgactcacaacccccaccataagtcacattgtcagatattctggcatggcagcacccacactaaacaaagatgtggctcctactaggcatgctcctcctagggctaaaagatttcttcctagaagccaagagcaacagccagaccattccctgggcaagattaaattccttactgaaccacattttagttcttccacacaggtctcaccaaacctataatttccaagtgagagaacaggaagcctcatcttgctttcacagcttgagacaaggcaaaaggaaacgctgttttgaactttgtagtcagggtgggtgtgtttacaagggatacaatcccctcaagtcaatttaaatcaagaatctatatgtacagtggcatacccagggtatgtggctgtaagtaaatcgtgttttaactctctccctctactttcttcctctcaatgacaaaattattttcagtaataattatttaataatatagtaattctcaccatattttaaaattgctcttcagttttaaaacaatttacaagttagaagcatacatttcaattttacagctattattcaaattcagtagaaatatttcacatatgacctgaaatttgaacttaccaagcaaaagtattatataacacagacttctttttttctactttactgagtgagtggacacagatgaaaaattctaagttagaaattctaagtggtcctaaggaatgaccaaattgaataactcaagttttctttcttttgtcattacaatcagtgtgctatcactttttattttaaatgttggtttaagcaaatgtgtacgtatgtgtgagatatatatatatttcatatatatatatatatataatatatatataatttcagcattaaggagacattgtgcccacataaagtgataatgagactggaacattacaaacttactccttcaacgaatgcatgtagccaatctatgtgtgatgggactgataatataaccaggagctctccaaattatcattcatgtagaatacaatggtttttaaataatcggtaatagaagttattaatttgaggcttacatatgaatctgaaatgcaacaatgtctgtagaaattgtttagaattttgacaagatttgtttgtggatggagtttctttttaaaagattgatatataatattttacatatcagtggggtccatgtgatattttgttgcatgcataacgtgtaatgatgggtatttgggatatccatcaccttgagtatttatcacttctatgtgtaggtaacatttcaagttctctcttctagctactttgaaatatactttgttgctaactatagtcaccctactctgctatcaaacattagaacttaaaccttcttctaactgtatgtttgtaaccatttgccacatctctttatcccctcatcccacccacacacccattccagcctctggtatctatcattctactctctaccttcttcatgagataaacatttttagctctcatatgtgagtgagaacgtgtgaaatgtgtcatctgggtcttgcctatttcatttaacgtaatgacttctagtttcatccatgttgctgcaaacacatgattttatccttttttatggccaaatagtattcatatatatatcacatattttccttatccttgcatctattgatggacatttaggttggttctataactttgctgctgttgtgactagtgctgcagtaaacatgggagtccaaatgtccctttgatatattgatttcttttcctttggataaaaattcaatagtgggattgctggtggatggagtattttatcactgacattgtttagaattgtgaagggaaagcagaattaaattttctgtctctttaaactcagtcatcttttctctatagcacaaaagattatgttttttttttttttttcataactcagcatctttgtgagctatgaaacttgccctgatagccttttcttgcctagggtaggatatattctgaggaagggctgggactgcccatgcattcctgcagagcattcacgggtgctatttacagtcctaattaaatggaggattattagaaacgggaaggcagctataaatagcatggtccattttatctgtttctttggtgtgtaggaagagcattgctaagattctcccttgaagttcagttaactcagaatgtgttctgcttttgttattctgctttggcttaaaaaaaagtctcctgatgctgttcaaagtggggaaaagaaaacaaaaacaaacaggagtcactctcagtcattttagcatatggacagaaggaacacagaatgaaatagagttggggaggggtgtgcacggtataagaaaaaaaaatgtgggcctaatcctttccgataacttttttttctgaaaacaactattaataaatcttatttccaagtctgtagaatattggttctcttcatccaactgtaatgtgatcagtctgttcagggagcagaggagtgggtatgggagccttccctctccgtggtcctgttagggcaccttttccagggagtggggactctgctggcttctctttcagcacactggacggtgcagaaatcagctcaactctagaggcagtgctgggattggaatggaacttgacctggatcaaatcaccgagcctttgcaaattcctgattttccaagttaggacatatctttagacccagagcccttaatcttggctcttgggataagcttccttactgcttctctcaacactcatctccacctccagcctctgctctacaagctgccactcatctaccttacatctctgatccatccccagtattcaacagccttcagcatttcttggttacctgttttaaatttcccaagttcttaacctgtgtttataacaactcatgaacttccaaccaacacatcaactccagctccctccagtactccttctttcaaaagggttctagtcaaaggggtttgcaggcattgcttaagctcatggggtgttttcgtcaatgccccattggatttgttcatgtctttgtttctttgatatatcatccttcttctcctacttatcttaattgatctcaaagctcaagtcaaattatatttctcccagttggtaattattttccccttactttaaattctgaaaacgctaatgactgagcttttcatttagtactaactggatggttagttttctttgtgtatgtgatcgtttacgtggtcgttttgtttctcaccaacacattgtaaactcttttagaattgttatctaatagaaatataagtaacataaacctgtattatatttttggagcatctgaaagatttctctcaaatggtctcatctgatccccaaagcacccctctcaggaagtaatttttttatttttatttttggggaacagggttttactctgttactcaggctacaatgtggtggcacaatcacagctcaatcagccttggcctcccaggctcgtgattcacctgcctcagccttcccagtagctaggactataggcacctgccaccacgatgcccagctgtttttgtttgtttgtttgtttgttttttaagtagagacaaagtcttgctatgttgcacagactggtctcaaattcctgagttcaagcagtcctcccttgtcttggcctcccaaagtgctgggattacaggcatgagcaaccatgcccagctgaggaggtataatattatccatagtttcacatgtaaggtaataggagctcacaagggttaaataatttgcatcaaatcactcagctggtaacttttagatccagatttaaaaattctcaacttctgactatatcctatgttttttgtttggttttgtttatagcttgcagttgcttttataattattatttttttgagacggagtcttgctctgtcactaggctggaatgcagtggtgtgatctcagctcactgcaatctctgcctcctgggttgaagtgattctcctacctcagcctcccgagtagctgggactacaggcatgtgccaccacgcccagcaattttttttttttctagtagagatggggtttcaccatgttggccaggatggtcttgatctcttgatctcgtgatctgcccgcctcagcctcccaaagtgctgggattacatgcatgagtccccactggatttgatctttacaaattaatattagcacttgttaactaaaggaatgaagaaataagtgaaagaatgaaggaataaatacataacaacattatgtataacacagatgagtgtaatgattcagcaaaacttcattataatctcttcagggcacctcctggaaacctgagaaataaaactgttttattactggtacttgcctttctcgaaaactgatagtaaacgtcctgacaagttagtcttaggtatctttccttcagttcaatagcaaatgctgtttaaaagcaaatacacagcatttatagaatgtttttgcctcttcattatattttactacataaaaatctaaaacacacaaaaaagtaaaacacaaaaacagtctaaagtgtgacactgatttcagtacaatacatctagagggaataatttttctctaaattcccaggtggctaaaaagagggctctgtggatagatgtggaaagcgtgagacagatgcttctctgagcctcgggtttctcatcttaaaatagagataattacagtacctacctcacaaggttgtggggatttgttgggaggatctaagtaaagcccttaagacactgcctgggtataaagcagctatgtagcttctagtgtcttaacattgctaagaaaagaaacacacttgccccctttttgcagaagtaagctcctttagtgattttcatctcattttcttctatactttttttttatatttgttgtgagcacgatcttctcttttttaataaattcatatttttcaattatttttattattaaggtaagaagtgtgcttttgttggtggaggaagaaggaagcccctacatgcatagcaacgtccatgggaatgaatcactgttcccttcttttctatgaacttaagattatactcaagccactccagaaaatgaccatgcagtcactgtaagcaattcctctaaaattattaaaaactgtttatgtttggagaaaggcagcccctcttgcagtgataatgactgctatatgagaggattaagctgattacatctttggaatactgagattgtgcaaaatagagggaacgatgaactctccacataagctaaggaattcagcaaaaggatgaatcaacaggagagagagaatatgaagcctctatttggaaactgaacacgtagcctcccagataaaagtgagaaagattttgagtaatatctgaagtcatgtagctgagaagttccatctacacttgagaataaaaacaaacaaacatactctaggcgatgtctatgccagttccatgaagtcatcatagacttgcaatcaattgcttgggaaaatagattttaaagttgaatttctggctattactaggataattttttctcctggacattttatgtatttatgtatctactttggtcagggtgacaaatggtatgtggtatgcagagcttaactactactcctagcccccaggccccataatcttttagtggattcagccaagcagaaatgtatgttgaataaaaccatgtccagggggtgagcagaaagaaatgcatttgaggaaaggatattatgtcaatcccaaactcgatgaaatgttctaagagtatcccagagattggttctatgaatctagtgaaacacagaataccctactcttcacagatgggtgtttatttgcatgagtccataggcatgtgagcttttgttccttagctggaggattagagggaagaaatgacataggtgattagggatgggggagagctgggatgaatatggagaaaggttagagaatgcaggcggaagttgatggcagcaatttgacttagaaccttatgggacttgggacacacgcactgtaaccttgagacctagataacagtgttttatacagattcggagaatagattatttctcccacaacccagctactgctatgggtacagctttagtgctctgcgggctcagctgaccacctgaaggtgactggctggcttggagtgacaatagaagagcctatagcacttgtaagagcagggtcctcactgagattgtgcacagcagagggagccatgaactccctgcatgagctaaggaattcagcaaaagcatgaatcagcaggagagagagaatatgaagcctctattcgattaatgaacatgtggcctcccaaacaaaagtgggaaagattttgagtcatagctgaagtcatcatgtagctgggatattctataaacatttgagaataaaaacaagcacagcaaccaatgtcctttctgttctaattaggactaacttttgagtgctagagactagagggcaggcatagccctctatggagatgggccgttcaagttttaataaatgtgttgcatttgtcatcttagtatggcatgacaaatgatctattttatattaggagctgcccaaagatgttgggttaattttagtcaaagtgattttatgcccacaacatctggatgagtttggtcaaaggaaagaagtttagtagactcataaccagaaagatctttgtcttcacctggcctgccagacttctgagggagtaatcatgcccaatatagtaactggaaggacatgccacttgtttggaaggatagaggcatagcctgagaagataaaggtgaaatctctgaaaactttgataaagaggctgggcacggtggctcatacctgtaaacccagcactttgggaggccagggcaggcagatcactaggtcaagagattgagaccatcctggccaacatggtgaaaccccatctctactaaaaatacaaaaattagctgggtgtggtggtgtgtgcctgtagtcccagctactcaggacgctgaggcaggagaatcgcctgaacccgggaggcggaggttgcagtgagcggagattgtgccactgcactccagcctggcgacagagcgagactccatcttaaaaaaaaaacaaaaaaaaaaaaaaccaactttgataaataaaatataactctaactctagatagggaccgaatgggggtataatgtttgtttaagtttttgggagacacttgataacacaacctggatatggtggagagcattcacattccttttcagtagtagcctcttaacgatgaggtatggatgaacagcaaattgctgctgacttattaattaccatgcccacaccactgatttccctatgtcttacctgtgcacacacattggctttacagcatacgaacgccaagtttgtggcgtagcatatggtgctccctcaaataagcacaactgtctgcctctctgcttatctaatcatagcaacagaaaaattgacttttcagttttcttttccccaggccctgggagatgcatatgccaaatacttggcattctttgtaacagagtcaatcataattaggattccaaattaaagtacactgccagccagggcatgtggtattttatattatttgtttgaacaaatgtattataacttgaaaatggcaaagtaaaagaattaagtaaagctcacactttttatatgtaatcatcttgcggagttttattttatcagaatgttagatgaaatcagaaagcaaagaatgtaaaatagaaaaatgtatctgaaactttattcttttaagtaacaggtttggttttttgtttttgttttctttattttcattttgtttggtttttgaaatgctcattgtagaatgttgaatatggtcagatgttgggtgtgaagtttattagaaattaaccctgaaaaagtatggtatagtcattcagttgccttttccagtggagtctgatttggcctggcgggtgtagtgaaacattaactacacccgcctcagccacccaaagtgctgggatcacaggcgtgagccaccgcgccaggccctaaagcacatcttgattgtaggttgagggtgcagtgccaacaaattctactttcatggctcttgaaattctgtgaacatttaagagccactttgacacagccatttcttgttttttgagagagggtattattgaaattctttttaatccaagatttttgtgacaatttcattcattcctactttctttacaccagtagtagctattcatattcattcttctattttctttgcatgattaactggcatatactagttcttcacattattagcctaataatagtagttacaggctataataggctattaattcattatcatctcctgactcaagtgaatctgctggtaactgagagctcctactcttgtcaatggctttgatcccactgatgaccattttagtgctattcccttctcaccatggttgagccttttctacatattcctctcagaatggttgtgccagactttcacggggagccatttttaaagctatcctcactacagaatatggcagcatttcgttggcagtaaaatcagttaaactgcatatagaatgctttagtttcttctgaataaaatgtgttacacaaactgaagtcactgctctttttaaaaaccaaagcagaataaaccgttttgtaagataattttgccactataaatatagtttcctttggcttcttcttggaaagattttatttcagcttgcactgtgagatctttgtcgttttcaccacacatttccgtcaaggaagcccttggatgactgccatgatttgcctctgctggacgcttccttcaagggctgtcaacacctctcttaattgtctggcttaaacatcaggcgagcaatgtgttaaagttagatggcaaatatacttaagacaaatatgtaaatttttactctttcaaatatgcattcaactggtgtgtatagatttcagaacaaaagccagagagagagcaagaaagagggaggagagagaaatctatatgtataaatagaaaagccaaggtagaaatgctgtgtgtgtaaatacccaatttctggattaagacgtatcacaaatacatatgatcaatacttatgtacatgcaagtgtactgcctttccaaacaccagcaaatcttggtgagcagaaatcagtagactgtccatagtgggatctagaatttgaatggaaacggtcttcaattttaaatattcatctgttttcatttgtagatatgacactcactttaagaggtgatctgagttcaaattccctaaattatatttgcatttgacttattacacatattgttagttgtcccttgaattccagtttctctttgagtaagttcttagaagatatatgtagctaggtgacttatagtcacctcttagtcattctcaaatatgattataggctatttcagattcatttcaggaaaatgtcatgtgtcaaggtgtcaattctgagcaatttttacattttgccaattctattatagaagtggctctcacccataagtagcttgaaggagtcagtatgtaatgtgccagtctcattttcactttatgtgggcacaatgtctctctaatgctgaactgttatataacctgtggtctatctgactaccatagcttcgtagatcaaaatattgttatggtcatataaatgactataatgtgggtgttttagaattgcacttttgtttatgcataactggtcccaactcaaatctgcttcatcattttttagtcaaaggatagtttttcatgtcagtagtacctcaaactccgcttgtgaacttaacacccagctatatcctgttagtttttaatcaggagggaaaaaaaggctgctatttgaactaaactgacagcttttgttgatgagctgttaggcagattaaattctgtcttgctcttcaattgttcttgaggctctgtgggacttacagtaatagaattttatttgtgtcagtaaagttgacagccctgattcagaagaccacagggagctgagatgttgattaaggagcatcatattgaccatggcttaagtgggtaacaaatgaactgagagagaagactctggatctacttttgcctgtccatgaactcgtccaaagcaaatatgctttgagttttcatgtctgttttttaatttttgtggatacacagtaggtgtaaatatttgtggggtacatgagatgttttggtataggcaagcaatgcatactaatcacatcatggaagatagatagggtatccatcccctcaagcatttattctttgtgctaacaaacaatccaattatacccttttagttatttaaaaattctattgaggctggacacagtgacttatgcttgtaatctcagcactttgggagggcaaggcaggaggatcccttgagcccaggaattcgagactagcctgggcaacatggcgaaacccaatctctacaaaaaatataaaaattagccaggcatgctgacatgtgcctgcagtcctagctattcgggaggctgacgtaggaggattgcttgagcctgggaggttgaggctacagtgagctgtgatcatgcccctgcaccccagcctgggtgacagagcaaaactctgtctcgaaacaagcaaacaaaaaattgttaaatcattattgactagagccacccattgtgctatcagatactagcccttattcatttactctatttttttttgtactgagattttaatttctgtacttagtaatagctttcaaaattgtcatgttatcccaggaaattgttatttttatccaaggcttattccatttttttttccagttgtttggggcccacaatattgtttcttttagaaataaagttagaaatattcagaataatgaacacttaagagagaataaggagtagaatacctaaaaaaaaaaaaaaaaaaaggaatcaaataaggaagagatagatagtaaaagagaagtggatgtaagcaatttagaatatattttatcaaaaattgctttttaagtggcattttctcttgctgcagaagacattattgaacaaaaaaaaagcccaatgcaattcaatttaaatttatcactctattattttaatatatttactcagggttaacaactcattaaacaccaaattgctcactcttaatgagtctctgacgctaaaattgagctgacttaaattttactgtaaaatatcagcaccattgcataaaactgtaataaaaattaactaaaagctattgaatgactgtggagtggaaaacagatttgtgacacaaaacagaaaatgtagcacacgatatgtggctggcagaaacatgagtaatagcttttattcaccaaaacatgataagcccatttttcttttgctgtattggagtctgtgaaacatgaagtcatgttttctttttttcccccattactttgtacaacgagggccagtggtggaatgatacagtttggctgtgtccccactgaaatctcatcttgaattgtaactcccacaattcccacatgtcgtgggaggaacccagtgggaggtaattgaattatgtgggcaggtctttcccatgctgttctcataatattgaataagtctcagaaagtctgatggttttaaaaatgtgagtttccctgcacaagctctctctctttgcctgctgccatccatgtaaaatgtgctgctccaccttgccttccaccatgattgtgaggcctccccagcgatgtggaactgtaagtccattaaacctttctttcttttgttaaaaaaaaaaaaaaaaaaaaaagattatgatagtgctagtcaatactgagttgactgtcaaaaataagcacactttacattagccagttacttctgggacactgttgaagagtatgtcacatgtacccacaaattagtcaaacatctttaggcatcacatgatatctaaattagtctttttctccttctccatcccctggttgtccatgaaatattggcctcaaatcagcttgcctatggccaccatggaaaccatccatcatgaacagcacctatgcccctggtacaggagtgcatttctccccaagcctacagtcttctgtgtgtcacagcaatgctgagtttcccacagaggtggcgttgatggactctttctcaactctttgctatggagtatcacctgggctaagaagttctgcttttgcatcaaatttcaatttttttctttttattggatttgaattgttctggcacttttgccactatgctgtctctcaagccctaccatcccctccatctttctaaggtctctcagaaccttagctccaacaaaacccccttctttttctctcattataacacaaatttcctgtgaatatcaatgaagcaaacagatacagtgggagctcgtgaaagacaaaggacaccgagctagtattttcattaacaacatgggctcttgtactgtcaaccaacaagagctttgttataaatttattcacaatggcaatggctttgggcaacatttagatggaaagtatttatgaaaaatatactatttatgtttctggataggaaacatactattcatgtaacaaaatatgacatttaaaggaactcactttttcttttttgttgacagtcaccgtgtcatcaaggaaatcaacatttagaaattatgattgtcactagctcactctgagccatggctctacattttatccttgtcaataagcaatccagtgttaggattttaaaaattgtttaaaatatccgtacaaagagttattttctatcttggtccacaaatttgtcaatattttccacagcatcacaattgtcagaaaacacagtgaagcttaagttaaaacaaatctgcaaagaaaaagtcaaaaagaaaactcttccacagattttcagagagatgatttattagtccaaatttgagcattgaaactagcctatattctaagtttaagaaaactgtaattttcatgtttctttcagttcaatacaatttatatattgaatacaaaagagattttcacttattgatatggctttctaggtgtttaaattctaactcaatattttaaggattcagtaatagtagggtttccatttctacatggtaggcattctctagtttacttttcctcttctttctgtagaaattaactatttttgcttcacagtcatttcatgatagacccgatttcttacactgaaattcattttaatgtttggattgagcaatggtttgctttggtcttaacttttatttattgaggtataacttacatacaatgaaaatctcaaatcttacatctactgttcaatgagttttgacaaatgcataccattgtggactccatccacatccctataacaaagcagggaactttttcaccttttcagtaccctgtaaaagttacctcatgcccaattctccccttcctctaagcaaccactgatctgatttctatcaccatagtttactttttcatgttctagaattttataaaaatgaaatgatatattgtatccttttcttgtctggcttctttcactcagcatactgtttctgagactcagcggattgctttttaataatataattacaactgagtctcaaagatttgaaaaagtcagaatttcttataaaattggacattgtggtttgctacctgctgaatgatgaagacgaataatgtacttcagtgccctgagatagtttttgtctactgtaataaaatatttccagtcttctctgtttttgcattcttcaattattaccttgaagttttaatgttttttaaaataatgaattggcctaattgtagcctcagcacaactactaagttacacattcaataaaaagactttttctttgtaatgttatatgttaatggtcagcctcctagatactgatgaagcccatcaatttctactgatagttaagatcaattaaccaattagttacccattttcatttttcctgtatattctttgtagatcacttactaaaatgattttctaagaccttcactttcttaagtaaagaaaaacaatttgactgagacttggccatttagctaaaatctaaaagacctatttaatttaaagtataagtcaagcagagatcttatcttctgtccataaataataagaatgattgtttttcgctaagtggaaaaagtgagatgaggcaagaagttgaagaatgcctagccaggtagcatatgaagcctacaagtttccagctgtgggtctgatgaaaaataatgagacatctgatggaacttaggatcttatttgaaaaataagccatcaagtactttaactttctggtatttcaaaagtaaaaacatatactaatcacttgtttttatttcacttatttgacactacacatctgtcttagtacaaactcatgtttatgcaatgagatttattagactgatagttcatatcttagccccttttcatagagaatcattgaaaaaaaaactgttcactgtgagaaaactctctcccctcactactgatcgcttatagtaccaattcagtatatgagaagacactatttttacaattattcacatccttaagaaaataaaactctataatttaaacaatgggagtataaaggtattttagaacgtatttgtatatgttaaaacaacagcatattaaaaatttaccttgagaaggccgggtgtggtggctcacacctgtaatcccagcactttgggaggccgaggcgtgcggatcaccaggtcaggagatcgagaccatcctggctaacacggtgaagccctgtctctactaaaaatacaaaaaaattagccgggcgtggtggcgggcgcctgtagtcccaggtactcgggaggctgaggcgggagaatggcgtgaacccgggaggcagagcttgcagtgagccaagatggcgccactgcactccagcctgcactacggagcgagactccgtctcaaaaaaaaaaaaaaaaaaaaaattaccttgagaaaaacaagcaaacacatgaacctaaaaaggcaacagcagatatagtgttgattgatccactgccactccagaattatttatggtagcaaaaataataattttcaatttgatggattcttatttaagcagactcattatactttttggaaaataaaatattaacattcaatataatatgactacctcagtcactttagctccacaggtgattgggatagcgctgctggcctgaataataaaatggtaataacctcagttagaacaaataattgttttactagttcagatacacttaacattataatagatgccctcataaggtgctatgtataaatcctttttttgaaaaaaagcttgaatcatcatgtaaatgttttagggcaactcattgcttagagaaatcctttgaagttttcttttataatgcaaaaactcctactgccttatctgttttgtaaattaggttgtattcgtaccagttttgttgaaaagtgaaacatccttctaagcatgaaagttttagaaataatgtctaagtatatctaaagtagctattataggacataaatgcattgatattttagtggatctcagtctagaggtgagaagagggctaatcataataattgggactgagtgtgttagaattacacatctttcccctgctctgataaaaaatatcctgccatagagagtcactgatactaatcagagcatgtcatatctttcagatatttggggacagagaaaaaaaggtgatgaattacagtactagagatactatagcctttaaaataaatattatatacttttggttctacatacttttaaatgaagatggtccatgaagtaagttatgatcaaaactaatgcaagggcttacagcctaagaagaaagtccagaatttagagaatggtgacctgtcttttcttggcaactaatattatgaacatcaatttctcatcactttgtggcttcaagaaattctcccatcatagagatgaatcacctttcttccaggtcttcaaaaaaaaatatatatatataaaggtctgtgggagataagcttagaaacagtggctgaaaaggagaaaaattcagatttcagtcctcgggggtttgcataacaaatgatgaagtatagttttatagctcatctaagtaccttggtgcttcttttgggtacaagtccctgtttattagacaggcatggtgacttctagatacattcttccaagacatcaagataattttacttcttagttttttcacatgttaggcaattccaagattaatcgtgtataaacttgtttgacacttgaatcaatttttggttttacataaacggcattatttcatgcatacctcagctgaaaattggcagttatgtattagtgcttgattttctagaccagtattaaaattaccttccaaaaatgtttcagttgcagaaagtattggtggccaacaggtcttccatgagtcgggacacattagccagtgtcaccctttctctagccagtcagttctatgagaatggtattggaagaacagacaacctacctgcagcacttgccctgtcctgttcatattgtggacaatcatcaaaagataaaagggcatatgaaagatttatggtaaatgtcttccattttctctgccttgagtacactggagttagctttcattttcatagttgcttactatgaatgtcttagatgtagcatgagaaaatcttatattttctttttgtctagaactctgctgttcaatatagtagtcactagctattacataattaaaatatggctagtatgaataagcagataattttaattcttatttcagtataatttccatttaaatttaaaaactcaagcagtgtaaaatagttttcatcaaacacaatttttgttctaataaaactatatttcacctaaagcactgaaaatttagcattgagtttcagtgtgctgttaagtataaaaatatactagattgtaaaaacttcatatcacgatataaattatctccaacaatttttatatacattagatgttgaaataatattttgattatattgggctacacaaaatacattattacaattaatttaacatttctttgtacagtttttaaatgtgaatccttggaaattcgtaattgcatatgtggttcacattatgtttctcttggacagtgctgagctagtacattctgaaatatgtagcaattatttctctatggcttcataaagaaaatgtcaatccaaggctgaggatttatttatgaaaatctaaagacagccggttttcctgatggttcatgccgtgggggaacgggtctctttcccaatatataagaggacaaatcttgggatgggttttttttttttttggtcttttatgacattctttaatgatttctcctgtgcttgccattctgccttgtacgtaatacaccctttctagcaatgggtttaaaggtttttccttcctctcctttttgagctgtaaaatatgcattatggggagaggtgagctgatagttgagaaaggtcattaagggttcagcctggcttagtcggaaagatgtgaattcaaattgttattctcccagatatatactaacatgaccttggggaaattgcttaacttttctaaattttagtttgcttcatctgaaaaaggtacctaatagggaagttttagatattaaaatcaatgaaatttaaaagaatcaagaaatatgataatgcctagtatataacaggccctcaaatgtgttctgaaccaagagatccctgtaagagttaaagaaacaggaaagaaacacgaaaagcggctcaacagtcaaagacaggttaattttgcagaataaacctgagaggggcttctggccaatttttggacaggagcactctctcttacagactaagagtatttattggttttagggcgagagagctttatcacaggcttggaatgtttctgtgtgggggagaaatttatggtggggttggaatgtctctgtttggaagggaagttatcctggggctgacctgtctctggtcggggaggggtttatcttatggttggaatgtttctggactgggatgttatttgtggtttatggtcatgctgacgttagccattaagctgatgccctttggatttaggcagtttttgatcaaggggaactttagaatggtggtgcttgtccaagatagccatgctcccgctgtgtcaatccccaagttttaaatgtgtatctttacttagtgacttatggagtcgtaactattaggacacatacagcagtaagtctaaggcatataccagcttatcagatggatcccctacctggcaaagggaagatcctctttctctactaccttagtccttctttttatactctgtgcagcttttcagttcttccacttgcattaaaattagattacctcttagattagatcaaaagattgtccctggttgtgagaagaaagaatactttaatctagcactaatcccttaatacaccattatatttgggtacattttttttcctagcagaaaaattatttttcagccttctcagaagtactaaaagtcctttgccaacatcagcccagtgcaagttaacctgttatgagatttgttttgtgctttggaaatgcttgtcagacaagctttcaacattgagatgtgtgatttaaattagtttgcataagaaaatgtaatgccagggacaaatttctctctttatcccttcttatactacaaaacagacaaagagggttaggtggttgctttttagtatgcgagtaatcacttgggattcacagaaatattagatgcagtgttattagtgaaaccttagttccctttatagatatgtcttatgtcccatttgtaatattattattgttgttaccatacgcaaactttatttcttagtttggatgcttggtctcaaccagacccattacctccttatcttcctatctcttagggtcacttcatgcttagaggcaacttgttgaaagtggaggtcagcgtgatcctttttcttagaagacatagccctttcatggaacttacgtagctgattcatagcctgagtcagtctcttggatctgtgaaaaaaaggaaaaatgaaccagacatggtgtttgcagtcagtcttctttgaatataaaatatataggcagaggaaaaaattaaaccaggcagattaacctcaaggcataaagacaaatgctaaaatgtactctaacgtgaagggttaagcattccaagatgcccgttggaaggttctttatccaacacttctctacccattccaaccccagtgtaaacattaaataattcttttaaaatttgaatactcaaacaagaaagtaaagcatggaagataatttttaaatcattatgtagtgattagaggaagaggaataaagggtaatgtgagattttagaaataggtgctttgaatagataaagagatattgcaaggatagatgaactcactatcgtctttgcagtatagtatcgttggtgcagaggatttgggatagaaatccagtctgggggccgagatgtgatcattatgtgcaatatcatcttcaaaaagtcaggtcatggttatcagtttgctacaaagaacatcttagtctcatttcctgtccaaggcaggaattttcccctgaacattcctgacagaagataacctgttttgtgctctaatcacccagtcttctaccagaggttgaagtgacattttggctccattttctcgtattttatgcaagaagctgggaattccagcatcttactctgctcatcagggatcctgagggagctggtaatatgcagaaaggatgtcaaagggccatgttactaatagctgtggaagctccgctatccacaaagcagagattatgaaacagtctatactttggctagaagcctaagcagaatctcttctacttccctcaaaatctatttcttagcaccagcaagactgggtctgtccagtgggttgtgggtttggggagaagcagaggaaagattgacatcatgtggaatctggaagagacagaacacatctcttggtgcttttgaaggtacagtgactccatctagtagtaaaaggtgttcaaatgaatggcttcaaatttgaccagattatcaaatgctgcttccctgataaacagctcagacatgggttagaagaggtggccctgggatgggaagcagtgcagactctcatgtatgaatagctccaattctcaaaaaattcttttagttaactgctgtctgtcttcttctacattgcactcaagcttaactctgcacttttaaaatcaacatataaattataactttctctcctatgataacttttcaaatgttttttgacatctattcagtaccgagctcccttttgaaaactgggccatcatttcccaacctccaatttctgactgtatttccataatttatttaaagactcctaacaatggagccacaatcataactacaggtcccctttatatctcaggatgacattcatttggttctaatccttgaactcatttgaagattctaattgctcttgtattctctcctcttctatctggaacttatctccctgataagcatctgtgttgtgattcttctagagtggagattatttctcttgtaaggaaaaaaattaaaactaccttgttctactttctctgttgcatcacaccttctctcttaagtaatagtcctaaaccttctctgttcttctccagacagatcataaatgttacaccccaacctaaaacaaaacaaaacaaaaccttccttcatgaattattattggccttgtatgcaagactgagttgatcccagtctcaatttacctgataccatctatttcaacaataacaataataacaacaataatgaatatttatttagagctttctctgttccaagcactgttctgaccactttatgtatatttacttggttgactctaacaataattactgaggtgggccaggcacagtggctcatgcctgtaatcccagcactttgggaggctgaggcgggcagatcacctgaggtcaggagttcaagaccggcctggccaacatggcgaaaccctgtctctaccaaaaatacaaaaattagccgggtgtggtggtacacgcctgtaatcccagctgtccagaaggctgaggcaggggaatctcttgaacccaggaggcggaggttgcagtgagctgagattgcatcactgcactccagcctaggcaacagagtgagaatctgtctcaaaaaattaaataaataagtaaataaaaataaataattactgaggtggctattactaatttctctattttggtgatttggaaactgaacttagaagttaaagggcttgagcaaatacattggactaaaaggtggaggagctgaggtttgaagtttcaatgcaggcatctggctccagggttcatggtcttttaccatgatgccatgctgctatgtctacttataggagtatgcacgcttttatgttctttcctgtttttgtgagccttattctagcttttatatatttttaaactctgagctccttagagagtttccaatggccagtcaaatttatttaggtcctctgaatagtctctgaatggaagaaagtgtttttcatccctaaagcccacatgtatacttcagatgcacaaggttcaaggtcagggcctgaaggagaaagtatcacagcacaagtaacaatgttaaacttcaaaggaagataaaacctcaaaataagatattaaggtcaaatactagaatctgcagggacactgtcctggttaagaggcaatagaaaggaagtagcataaggtgattcagcaggggagagatgtgagaccaacagcgttagatcagtggggctgtaagagagactctccaaattcatttatggaggagaatgccagaagagtggggagagagtgagctagagattcccaagtcccctggcaacgcgaaataccaggggtactagcacccaggtctttgcttctaatgccattctctaatgaaagggacaaggcatccttggaaaaatggctaattctagcacagagcagggaatagacaagatgagcccggagaatctggtagtgacagaaaggaagaaaatgcagaaagaaaaaggaaggaagacaagggaagggaagggatggtatgaaaggaaggaagaaagggaaggaaggaaggaagtccaatgaatgggattggggtctatttctatctgtgttcttaacaatcttcttcatcagggattagattcttgtttttttctttgttgccttttttttttttttttttttttgagatggagtctcactctgtcaccacgctggagtgcagtggcgcaatcttggctcactgcaacctccgactccgtggttcaagcgattctcctgcctcagcctcctgaaagctgagatcacaggtacacgccaccacgcccaactaatttttgtatttttagtagagacggggtttcaccatgttggccagaatggtctccatctcctggcctcgtgatctgcctacctaggcttcccaaagtgctgggattacaggcaggagccaccgtgcccagcctgttgccttgtttctgatgggagtccaagaatctccaagctatctatatgagaaagacaaaactactctttctatcctgtactgtaatcctacctgacaaatatatccttcatgctccttgtcattttgagcaaatagcctgagcttacctcactttcatttgaacttcctccctctttattgccaaggtactacgttcctttatctctgtgcctgaacaagccccccttgctataatcttcatgctgacccctcattctctagagtatatgctgttttctgcagcagactacacggccagtgcccttgcttggagcagatctagacatcatatcgccacggtcttcattctgaagtaaccttagaagtcactttcagttcataacattaaagcacaggttacaactcatatgactacatgggccatataaaataaatgagtcaatgtgccgaagatcaggaaagtgatagctcaggcaagactgacactaattcttggcctctctgtctaagagacagaagagagtgctagagactatggcacccaggagaacccagaccgaagagggcagccactgctcagctgctgccagtcatcacagcacaggagcaatggaccaatattatgaatttatcttcttttgaaagacaatccagaagtcgagacttttataaaaagtctgaattcattacctgtattaaattttctttgatttaaaacactgatcaggctaaatacaacatacctgtaagatattacatacctactgcaagaaccctgcctctgcatataaaggagaaagataagcacagttgattctcttcacaagccctgtgtcatgcaaacaggattaatagcccagttctaggctaacaatttcatagcaaccatgtggttattatgtgttgtatatatgaaattatgccataatgagctgtctcctaacaagattgtgcaggctataaagctgttttatagctccaagagagttgctcctgagttcattgacagtgcttattgtttctttccatctcagttacttttgaattaaaaagtgctcaccctactctttcttctcggctacaagttttgccatagtgcacagtgtttcttcatcttactttctttaaagaacctttcccatctcttcagttatttctacctgttccaacctccctcctgatagcaccccagtagtgggatggaatgtgctggaggggtttggccagttcttgggggagtttcacagtcacctgtctacagtttcagtgagatgggaatttatcaagctgaaattagcaaaagacaaaactgacattgtttaaacacatacttaacaaaagatctaaccagttcctcctagaactagaagatatttgaaaattagagaggagcttttttttttttcctatcgctttctttaaaacacacttttccatagataatcttatctttttggcatcaacaattatttataattctggaatgatttccaaatctaacttgtaaccatatttccaactacctgccaagtgtctgtgctggaattacctaatggcatttgatcgtggctcaaatgtgctcactcaactttattccgtgggctgctcacctcccctgtgtggagcctgggagcctctgaaggcaaatcttgactcatctctcacctctcaactgatcaaccagtagccacacctgacttaaatgccatctggaatccagttctctttcagctcttccatttcttacaggaacttttacagtaacttctgaactgttactcttgcctctgaactgcctcctttccaatttattattcacaagttccctggagttattttctttaaaacaaaatgacagctttgtttcgttaaaagactgtcaggttactccattccattggccagagggaaagggacaaagcaagtacgtgcccacacaatctctttactgtggtatttggtagctaatacatctttcaagcctcatctacttcatcgcctcctgcaccccaagctggaattacatgtgtcttattgccctgtccctgcatatcttctggccttatagacctctgtgcctttatctatgtcgttccttctacctcaacaggtttctgtcctaccatggattgtctaatgccttctgcacatgttctttatcctaggaagcaaaatatttattccttttcctgcattctttaatacctagtttatgcatgtctcattgcacttattctaatcggagcttgttcttgtcattttttttcatatttttttccttttgtgggggagtttaggacccaagtctttgtcctcttttggtttaactagtaccttgcacagaaaaggtagtcaataaatgtttgaaaaaaaaaatcccagtttgataattagttgaaaatttcttcagttaatgaaaacttggtacaaccaaaggaaaatgaattatcagagtttactatgctccatgagattcttttcatacaagtatgctgcagaggaatggaagagtgggaatataaataaatatgaaaaattcttagaacaatcttcttattatttgagacagagtccagctctgtcacccaggctggaatgcagtggcatgctgttggctcactgcaaactccacctcccaggttcaagcgattctcctgcctcagcctcccgagtggctggaattacaggtccccaccaccacgcccagataaatttttttttgtatttttagtagagacggggtttcactgtgttggccaggctggtcttaaactcctgacttcatgatctgcccgcctcggcctcccaaggtgctgggattacaagtgtgagccaccgcgccctgccagaacaatcctattttctaattggggtttttctttgttttttgtttctttgtttgtttgtttgagatggagtttcactctgtcaccgaggctggagtgcagtggtgtgatctcagctcactacaaactctgcctcctgggttcaagcaattctcatgccttagcctcccgagtagctggggctacaggcgcctgccaccatgcccagctaatttttgtatttttagtagggacgaggtttcaccatgttggccaggctggtcttgaactcctgacctcaggtgatccacccgccttggcctccaaaagcggtaggattacaggcatgagccactgctcccggactttttttttttttaatccttctactttactcatactctccaaagttaattcacacacaacctccccaataaaatggaagtgaggtttaaaatcagaccataatttaaccagctgaccaaatgccattttgtataagaagataaaaagctaccattgttgttatatctcagagcagaagctctttcttcattttattctttaaaaacatcattcagggttgggtgtggcggctcatgcctataatcccagcactttgggaggctgaggcgggcggatcacttgaggtcaggagtttgagaccagcctggccaacatggtgaaaatctgtctccactaaaaatataaaaattagctgggcatggtggtgggtacatgtaatcccagctactcaagaggctgaggcaggagaatcgcttgaacccaggaggtggaggctgcagtgagccgagatcaagccactacactctagcctgggcgacagagtgagactccatctcaaaaaaattttaaaaataataagtaaaaaataaaaacaccattcaatttatagttagcatgaagctacaccatcaatctttcctcgtgttcatgatcatggctcagcatttttctgaagtgtcattaataagccatgttagcaggaatgacctacacatatgcatgtcaggagggcttcaggccactgctgtctgtgtgtcaccttgacgtcagccttgataattgtccagggcctccaacttcacagcagtacctgggcctatgtcaggttgagttctatgatcacacactattttcatcagaaattttaataaaattatttttttctcagatgacttcccgcatactactaagtgatctgggagaaggagtcttagggtgtggatgggattctgccttgggcatattttgctctactgggccctggagtctttgcagatgctgtcaagatactgcacttttttttcttttttgagacagagtcttgctctgtcacccaggctggaatgcagtggcatgatgtcagctcactgcaacctccgcctcccaggttcaagcaattctcctgcctcagcctcccgagtagctgggactacaggtgtgcgccaccacgcccagctaatttttttgtatttttagtagagacagggtttcaccatgttggcccggctgctcttgaactcctgacctcaggtgatctgcctacctcggcctcccaaagtgctgggattataggcatgaaccactgcgcctggccgatactgcagttttgatggccatcactggtacaacaccctgcgtatgccaagactgtcatgccttgtcagctataataaaaagcaggagacaaatggccttttgttacctgaaatgatggatcagtatgtatgtgcaaggatgcacgctgtcaagttcttgtgggttaatcatgccaggctgatggaggggctccacgagttccaaagtagaaggagcttgaactccaggctgtggctttgaagcagttgttttctctggaattagctaatgaggctctctttgtttgaggattggaaagcctccaaaaacccactcaggagggaaattaacaaatgtctgttttgttacctccggataaatcttcatgatgaaatgtgcagccggtccacctcttcaatcttctctcttcttcttcctcagtggaagctcaattaccatgaaggccaaaataaataaataaataaacaacaaaccaaccaaataaataaataaagcagataaaccgtggttctttgcttaaaaaaagttgcagcaaagaaaagctttagagtaatttctagttagaagtggctgtgagattcactgtcttctggtgatatttgaaatatactatattcatgcaaatgtttctgattatttaaacacattatctgtatctataattatcagtagctgctggcattatgtgagcatgcaaaagtgggaacagcagcagtaacctgactcatttcaaccaggatggaccatctcagagggtcacagttactaatctctgcatgaactagattttataaggtattatgattctttcatagcttgtaacttttcattgatcatcaactttactgatttttgttaatactggaaattttaataaatgggttgtgcacaggtacttattgagcatctattacgtgccatagaatattctgattattaaggatgtcaaggtatataatccagagtcacggttttcaaggaactcagtcaataattacaagctaatacatgggtaccactgttctaggcacagcgtggcagaaaagaatagcgtggacacacattcaggggatttaactaggagaaaacagtaaggaaggggatcttagcagaggtagtatattaacagatgtatatgacaacttacactgctgtaagtcatcctgtttggctggcaagttttgctttagaaactgggtaaatattgttcatgaaacttctgtgtaagtttcacgtgaatgttttcctatgtgtatgtgtgcatgcttatttgcatttgtgtgcacttgtgggtatgtgtatttgtcctgtgtcacaataaaaggtatctatttctggactttgcagtcaaaaacattggaaaactgtctatgtaggtaatggacacaatagaatttagaaagcaacttttacaaacattgcagatttgtaattttctaatatcattgatatataaagctgagtataccagacacttgtaaagaaatgatcttttccaatgaaaacacaggtgttaaacagaacctttcttctggcctacaaatcactcttctaacacttggaaaaaattaaagaaatattcagcaatgtgtagaatttcaatcccagagagacaggaagagactgtatagctgcagatgcaatatgcttgttattttggcaaaagcgtaacataagaagccaccaactctcacagaggaagcagagaaattcagtatttgcttgtaacttagatatttctttctttgttttccccctaagaagaacatatcttttctggtgggaaaagggaatttagataattaaagcagagggaataaacattttcaggaccaaagagaaaatagccgtttgagccacatatttaaatgttaatctacaatttttttttttttttttgagacaggatttcactgtgttgcccaggctggagtgcagtggtgcagtcttggctcactgtaacctcccttctcccctcttgggctcaagccaacctcccaccttagcctcctgagtagctggaactacaggcatgtgccaccatgcccggctaattttttgtcaagacggggtctcactatgttgcccaggctggtctagaactcctagactgaagtgatccaccagcctcagtctcccaaaagtgctgggattacagatgtgagccaccaccgtgcctggccatcaaatgtttttcatagtggactagggctttatgatcccataaaaattatttccctcatggaaccactccatttatgtattataaagctgtcaacatctggttttattgataaatatccctggggtttttgagctttttcttttcaacatagtgcctgtgttttatcttgacctttgctttaaaattactgctagatgtaatgaggattctggaaagagcatggttcaagattttgtacaattgatataatgattctgaagcaaataatgggaaaggggagagtttcagaatttggtggccttagggtaagcttatgatttgttttatctttcctcatatctacctaatgctgtgaaattttgggattagatttggattggggacaaatgaggagtggaaatagtggagggagaaagggttaggaaagttacagaacttggcaaggctcttggaggtggtggattgatttctctggtgttgtgaagtgtcatcttctttcttcagttaaactgaagtacaggcaagcttctcctgctgcccctcagtttcactgtgtcaccatttttagtagggataagcagagacttgttgttggtaaggacaggaaggaaggtgatgctgatgaatttttgctggtgctaggttagctgccagccggcctggcaatggctgtggtccagccagcctggggcgcttctagtattctctgtcatggggcaatatgttaacgaattaaaatgccaaatagaaatgagacagaattccaaagacatgtaaactgaaaaacacctgtccccatttgttgattttttttttcctgcatatacttaaaaaaccccaaacctttatgtaagagtctcaggagtgcagtgaaaaaaaagtgtttattgacgagccatttccaatttaggccttaaacttcaagacccatttctaagacccatatgcttcaaaacgttctatataattcagctcaaaaggatcttcctctcctctagatctataatgtttattgactacatccctcaaagagcagtaatgcatcatggtgaaataaaaattgaactgcaaatccgaagacttgaattctagttcctgatcgtttttcatagtgtatttaatcacacagtttaacccctaggtctccttcactgtgactcattatggtgagttcgcgtgagaaagtgtccaccataggacactaaattcaaaagagtgaccagtaatgattgttgtcccaaggatgtccaaatgggaaaaccattatcagtctacactctaaaccagaagggacttattccaccaaaagaggttaagggctccttaccacagtcacaaaaccagaatatatattctttcagagaaaacccggatacagggcatgagattagaaccctagaatggcatatcaaaaacttctggagtctgttgagtagaagtttggagaataaacaaattgatagattgatatttgaatccccggcagagtaagaggaataataagattttgaatcaagaagaggaattctgccacatgcaactaggaagaaaaaagcaaattaactgtgataacactcattagggattatcattatatctttaatgaggaggtaataaagactgattatttactaggcatcccttattgatccctatttatcactacgtagagtaaaatgtacaatttttcctttcacttgtggatttcattaatttatacagtcatcacatattgattgtacatatactgtataccagacactttattagctttaagaataccaaaacgaatatgccagatatagtatctaacttcatggagtttgtagagagattttttgaactgaatttctcagcaaactaacacaagaacagaaaaccaaacaccatgtggtctcactcataagtgggagttgaacaatgagaaaacatggacacagagaggggaacatcacacactggggcctgtctgggggtaggaggttgggggagggatagcattaggagaaattcctaatgtagattacgggttgatgggtgcagcaaaccaccatggtacttgtatacctaggtaacaaacctgcacgttctgtacatgtatcccagaacttaaagtataaaaatgagaaaaaaagatgcacaaatagtgtcacatatagtataataatgatatggatatggcctaattcatagagtcaacattctgatactaagaggaaggaaaaatcaaaacaaaataaagaaaaaacaaagcagacagtagcctttaaccgtttccttttaaagaaacattgttatctgggttcattacttgttagaaagtaatgtgaagcacttaataaacttcaggtggtggtattaggtaattaacatgtgaaattcctcatatggttatttaaatttcatggtagtatttaacagttttcatgtttatggccttttcctgcaactaagttgtaaaatccttaagggaaaggatgaggaaaggaagacaagagagaaactagcatttgttgactggctactacgtgccagccacagcactagctactaaacctgtgtcactttatttaaatatgaaggtcagaaagcatttctcatgttcctggtatctcctgcactgcctagtataatatttcatacttacaggtgcttcatcaatatttgtgttggttgacttagcaatttaaactgcttctaaatagagttacgtgagtttttccccaaagactcatgcccttttttaggaggcaaactagccctttccatgtcaccttccttaagaagcagggcaaagaggtgacagtttttatactgaaatcagttgtttaattgttcacccatttatcaaagcctctgtagagttaaagacaagtacagtgcccatgtaccctttatgctgcaagttctggacagatagctgtcaatgcctgaaaatagtgtaaattcactgggtgaagagagcaacttgccagggggatgtgatgtagccccttctagagtatggggttttctacttgggcatagtcagctgctagtttgttggattgctgctgctggggaaagaccaggccacttcatgatggaatgcgtcaacttttggaaagtcaaattcaggatgcagtttcaactagtagtaactatatttttctatcttttaaaaagtgaaggagcaacagaccagtctagacacatggacgggctttagggctcagttgctaaagagatagaagtaaaatattatagaaaatgcttatagtacatgttaagtgagaaaggtaaggtaaaaatggtttatgacctataactgtgtgaaaactaaccaaagagacacgtatcatttaaaaagatttaatgttgtgcctgtaatcccagcactttgggaggccaaggcgggcggatcacaaggtcaggagatcaagaccatcctggctaacacggtgaaaccccgtctccactaaaaatacaaaaaattagccgggcatggttggggggtgcctgtagtcccagctacctgggagactgaggcaggagaatggcatgaacctgggaggcggagcttgcagtgagctgagatcatgccactgcactccagcctgggcgacagagcgagactccgtgtcaaaaatgaaagatttaatgttggtcaaattatacacaacgattcaacagtactggaagttgaggaggacgagcaagccagatagcaccaatgatcatgaataaattccttatctttcagaaagcattattgttcagtggtttcaagttttggatgtgcactcacattgcctgtatggaatcctggctccacaagtagttgtgtgagattgggaaagttgcacttgtttaatctgtaaaatggaaaatatctgaggattaaattaaaatatagctggatcatgcatagcataatacttggaatatactaagtcatgaataaatagtactgttgtcatttctttgacattaattattaaggcaattaggaaattttccatctagttaacatatagcaaatcaaactaagctgtgaaaaatatataatatgctatggtaataagacactgaactgtgatgctattattggggtctgtctaaatccacagaagcatcagaaattcacataaatcaatgctaatgtcaatgcctagtaaattatagtctcagaaacatgaagattctagatgttttccccttctttgcacactttgtttatatttcaccctattactattatcacctatatttatggtttttcaatcatttgtgagtgcttggaggaaattcattggttcagcagttgaaccagggtattgaatagtacatgaggactctcagactctgaagagctggtcgggtgtctctggctaacacatttccagtggataaagagctgctccagggacatctccttcctctgcagtacagtgatctttttgctggtgactagaaagtccaggggaaaggacagccagccaaagggtggcaaactgatggaaagtgggggcaagctttctgtaaccatgtaaaagaaactgccaattcccatgaaaatccattgtctctttttcttattaacaaatccccaacaagccaccatggctcaagcctgtaatcacagcattttaggaggctgaagcaagagaattgcttggggccgggagtttgagaccatcctgggcaacacagtgaggcatgcatctctacataaaaattttacaattagtctagtgtggtggcacatgcctgtagtcccagctactcaggaggctgaggtggatcgcttgagccaggagttcaaggctgcagtgaactaggatcaagccactgcactgcagcctaactgacagagcaaaatcctgtctctaaaataataataattttaaaataaaaataaaatgctaaaatgaaccaaatctccaattttatttgaaataacactgccttagttttttaagaaagaaaataaaacatttctcaccttttctaacagtcaagctggtatgttgctttaagtttggtgagtgtcaggtatgcaaaagtgttgagtggcagatacagaaagactgcttaaaggcatctgactcagttgcaaaggacatcctttgtccttcttgctgcctgtactatgaatgtagtggttggatcttcagaagcctatttaatcataaggtaatcttaaagatggaagttatgattaagaatgccagaacacaaagataaaaaatatagaagtctcagatgaaatttctgaatcagccttaaactataatgcttaaactgtttaaatgtgaagggataaaatttggggcatttatgccactattttatgttatcgttgttacagtgagtacaatttttaattggtatgtgtgtaagatttgctcagatctcaatcaatggttctaagaggaaaaagcttaattccaagctgcctctctcctgtctatgatatcccaagcatcacaaagtacacttccagctcctcagaccctgtccttgttttgcattgtttagccaaaccacttcttaacttcaagtagcaaatagataactcacattagcattaggttctcttattacaagtaattgacaagaattgtaccagtgattaggtgttgcccaaagatcttttaaaattccatgtgacccaaatactaccaaatcctaaaagatttaactaactggctcactaaccaatgcacacacatacttacttatttcacccagtatgtgttgactaccttttgcccaccaggagctaggcaggttcacagtgcctagctcccaggcacaaagataaatcagaaaccattctgtctaagtcaacctttcattttagcttagcaggaaacacactaaaccacggctgaaatatgccaggaagttggtagctggtgatgcctctaccacaccgcagtgcggttaatccagcattcgacttagtcgaaatcacttttttcttccaatactggcatttttatggatggatggatggatagatgaatatcagtatcaaaaggtccatgctttattttctaataacaattcatgtccaattatctgactgccagcacagttatctgctatggttgttagaaactttagaaagaagtaaatcctccaaaattgtcactcttaaaatctgagagaaaacagaatgaatagataagagatgcttcaaggcagttcagctctgtgatggttccgttgagatagaacacacatatacaaagtgtttgaagtaagaatttccttcgaggagaagcacaaagggaatagaagacccagcatttgttactggccttagataagcttactgttcacttatttatcaatgtaaaaacgcccagttagtttttagctcaaggaagagaggacatggccaaagatggccttcatgaacttttttttttcctgtgtgaagtatggaaactcattttcagtattggattttgactggattgtcttctacccagaagctggctctgcagaagttatgatcagatctttggaagtaacatttgatctaccgccgaatatagatccccttccttccctcttctactccctccttgcttttccttcttattacactgatttcatgcaaaattaattatcagtcctgtcacatcttgcactgctaacagtggtcagtattgaattatggggaacgtgaacagaattttcagcagcctaattgcttctcctgtgcccagcaaaatgttacgttaaatactcacagcaagtagactagactgtattctatttccataacaaactggcgggatttcattaccagaatccctagcatctactcacatgactctttcctaactgccctatcagactggtcttggataaagtaaattcctttccaaagctgcagctgcctagttaggtattgaaatattgtatccacttgcaggtcaaaaaggaaaaaataacaacaacagcaagtggtccatgagagtgaagtggaggtattaaaactaggctgggtcttctcttggaagatgacagactgagtcccacagtgcctcactccattcaaagcaattaggagtgtaggattgcagtgacaacggatctccagggctatcatagtgctttacctaaagataacaagagattagcccttagtgacagatgactaatatattctgtggacactgactgagagtttgggagtttctactgtccctctcaaggagcttagagaatatgtacacgggaagacaaaaattaaagaaataaatgtaatgcactgtataatgcataatgataaatgcatcttcaaggtacctaagtaatttagaagatattgcagtgggagaagagtactgagatattcaccaaattcctaccagaaaaaataacacttgagttggctgatgaaggttgactaggagttcattagacatagtagagaaagtcattttagaaaaaatgataataaccagctttgattgagagctcaattttgcttgtcctttttggaagtgtactgtatgtatgtattagtccattttcacattgctataaaaaactgtccaagactgggtaatttataaaggaaagaggtttaattgacccacagttctacatggctgggaaggcctcaggaaacttacaatcatggtggaaggggaaacaaacacatccttcttcacatggcagcaggagagggaagtgcagagtgaaggggggaaaagccccgtatagaaccatcagctctcatgagaactcattcactatcaaaagaactgcttggggaaccgtccccatgatccagtcacatcccactggttccctcctacaatacgtggggattatgggaactatagttcaagatgagatttgggtggggacacagccaaatcatatcaatgtattaaaacagttaatctttatagtgatagtgattctttgaggtattattcccatcttaagaatgaggaaactgaggcactgagaggttaactcacagctagtaagtaagagagcaagaattcatacccagcagtatgaagaagtgaaggatgagttgggaatacagaacttgatcattgagagtcatactagtcacaccaaggaagttagagttaatcaattgacaacggggagctcttgaaaagaactgacaaggtcagatttgcattttagaaatattgttgtggaaacagaaggattgattagaaggaagccagaactggagcctggaaagttggctacatggctttcacagtaatccaggaaggggatgatggaagagaggctgcagcatgggagcaacagctggagtgaagaagagaggatatgtgtgggaaatctttaaggggtacatttggcacaactaggtgatagacagaagtgatgggtggggagtagaattggtgaatctactcttctaactgcctttccctatctccagtctcaccaagtatcttgaattaggaagcaaggaaaaggggtcaattaagaaaaagggagagcaaggttaatggagaacaggctcaagaaggaagaatttaaaaatggaataaggcaagagaggataaagaaactacctatggagtgctatgcttgttacctgggtagcaaaataatctgtacaccaaatccccatgacatgtgatttacctgtataccaaacctgcacatgtatccctgaacctgaaataaaagtttaaaaaaatagaatgagttaagagatttggtaatcttgagaaatgtctgtaaagtgtccatgtattccatgggttcaatggggatctgccattgaaattcatagacctgaatatcagagaagggtagaagattagagaatttgctgtttggatagtcgaactccttctttcatagatgaggaaagtaaagtctagagaaattggagagacttgtgttatatcacttagtttgttacagagctgaattcataccacccatttccatgtgccctcaaatagtagccgacctcttccttcctgggagagaatccttaaccaccaagtcctgatctcataggcctgatagtcaatccttggaagggatactgtggtgcattgcttagatccgtcccacttaaccctgggacccacatactcactcaccaacctgctgggagtgctggtcactgacctgtctcaactaggttgactccaggaattgctctctgctaaaggattttttctgtttcagggatataccaaaatgaaaaaataaaaattttatataaagagcgtttgttgcctgggttgtatgcctgtagaatacattcagaggtagaattactgtttcaatagtattaataaatttttacccaatggcttttcaaaagtgtgcatccccaatggcttttcaaaagtgggcatcaatacacacttagaaatatgcagtaggatcaatttcaccaattatctcaccatctttttagaagctaattcattttgcattcttaaattccactaaatttcaagagagcagttaaagaataatacaaaactttgaagcactaaatgtatatatttaagatattatgtcttctgtagtcaatggcaaatatcaagaatagagaagatgcacaaaactgaccagtagcagaaacagagatccacattctaatctcacgtctttctactttggttaaaggcaataattcctatttcactcactgatgagtctttccctaacgagaatgtgactaaaaccagttgagtttgcgaaagggatgtagaaagagacaattaggtaaaggtgaaaaatgagactgacgaagtgacgttggtcaatctcctgtttactgagtgcaggttaggaaataacatcaactaggttttctggaatttgagaactgagtattataaaaacactgactccgttattattattattgtcatttttaattttggattcagagataggagctgaatagcagcaaaaaaaaaaaaaaacatgcttatgaagagctgcctagtgaaaatgacactcctttggcttaggaagagaaagaaaatgaaagccttacttctttcttctactgattgaagtttttactttctgctgtttacttgggtttttaatattgaagacttctttgtagtctctgatgagttttgaagattaattttgcagaagtaagataatattcctgtttaccagaaatatttctgaccataagactcattatttatttattatggatggtcattttatatatttttaatgcttatttaagactccggagtacatgtgcaggcttgttacatggatagattgtgtgccactgaaatttggtgtaagaatgatcccctcatcattcttagcatagtagtcaatagtcaggttttcaagcctcaacccttccctccccctctagtaatccccagtgtctattgttgacatatttatgttcatgagtactcatagtttagcttgcaattacaagtgagaatatgtggtatttggttttctgttcctacatcaattcacttagggtaattgcctccaggtgcatccatgttactgaaaagaacatgatttcattcatttttcttttctgtggctgtgtagtattccatggtgtacatgtaccatattgtttttatccaatccaccattgataggcacctaggttgattctatgtctttgctattgtgaatagtgctgcagtgaacatacaagtgcatgtatcttttttggtaaaataatttgtattcctttgggtataaacctagtaatggaattgctgagttgaatggtaataccattttaagttcttttggaaatctccaaactgctttcaacagtgtctgaactaatgtacattctcaccaacagtgtagctttccctttcctctgcaacctttccaacatctgtttttttgtttgtttgtttttcactttttagtaatagccgttctgactggtgtgagatgatatctcattgcagttttggtttgcatttctctaactagtgatattgatcactttttcatgtaattgttggctgcatgtatgtcttcttttgagaagtgtccgttcatattctttgcctatttttaatggagttatttgatttttgtgttgaattgtttaagtttcttacggattctagatattaggtgtattttaaatgcatagtttacaaatattttctcccattctctaggttatctgcttactctattgatagtttcttttgctgtgcaaaaagtctttagtttaattaggtcccacttagcaatttttgtttttgtggtaattgcttttggagatttagttgtgcattctttgccaaggccaacgttctaaatggtatttcctaggtttccttctaggatttttatgatttttaggtctcacatttaagttttcaatctatcttaaataatatttgtatatggtgagaggtgtaggggtccagtttcaatcttctgcatatggctagctagttatcccagcaatatttgttgaatagtagcgagtcctttccccattgcttgtgaccatgagattttatgtgatgttgaaacccaaaactacccaaaggaattaactactgctggttaattgtacctatattaaacactttctttatagtattttccttatttgggggccatctcaaagtcctaacaatcagaatttgtgtcttctcatatgatttttactcagaattacacagaatacagtattcataaaaatgaaccaaccataaaatatttattcttctactgtgtcaggtagtcttgtaggttcctaagagataccaaatacaggttcataattcttgtcctcgaagatctcccaatctactgataaagcaagtaccatatgcatgaaaagataaatgtctttataaagtttcttaatcatgagtgcccatttgagtggtctgtgggtttttagaagttattcacagaaacgaggctccttagttctgacatggggaccatttgtttttattttcaaaaagctctatgaagtgatttggatgtaaacctctgaaaagaagttattgtcttaaatattcatgggaggctaggcctacttgcatctggagttggctccagaagtctttacaaagttagcttggcattggctgggtttcaaagaataaatagaaggggataaaccaagaagaaatgtggatatatatggggcacgattgaataatttccagaaagaaatcagatagtacaaggagtgtccagagaatgatgtatatggctgaaatggaagtgttatagaatggtagttagtaataaagctttaatatcacaagcatattgaaacaaattgcatgtaaaacactgatgtaataaaaagatttagattgttggagtattttgatgtcaagtacttgtcttcctggtgatgtgaaaccatgcatatgtgttttaagtagaaatgtgactccatgggaaaacatgtaagaacatgagcaaagatggatgagaatagggtgagtgtgaagggaaaacttattaggatgctagttctctgaggttataaagaccataaggtagtggcattggagtacaataaaaagatgacgacattttaaaggaagaacctccctggcagcatggctgaatagacctgggaagaaagagaatttatgcctgaatgaatggaaaactgatgattttgtatctcaaagtggataatttatttagaggcaactggctttggaggaaagagaaaatgaggggttttctaatgtttgagatgatagagaaacaggcaagcatagatactttggaggcagttggatatgtagcattggagtcaaaggccaagtaagaggtagagaaagagattttggagaacttctcatggaggaaatacttgaagtctggagaatggatgagacctgaagggaataagatatgtagatagagacaaaagttgaagggtaacactcagactttgggggagatctacatttaggaagtaggaggagaaaagtaaaggcacagtaagaaaaagaaagattcaactaaagaaaaggccaaaaaaagtgtaacccacagagaaaagagcatttctggggctaaggagtgatcaacactatcaaaatactacaggtaaactagtaaaacaagtaatgtcagcattagtttccttgtctgcataacaataatagttattatgaggtatttttgtgaataaactgaaatgatgactattaagcatttagcccaaggctaggtaaaagaaaaggctagccaaaagcatctgttattataaatataataattactaatcagcacccaactatgccgggcacttttgtagttacacatttgaataagatgcaaccctcaatttcaaagaggtaagtgtcaatacaaagataaagatgtgaagaatagatagataccattttgtggtattgtttctacaagaaagatgtaaatacaatggaaaaggtgccagtggagaaaagtgataactttatgagtcctttgccagacataagtgatagggttttctgtacatattacatgttattcttagacttgtgcaatttgctaagccagtttatagactcttgaatctgtgtaattgctatgttcttgactcaaacctgaagggacagactcttgggagggaatagccaggttcagccttttatctttcttctgtgcacagaactcttgcttactttctccaccatgggtaaatcagaatggctttgaacaatgagcattttctgcagcctgagcagcagttgctctttagacccaatttacaaattaggaaaaacaaataaattatttatagcatgacaaaaataggatttggcttaatccaacagctttctcagttacaatgcttgctgctcaagtaatggatcaattcacagttggctaaatccaggtgtttttgaacctttctatttaaagtatggttctctgaccagcagcatggagatcccttggatatttgtttcaaatgtagaatctcaagccccactccaaacttaactggataagaatctgcgttctgtcaacaactttagaggcactgtatgcagattgagaggcactgggctagaatactgaattagggctgaggaacatcatcacattctccacgctgtcccagtatactgttggatgatgtcagagcaacgtgaaaggattttgggttatggtttagctcatagtccatgcagaagaggccataattagcacagggtaccatggcacttctcatctgagacatgtgacatggatttgcacagatgagtacttctgacctattaatgttagtagtagaagtgatccttttgtcagtggaaaaagctgccagactcagaagcaagtaaaacctgaagaatcttttagaactgttagtcaagaacttcataggtggtttatataaaatttattgtcacttgctaactgcatggctttcggcatttcttaacctttctaaacttcaatcttttcattcatggaacgtagataattattgtacctgtatgacagggtcaatgaaaggttaaatgagtgaagatacataaagtagttagcacaggatctgggatttagtgagggcccagatactacttgtctgttattatttagtttatttagtttatttttatttatttatttatttgagacagagtctcactctgtcacccaggctggagtgtaatggcgcaatctcggctcactgcaacctccgcctcccaggttcaagggattctcctgcctcagcctcctgagtagctgggactacaggcatgtgacaccacgcccggctaactttttgtatttttagtagagatggggtttcaccgtgttagccaggatggtctcgatttcctgacctcgtgatccacctgcctcggcctcccaaagtgctgggattacaggcgtgagccaccgcacccggcctattacttagtttattattatttcattattattgagtatctattatttgatcttttatgtaataatagtgaaataatagacttctgaatatttgcagagaaatccaataattttaagtgatattggcaaatactatgatattagaaatctaggtggtacttaggaatctattttcttagtctctattctgtggccagggaaactctttattccttttgtccctgctatatttgagacaaagatcttgaatgcatccactcttccctaaggaaatgccatcaactcatcatccccataccatgcaaatgccttttacagctgcagagcaggtgtgggcagatgcatacagcagcatatgaacacatgtttaccctccttggccacactttgtcttactctatgttttctaggaacacattttggggtggaaatgcctttattccatttatatttagtcaattatctggtttagcttccattcttacaacctaattaaattcagcccatcaactcagtttaaggcatagcagctgtagacacttcgtttatctacttggagagaaaaaagataagttggtacaggggttccccatcttgtgaatgcaattcccattcaactacatgcaattgaatatgagcatgggatggtattctggacctaatgttaaattctgctactaagctatcatagttgaaataatatactcaactgcaactttacatattttccagggaaatgcaaatgattgcttttaaaggaatgacaactcatttgcctgcagatttcattcaggatatttaattctgaactactagcctatcacccattaactgccatttctaatatcttttgactccctcaaagagggaaactcataatttgtttcacttagaatttacatttttttaatattctagaaaccatgaaagaaatcactgagtccttagctcctgttttttttttttttttttttggttgttgttaaattgtagaatattagaatgtttcagttttactgattgtatttgttaatcattcttcttccactaccgttgtcttttcccatcctcttggaagggtgttagagaagactctatatctcacctacagatgatttcacctagaagcttagcctcccttcatgactactgttaaagataaagactgcctttggttgacaccataacccacaagaaatgattgcattcctcctggatggggagcaggtgacattgcagatgttacacttcccacatggctaagccactgatcgagattaaaaattcaaaagacaccaaagagccacgttattgtcccctcacagggagctctagaaatacatgacctaaattgtttcttctaagcatattatcagttccattttcaaggtatcaacatgatatctttccattggttcacaggaagaccaaagagtgacaagagaaaaatgtttccatttgtagtttttctacagactcatggtataggtcagcttttttattgtaaatatttaagatgtacatttaaggtgtctccatatatgtatatatatatatatgtatacatagtgaaattactagtagagtcaagaaaattaacatatccatcatctcagttacctttgttgtcataacggcacataaaaatctactctcttagcaaatttccatgatacaatacagtagtagtaactatagttatcatgctgtaccttaagtctctagatattcgttctacataattgtaactttgtaccctttaacctatatctccccatctcctcttccactgcatctggtaaccaactttctactctgtgttactatgtatttgactgtttattagtgtcgacttaggagtgagatcaaactctttcactctctctttctttcccgtttttttttttgtttgtttttgtttttttttaaacaagatctcacactgttgcccaggctggagtacagtcacatgattccagctcactgcagcctcaacttcccaggctccagggattctgtcacatcagtgtccttagtagctgagactacaggcatccaccaccacacctggctaattgtttgttgtagagatgaggtctcactatgtttcccaggttggtctccaactcctgagctcaagtgattctcccacctcagcctcccaaagtgctggaattatggtgcgagccactgctcctggcctctacagtatttttcttgctgtgtctggcttatttcacttagcataatttcttctgggtccaatcatgttgttgcaaatggcaagatctccttctttttaagactaaataatatgccatttaatatgtacatctaccacaatgtctttattcctttagcatgaggagaatattgaacattactttgagaactagaaaaaaatgaacatgtgggttattttagtggttaaaaaaaataggaaaataactataaagacatgaaccaactatcaggggatgtttgggttgtttccatatcttagctattgtaaaaaatacaagaaagaacagacatctctatggggtgcttatttcatttcctctgggtatacccagaagaacaattgctagataatatggtagttctagttctaattgtttgaggagcagccattctgatgttataatggctgcacctatttatattcccactaacagtgtacaggcattccctgaacttcactctatattttatttcccaaatgagatggaagtacatggaataaagtagtattcaagccagtttagtcttcacattctaaatcacccctctatgaaacctctccagattaccttttctccccatgtggatctgaatatgctcctttattcccagttgtcctgtatgtatccagttttacagacatagcatctgtaaaggacactgttgtcttacaccgaagtgtagcagttaagaactcagggtttgcacctttccagctctgtagacttgggccggcaactgagcctctttcacccatagtttctttatctagaaaacaggagtgatgcatgtctcataggaccggtgtaaggattaaatgaattgtaactagaaaattgttgggaaataccaaatataattatataatgactagcctctgtaggtataaacagtttaattacttataagtttacatgtctgcttatattaaagagggaaagacttagactgtagttcattttcatgtctctgtaacacagcactctgtttagtagttacataaatagtgattgaatgaatgtacaagtgagtgaataatcatctcaagtctatcctttgtcaaggaaaatttccagatagagttctttctcctttagggggtctttaagatggtcccagtgccagcccaagaagagccagagctagatcttcaaggcagtctgggacctggatcctcccctccagatgcctagaggtatctcctgggaccatgatgggtctcagtcataccccttcattcattggttcatgtcttcatagtcattttctttttttttttttaaaccactgaaataaccctcattgtttgtcattatttctaatactcaatgtagttttaaattttctccccatgctcaagaagagaaatggaaatatggcaaacatctccatgaacccacattttctcacatctttagatcaaaaactcttattcttcagataaacaggttgtaaaattttcagtgttgaagagaatgaaatatgacatttgattttattgattcattgcttatttttggcagaagttatcctttattcagtttcatctctttatgtcttaccacctctttgtgaactagccacttgccttgagggtttacaaattcaagatttctcagcacgattagccctaatagtatgctttccttccaaggtttccagattatccaatacagtattatttctatcccaatcatgtttaaggattattattttacatagaaataaataaagaaaggggaaccaatacaaagtgttagaaagacagctacgattaatatattggactggcccattatcagaccctctagattttacaggtagctttctgatcagaaatctcgggtgagaaatagtaagaatgatggccttagttaaatcctctatcaatatgacaggttaaaaaaaagacatatgagttagttaaaagcacctctcccttggtaactctaagtgttttagtttttcagatggcaatttgtgactttctatagctttttcttgagatgaatttgtggaccagttgaatagtgatagaaatacaggacttgctaaaaattacaaagtgtttatggcagttctggcaaatatcctctagatcaccagataatgccaagtcagcaatattatcaataatgagttgcctactaagaaccaggggaatgggggcatggactgaaactttaccatagacatctttgctattctggactgttggtttgcttcctagtgtacttctgcttatcctttcttccctttggcttcattgagatcctcagccactgagttctatcttggtgcattccagccacaccccaaaagaataacaagaatgaataagccatccatctctgaatgtagagcaggttggaaaatgataaccttattcattattattgcttgatacatttccgaatttgtgttatctgtcattaaatagctaccacagccttctttcattcttctcggtatcagtttaataatttgttcaatgaatatgagaaagaacaggatcacatccagattttaccacttactggctgtgtgacactgggtatggttattaaccccatggaacctcatctttaaagttcagatgatggtaactaactcatgaggttgctagggattaaatgaagtaccatgtttaaggcttctggcgtgggtgctgagatatagcagataagagatggtagtcaaaaagaatgtgtcttactttttttatagtatatagagtgacaattttcaatacaaatagtgtctgtatatatgcagtcttaacacggcattttaaaatttcattgtagactttaaaaaacctaacaaattggatttcagcctctttcttactatattagaaaataaaagaagattaaaataaaaaaaggtttccttttaatcaatctattaataaaaagataagtactgagattccgttgacataaaagtaattgaaagtttataggcaaattcttgaaatagaaaggcactttttttcctcataagaggacagtttagaggatttaaaaagcaatcaaaggtctcatgttttatatgatcaattcaaattgactgaattttcatcatcatcctcctccctccttctttctgatagtctacatttgtggaatagagagatttttgtctttcaaattctaaccctgaggatttttgctaggcacaagttaagacctgtattgttttctcctaacagttcctatgacatttttaaagtatttactttattctagtatgtccattctgttgatcttcgaaggacctgtgtctctaggtgacatctgtattcaaccaattttgaagactcttctgattggatttagcaggagatttgtagagtgtggggctttgactaggcccaggtcctttgccagccaggcatagtttgtccttgtgagggcagatattggaaaggtggaggagaattatgttctatggcactttcagaagctcgagaataccttggcagagccaagccttctgcttagggaatggctagcagtaacaaagcatggtacctgagatcaggtacatagtcaagagttaggttgaaagtcgaatattaacctgaaaaaggaagatttggcagcacagtgtatcttacagtcccaggaaaagagccagttgacatgttctgtgagacttcagaaaactgtacgacgtgaaagtagaagcatttctaatcatagttatattttgagtaatctcttcacagtagaatgagtcccccaacactggatgtactaaagccaaaggaagggccaccacttttcagagttattgaaggaattcacccatcagatatgttttgattttattcagtgattgttcaaactagatccgtttctctaccttattttcaatgggcagtggttctctagttcatcaaaaagtttttcctctggaatttttgagaagcaatagaaatccagagcatttaaaggtgatgattaattagtatattaatcttagataaatgtccccagataatttttaaatgatcaaatttgtatcaaagacattatttattttagcatcattttgatttcttctactttgttgctggggttggggtaaaagagggagaaatggagaccatatataattccgaaatgaaaaaaaataagcaacaatacactgaattttcttagagtaaacataatgctatgctgggttgttatagcatttacaatgctcatcttcccttacacttgaatgacttcctcctggatctgaaacaccttcctcaagagcatcatcacaggactgttaaaaatcctaacatgttacaattttactacctttcttcttccagtattccagcttggagactttgcgtagccctggttaattaatgttgaacttttcagggtatctgtgaatcatggtggggggtagggttggggactagaatttaattaaaggcacaagcttcatggggattgtgaaatcacagattccaaaagggagacagccattctagggagactgctaatagggagtaagcagggtgacaaagtgtgcaggaactgaaggaagatgacattcaaaggtctaaacaggggagaagaaaaacaaagagatcagcatgttacagctgagccttttcaaatgcacggtgataaagaacagatatgttttgtgtgtgtgtatgtgcgtgtgtgtgtgcgtgtgtgtgtgtgtgtgcgtgtgtgtgtgttatgcacagtggcttgaaggtagcagccctttcccctgatagaaatttgatgatggcagcaacaaaacctaaacagagaataattaaagagtaagggggtagttaatgaaatgaaaataactttaaaaggatgaaaagaaattgttgttaacacaccatgtggtttacctatgaacctagctgctgtggaaacataataacacagagtcagctcctgcaatgcaagtaagccacttcctgggtagaaatggggctcttcggaaaaagattaacttttctgtccacaggggtattatttagctcactggaatagcaatttgacaaatggtgcctttatggcccaagtgaatactgctggtttctgctaaaagggcaggtgctacaaacccaagaagaaaaacattcttgcatacttgcccccctcagcataaggacaactttgagcctgttcatttttgagagttccagcagtggaaagaaagctctaaggtttggtaacctgtgactcacagagagcagaatttcaagcctagttgagaaaacattccttcaagagggtgctgcttatctgctttggccacgttggattttggaatcttaactgttcttgtcactttggtcctggttcaagtcaaaagagtttcttctacttgggacttgaattaggtgaagactgacggacatttatttacgtaccaaaatacacaacatatgtgttgcagttagttcctccttacagaggaactggtaagcactttagccaggtagggctaaggcaattttcacagttctgactgtatgaggattcctgtttctttgttgtcctattttatgcatcatccactgattctcatctaaaccccaggccattttgcgtgaaaatagtccttctataaataaaaaatttagaccagaggcaaaggagcctccatctctctgcttacaattattgctcaatgttcaaagttctcaagacttatctcttcctattgcaatccctaatatacccgtatatagatacatttaggtctgagaatgcttgagcttaaagagagtaagttcttgtttggtacaagctctgcataatacgtctgagctgtctccctgctttagaatgcagtggtagaagttttttttacagcactctgattttagccaaggaactaacaaccgttgtgtaatgcactagctaaaatagtctcctttatcgtgtaaaagtcatccattgactcatttatttatttaccaagtgcctactatgtttcagaaagggttgtaaagggaacagctaagacaaggtccttgtcctcatgcatgtcatactctaatgagaggagacagatcatactttaattggtaaattatagtcaattgccaacagcagtaagtgctagagaggaaaggaccagaataagggtaggaggtacttttgagaggtgacaacgtgctagcagccctcgctcgctcttggcgcctcctcggcctcagcgtctgctctggctgcgctggaagagcccttcagtccgccgcggcgctgtgggggcccctctctggggctggccaaggcctgccctctgctggcggggaggtgtggagagacaggcagaggtgggagtcggggctgcactgggcgctcgctggcaggcaagggttcgggctccgtggccccgcactgggcgcagccggctgatgcctgctgggcttgaaaagggacgagctccctctgggctgccggagtgcccgtgctaggttccaaagtcgccagtgagtgccactgagaggtgaagccggctgggcttttgggtggagtggggacctggacaacttttctgtctagctaaaggtttgtaaacacccaatcagcactctgtgtctagctaaaggtttgtaaacgcaccaatcagcactctgtgtctagctaaaggtttgtaaacgtaccaatcagtgctctgcatctagctaatcaggtaggggacttggagaccttttctgtctagctaaaggattgtaaatgcaccaatcagcactctgtgtctagctaaaggtttgtaaatgcaccaatcagctctctgtcaaaacggaccaatcagctctctgtaaaatggaccaatcagcaggaggtcggtagggccagataaggaaataaaagcaggccacctgagccagcagcggcatcctggtgggtctccttccacactgtggaagctttgttctttcactctttacaataaatcttgctgctactcactcttagggtctgtgccgcctttatgagctgtaacactcaccgcgaaggtctgcagcttcactcctgaagccagccagaccacgaatccaccagaaggaagaaactctgaacatgtccgaacatcggaaggaacaaactccagatacaccatctttaagaactgtaacactcaccgcgagggtccacggcttcattcttgaagtcagcgagaccaagagcccaccaattctggacacacttcgagtagtgtggttggagaaggtccttgggagaagacaacatcacacctgaaataagagagattagaaggagccagtgataacagacctggaagaagggaattcaggacagagggagcagaaggctctaacgtggaaacaagaaggccagagtacccagagcagaatgagaaggggattcctaatcaggaaggaatcatatgtggttgttcactgagagcaatcattgacagtctcacccatgttctacaaaatttcacttcatgattaaaacaaattatatctctgtctttgcctaagacgtgtattaaataacagcaatacaaataataaacatattaagtccattctgtgttctagtcacaatattaagtattttatatatattatttaatcttcacattactgctaagaagcagtgataaaaccaagattttaaaatattaaccaatttctcaagactaaacacagctagtaagttgcacgacctggatcaattctccattggcttgtttccaaagccacaggtttactttaacatatacagcttttatagcactaacattgtgttctatgtgtccgtcattaagttgggtattttacacacattatcttaatatataaaacaattatatgcagcagatgttattaccatgatactgcaaataagaaaactgagaaatagaacattcaagggatttgctcacagccaaataatagtaattggcagtgttaggatttagactgatttctgtgtgatctgtagtccattctgttcaacactacatgtacctgccttcccgtggtatcattgccccagttctgaaacctaggtctaggtcgcaggagaactagcttgataaggatgggctttagagccaaaatttaagccatgctttgtcttatctgcataattttatgttcccagtcaggtaaaaccttacccatttatctttatttcctatcaaatgcagacttccctatgagctgttgcttggtaagttccaacccaatatgatgtcaccactgggtggacctctatggcacctgtctcactctgccttggttccagttatttttgtatatgcttcattgattatttctactcacttcccggaaatgttccctttccctgagaaatggagttgtatctccctcattgatgcatcctctgtaacatctagctgtttaatgtgtcactcagaataagtgctcaataaatatttatcaaagtagctgatgtttcaggaagtctaggaagcaaaccacctcttctgttctgctcttggattcaagaacttaagaggattttgttggaaatccacaaagaatattttaaacgagacacataataagactctcttttgagatgagagaaaccaacaacagcaaaagatgggtggtaacagaacggtgctgtttgctgccagctgatgttcttcttgcctcctggaaagatagagccagaagtcttccatcacttcttgggatgagccaactggcctgttttaacctatattacttgagttttggctaccaaaactctaagcattcacatgggcccccacgaagctctgccatctgacactttcagcaccttcaactctatccagtctcactcctgctgtactaacaaacattccataaacacaaaaccaaaaccacttaaaaaaaaaaatcttaggctgtccctacaacttttgctatcctcacgaaagagtgttactccagtgagacaaaagtccatcacaagaaatgatttttctacggaaacagctgtgattggagcaagatacaaggtaaaacatgttgtggtcaagttcaaggagaaaacagggtggctagccctagcaatcctactggtggacttacttctgcacacttcatgctactatctatcctgtgttgtctaaggctatataatgtcgagagacgggctagtccaggaatcatgacagcaaatgagggagagagagagagagagaggagacagagagatggctcttgcaacctttccaatagcttttgataggttacgtatggaaaaagcctcatattgacatcaggtttacttaggttcaagtgaaaataatgtctttaaaataaattatctcttttgatgaaggaagtcctttttgttttttgataccatgttgcttttgggaaaacatgcctgaaagtaggcaagtttctctaaagcaagaactgtaaaactcacagaaacataaagttgacttgatcatgcccattttataaataaaggaatggagactcaaagcggttaagggacatgtctgcagtattttacccgtgagctatatgccctctgggtttctcctcatccatctgcccccaacaactatgctctttcctctttcctttactgtttctgggcatatcaaagccaaacttaacagcaccaatttcacattaaacaaaagaagaggaacctactgaccaacctttccccatcgccaccacgtctagcctcgccagactctggtaatcattacactactctgtaattctaagatcgacctttttagattccatatatgagtgagatcttgaggtatttgtccgtctgtgtttggtttatttcatttaacataatgctctctaggtttacctttgctgcaaatgatgttctggtgttctgttgcacagtagggtaactagagttaacaataatatattgtgtcattcaaaatagctagaagagagaattttgaatattctcaccacaaagaaatgacaagtgttagaggtgatagatatgctaattgcccagatttgatcattatacaatatacacaggtatggaaacatcacattgtaccccataagtatgcacaatgattatgtgtcaattaaaaacaaaataaaacataaacaggagagaaacatgagctaaaaagaaaaccagtaagcaaatgcactagctgaatcagatcattttatgcctcttgatcggactttgatggtgggaacatcaggctacaactcttgcctgaatccacagacatggaaggcaagagaaattatttaagcctatgcaatcatccaggaatggaaagtgggaatggggttcaccaaacgtactagttttctagggctgttgtaacaaagtgtcacaaactgggtggcttcaaacaagacttatttttttcctattctaaatgctagaagtctataataaagccagggccacattcctgctgaagactgtagaatccttccttgcctcttcatagcttctggtatgtgccatccacctttggtgttccttggcttgcaactgcatcactctaatctctgcctgtgtcatcaaatggcgttttccctgtgtgtctgtatttgtctgttctcatgctgctttgaagaaatactggagactggataattcataaaggaaagaggtttcattgactcgcaattccacatggctgggaaggcctcaggaaactcaaaatcatggtggaaggggaagcaaacacatccttcttcacatggaagcaggagatagaagtgcagaccaaaggggggaaatggcccttatggaaccatgagatctcatgagaactcactatcatgagaacagcatgggggaaactgccaccaagacccagtgactccttactgggtccctcccatgacatgtagggattatgggaactactattcaagatgagatttgggtagggacaaccacatcactgtctgtcttcacatggtgtttctttcttcttataggaacaccaatcattttgagttaggatgcattctaatgacattatattcgtttgattacatctataaagatcctatttccaactaaggccacatttgcaagtactagggattaggacttcaacatatctttttggagacacaatttaacccataactccatgttataactgtactttttcagaatatcagtacgatggtgcccctaatcaacaaatatattgtcaccaatatgctgcagtctgggagaacattcagggatttaatttttctgacacacagactgtgagttcttttgttttttgtttttgtttttctttttttgttttcagcacatcacactctggctgtcattatcagttccccataaactgtgataatttttgtgtcacatagagtgtttaggttggcctctgatgaaatgaagcccaagtacttgctcttccaggcacctaacccagggcaaaaacacagagacctaaatgccttctctcagattatttttttattatatttccagtgagcagaaacattacagatgtgagacttgttctagaaatcagagtatttccccagggaagcattatcactgttcagatattactaagaagtgtaaaatgctggagggcaattgcatccacaccgtcctctgcccatcactgcaaagggagaaaggagaaggccatggggggatgcagcaagaccccaaggtctaggctcctctgccaaaggagcatggatgaccaatttggaaagaacacttgagaacctctgctctgtcctcttcacttcactagtgagaaagctaaagctcagaaaggataaatgacttgactaagctacttattggaaggtgggtgattaggatgtagcataggggtaagactgtgtaaccagctgacactgctttaaatgataaagcattgagttgttctgttttaatggtacacaagtcaaaattgttcaaggattgagagtggagccagaaagcctgggtgtaaatcctggctccttcacttacaagctgcgtgatttggggcaaatcaggtaaccccttcctacttctgtttcattgtctgtaaaatggatattataataatgtttacttcatagattgatgtaaaggtcaaattcataatatgctaaaagttcttggaacattgccttacacagatcaagtgttaaagaagaattgatattattattattgttattgttattattcttattatccttgagttcataatcagggtgtcctgaatatactacacccaggaatggaagccccaccacattgtaaagacacattcacttcccttaaacctcggcatatttgaggtggttgtagcaatagtggagggagagcagcaaggatggacacaaagcttacagtcacccagcagtgtaggaaaggggggaatcctgcacacactcccagacatggtggaggtcctcaatcactgcagagaagactgttgtgggaatgacagcaaacatgtagctcatcaagaaaatcagctgacttattagttcttctggatctggttggagtccctgaccccagagctaaattataaaggttattttgttgtaattttgatgctctaagaaactgatgtaagatatagaaaagttcttttttttttttttttttgagatggagtcttgctctagcacacaggctggaatgcagtggtgccatctcagctcactgcaacctccacctcctgggttcaagcgattctcctgcctcagcctcttgagtatctgggattacaggtgtgcgccaccatgcctggctaatatttttatttttagtagagatgggttttcaacatgttagccaggctggtcttgaactcctgacctcaagtgatccacctgcctcggcctcccaaagtgctgagattacaggcatgagccaccgtgcctggccttataaagttcctcctatattatacgtgcccatacctctatactagtttttctctcttaaagctacattgccatctcttgtattatccgtgcatttgtcacctgccacttgtcccccatgcccctcctttctagcctgtggtttataacatgctgtaagtctggaaaccaaataatcatgtttattagacttgtatgtaaatcgaacctaatgctcctttcctttgttgttgttttccttgataatgtggtcttttaaaagagtaaaatttgaactaggatttatgaaatctaggtttaagtttgagttctttttctacttatgtgatcttattcgagtctcctgacttctttggataaagcccaaaacaccattttacaggtgagaaaactgacagagtgacgtatgagtagaacagaggagaaaaggaattgaaaattcaggtctgtcaaactgtaatacccaggttctttctgtttgataacaccgttttcaaatgttgagaatgactaaagaaagatatagaaatttgtaatgattaggtatttatacattctcaataatgaattttggtataaaaacatatttttttatctaactatatttttcatgcagtcatttcagtcagtatcaccatctaggtttcctctagggaccacatatcaatgactcttaaaatcactgttgtgcaaggtgagtgggaaaggaacaggatggtagagtttggattggggaacagactttgagcactgaacagcaggcagcattgctgttggcagagtaacggagaaggcgctgaggcttacccatgccatcatggcaaaaaatagcacggaaacagctggtgagctgtcagaatgatcttaaggaggaaatgtgaaatgtttctgcttggtgcattaatcgagagttatttggacagaactgaattgccaggggaggaacaagcaaggtggtaactcacccttccctgccctttcatctctctgtaatacggttctatgtcatgggcctccttcacatacacactcccccagttgtccattactcccaccctctccgtcttacccacacctagagatatgtgtgcacacatccaaagagataacagaaaaaaaatccatttgaaatgcttacagatatttcaagacaaaatttaaagagatattggacagattagcaattatgacttttttaaacttttattttaggttcatgtgaagttttgatatataggtaaactcatgtcaccgggctttgctctacagatattttatcacctgtgtatgtaagccttgtacccaatagttatttttttctgctcctctccttcctcctaccctctaccctcaagtagacctcagtgtctgttgttcctttctttgtgttgatgagttctctagaaatctttgtgattagttgtagttgagtactaatgtggctttgttttttttttcatggagttgtttaaatatgtgtcctgattaatttttgttaactgttatactaagacttttcaccatcaatgaattcagtgaagggttgaagggaagaagtgcaggaaaggagaacacacaaatgagaatgtcagtcttgactgctgggtgaactttttttcgctgtagaagatgaaacaaattgagggccaacctcttgaatcaaattgcaaagtaactttctgctgggaacagtttgagtaacccgaagtagctaaggtcataaatatttttacaggtggctaaggaaagagcatttgcagccatggaatcaggtgttgttattttgggtgtgaccttgaatagaggctgctaacttttggcttctgtttccgataataaatctccctcctccccacccccaccatcagccccaaggaaagatgaatgactcaggtgcttcagagacttcccaagaagtggtttcagtatatgcagcaagtggacatttagaatggcacagttatccatataggaatattgttgaggcagttcatcttgttgtccctatagtgtaattctttggagtagaaagcaaagagcaataatttgtccaataaatgaaataaggaaatgaagagaaaatttacataagccagggaggccaacttaattttctaaagtagtgaattgactttttttccttggattttgaaataaatggcaataaatccagttgtggggtagagttctttgctttcagtgatagcttaggaacattctgcagattgttaggattgcttgtatgtggttttaaatgaatgaagctgtttctatacagctattttcagaaattctatgatctaaatgttttagattcaggcaaataaatacatatctatattgggagataaggtttttgctcaaacaagcaatgagtagttttcccattcctaatgtccacactatcttgaccactaccaagaaacactttttgcaccatgatgtgcaaaccatgtatttcttatcatcttgatgctgttgctcattttgcttaagttttaaagatttggcctttctctttttatgttgattaccaagagtgtctttgcaaagtcctttatgcagtactcaaagtatgtccatgccatttagctcctataaagaaaacaagtttttagccttcctaggaaattaagtttcctacaaaatatatgctcttcaaaagctctctcggcttcatttcaagcatggaaagcttgctggtgacttttgttctacttgatacggcatatccattcttgagtgaggctgagtacaaacagcattatcctgatgtaaaggaaacaaaaataattctaaccactaattaactaacagcaaagagactgatagtcttaaatggaaagaatacttccatggtctagtttctagagaacactaccaggggcttgaaggtaagtagcctctactggaggctaagggaagctaaacacttaagttttcttctatattatcagttgctgtttagaataaattataatctccacgtttttttttgagacagagtctcgctctgtctcccaggctggagtgcagtggtacaatctcggctcactgtaacctccgcctcctgggttcaagcgattctcctgcctcagcctcctgagtaactgggattacaggcgcacagcacctcgcctggctaattcttctgtatttttagtagagattgagtttcaccatgttggtcaggctaatctggaaatcctgacctcgtgatttgcccacctcagcctcccaaagtgctgggattacaggcatgagccaccgcgctcggcctcttctttactatagagtaaaagttgcatggtcgttttcttgcatttgggtcacagcttcagaaggttattaccaatcagaaaaaggttttgagtcttttatttcctaaaactgagtgtattcgttattgtctaatgacacagcataacaaaccactgaaattcagtggcttatcataccaaatatttacgcccatgtttacaggcctgcaggttgactgaaatttggcttgtctccgctgggctcagcatgttggctctcctttggactgcaggtcagctaggattggctccaggctgggattaggttcagatatgctccatgcatgtttttttctggggctcaaactgaagggacagtgtctatccagggcttagtctttcatggtacatttctgcagcacacaaaggctccctccaaatgcagcaattccttcctcagcggtagtagtccagacagaaacagttttggtggttgcttgagttctcccagttgttctcctgtcattttgcaggtcaatctgcttcattataggaacattctactggagaaaaaagtctatcattattcaaaatatccctccttatgcatacttcccactgcttagatgtctatactcagaaaagttactatgtggtttttctttatgggacaatactgcgtgatcgtggcgttcacatttctccctccaagtccttgcttttctagtttctgtaatcattcctcaggtgacataaaagtattttccgaagttttgccattttcatcacacaatattgtggacaaattaaagcctattgatgactttattaaagcagggtatttaccacaaattaggattctctgcattttgcctgactcctgcagagcacagagaccattcttgtctccaatagcaacactcttctattaatcaatcaagagctgacatgaatgtttttatagagattctgttccacttagcgatcctattgaacccctggccatgtggtatccccacagctcttcttctgaaatcccattttgaccaagccatccaaattatacacttagactgtaattgtttcttttccataaatgaatttacattcatcttaattcacattcgttgagattttttctctgtttccaagtctcttcacagcatttgtattctgtcattcaatacatttcctccaatacatcatatcacattcatatgcaatatgaatgaacttgtaacaatatctctctttttttttaattcaagccactgatacaaatattgaccaggtaggttgtaaaggacatggttctgtggccagccctgcaagatctccttatctgtttgtttagtacaccatgtatataatgtgtaagcctgcctcagttttcttcatggtggcctcagagatatcactgaagacctatctgatgctttgctgtgatttttattccctgttcacgccattctcctgatttcctgtatagtaactatattctcaagaagatgagattagtttgatgtgactattctttgtgaagctgtactagctaattgcatttcctcttagtttctaaaacccagaggtcccaaagtcaaatgctttgcagccaggcaagtaacaaatgtctgggtcagaagctgggtattattcgtcatttcatgaacagaaatatatatcctctgagtagaagactctgccagcagaacaaaattcttctgttagctaatttcactagccatcatatgatttagcttctgaagcagcttgctgctctgttattcgtgtgaactcatatcctttctcatttggaaagtcaagaccacatgggtacacctcttatcacaagcttcgtagagaccacaaagatgccactttagtcccaactcactaaatctcctctacaatgtctctaaaaattatccaatagtgttttttaaaatatatatcaaattatgctatctcaccacatcacagtatagctgctactattcctcctgtcttcctgtctcagaggaaaaatttgcttatcaccttccacagttgagtctacctaggtccttggcctcctgcccttttatcttttctgagatctcatgccatctgttacctcatctctattttatctgttataattcctctcctctgcttcttccccagctgctcagaacatactgaaatatatgtaagattttgggttttttttctggtcattttgctcaatgacttcctaataccaactgaagagagtttatatttcttaatacaacattgaaagcctaacatgatttggcctcaacctacctttttttatccagtaaaattcatttctctctaatgtatactatattccatccaaactaacccactgattagacttcatttttcttttaattactgctttttgctgtgctggtcccactgcttagaatgttatttcctcaaccttatttctgtttcctacatttgttgaaatcctagatgtccttcagaacccagcctctgagtcacctcttgcaggaagccttccttgctttccctagcagaacaacaatttctactgaaaccctgttgaattttgtctccattattgcctttaccaccttctatgttttgacagctattttgactatgtcttatctacccaattgtaaacttaatgaatacccacactgtatcctatttatctttatatctttagattgcaacacaattctttgcacatagtgtgtgccaaaaaatctctattgattgatggtgcaattctgatatttattaataatgatcaatctaagtatttatccaaatcaacccaatgccctatattttgggacaattacccttgagatttttataaaccaaattcaccccatgtaaaacagatgaaattaaccttaatttttatctgatgtgtaatggctaattggctaaatttctttcataaatattacatatgtactattttttatctctataagtattctagtttgtctagatgaagaaacagaggctaaaaatagttaaacaaaaaattacctgtttcagagcttgaaagccagatctgtccatggaaatctcctgagagaagaaggtttggggatgcatataatgagagcagagaactggataaagagatgtctggatctatttttggctgttgtttagatttactttgtgactgaaggaagtttatctgaggctttcccatttgtaaaactgagattcatatacaactgtgcaaaatatgtgtccctttacttacctccctctaagagattaatgagatgatactcaagaagcactttgattttctctgatgaaagaaatggataagtatgaaatgaagcatttactacttctatcgaaggtttttaagatggcagcctttaaaaattatcaaagtgaaagctaaaggaagaaacagccgtgtacattttaaatcaagtcaataattattgtagtgcacctaatgattctctgatatgtgttttgtgcattaaaatttaccaagcacttttacatatattatctcatttgatccacaaaactatcctgtgaagtatgtaggctaggtggtttcattaccatttttgaaataagaaaactaatactcaggccaaatgacttggtcactgctgctcgactcatgtgaaacagtccagggttaaactcaagtttcctggattccaaatcccaattcaggtatcttgcatttctgtccacttgttaacatcatagcatgcacattggaccatctcctctgtgttcacttacattctatccatgttcaggattgagtttaaatcccatttctgctcttaagacttcccttatcactttaactgaaaggcagactttcttattccatattttttttgtccttaaatatattgtttcctggaggtctttctagtgagttggatttcctgtattccattcttccttaaaataagcctttggaattcagcccagcttccacacttcttgatagctgccaccatccatttcattcctgggactgagcctcagcacaaggattatttaaaagttaaaaatagttgtattcataatcccagcattttgggaggccgaggtaggtagatcacctgaggtcaggagttcgagaccagcctggccaacatggtgaaaccccatctctactaaaaatacaaaaatcagccgggtgtggtggcagacacctgtaatcccagctactcgggaggctaaggcaggagaatcactagaattcaggaggcaggggttgcagtgagttgagatgcgccactgcactccagcttgggtgacagaatgagactctgtctcaaaaaaaaaaaaaaaagtttttttcgtgtcggtattaatgcctggtataatacctcgcacacagaaggtgttccatatatgcctgctaaagaagtggctagactaatcaacaattatggatgggagggaaggttcagaaagtttggtgacaatactgggaaaaaatgttggcacctgataatggtggacctgggataccaggctgaagagtttgaaacttgcccttttggcaacaacagatttattggcaccaaggaatagttttgctggattccacttttgaactcatcaaattccttgcttttcttttccttgtcttttcaatcctactgggacctcctcccaccagtgccactttactggaggcttgtgatatgtatgacaggcagtaaaacccaagtgaatcaaggaagcctgttaagagcactgatttctatgatgtctcagtttgttaactaaattgcaggttgtactgcttggccagagacagctgacaggcaactctgcctgaacaagtagcatctccaaaatgacatgtgcactttagtttcattagaggcagtggtatcatgattgcctgggccattgcaataaatatggtgatcatatgtatcccttgggatttggggttgacagcatagttgggctgcactaaagagtcttactctgacataaatgacggcaaagtagatctctgggcccctcagcaaggaggcagaagttcatgttgcaaagaaagttccacgggcctactgaaatattaccaatcaaaattacaatttcatttattgacaagtcatatttaacattcttctaatgttttttctcacatgccaatgtccaaaaagctaaaccatcagctgcatgatgctaaggctttcagcagtcagcagaagcagtggtagttgcgagctggttattcagaggcagctactgtgctccacataaccataaagtgaacattttgacattcccgaaaatgtaccaacctccaagtcacaaatcctctgtagatgcctgtggattggcttttcagatcctcttaaaagccaatctgtggtggcaggattgtctgaagagggtagacttgggcttctggtacgttacagaaggcatggtttctccatctacactatgctataagacaactgctcttctctgaaaagaaactactggaatcacacttcttgtaacttctctctattcccttatttagttggtgggattggatgaaggatcttcacatgtctagtgagactcctttcttctcttcttcctatccaaagggcttttcttcctgggctgagtgtatccaggcctatttcatctttgtaggaggcaaagggaaagagaagagaactagaaattggtgtaggcagactgatctgtggccaggtctaagtgttgccccaatccgttctcccatccaactccacaagcagtaaagtttgctggtcctttcatctatgtctatttctcaattggcttggatttcacaatgaagagggctatgatttattggcccacttaaacctcaacatggtagagtggcaattttgtttttctggctcttatattgcaatgaatattttttatttgacagtctgttataaacgaaaataatttttttcactatcagtttctactcaaaattaaatggtagctctagaatagtggcctgcattaaatttttctttatggttatagccatgcagatagatgcatgaactcagaggactaaaaatgtgtttccatgtaatttaaatgtacctttctatacggaacggtctgctgtcatgcaactttcaaataatgcattttattatcattatcttttccggcattgattaatcctactgtttattggctaagtgtacatttcctattggtatgtttctgagtcaaggtgaaagcagttaatacttaagagttgagaagcaagtttatttaaatctagtctttcttatgagtctgcctaacagtgatagattttgttgttgagccacagtttatgaaaagtgcattaaaacctcgagccgacccatctctctgaagcagcagttgggccattacattttggcaggcacttcagatgtgtgtatgattttatgatcaggtctgcttaattcatcccaactcttcaaagaggaagggaactaaaattccttgagcatcttctagtatgtgctagatgcctgcatatgttgttttatcctcatgacaatctctcatggtagatagtattttttcagcattgaaggtgagaaaattgaggttcagagagtttaaataatattgtcaaaaacatataggaagtgatgaagttaagctttaaggccaggcctgtctactcaaaagcctgtgattgttatattaagggttaaaaaaacaaaaaagtttgcaagagacagacaagttatttgaacggaatgaagtataagaaaacctgtgctttccttaatttttcttgaatcctgtggccttctcagtctatcctttattgaggttcagagaggttgctacttatatggtagcaaaagtatttcccttccctacttaccctactatacaaaacaaacaaacaaacaaacaaacaaaaaacagaaaacttgatgataaatgtcaatcaacactcagcctctgcatctgatgagcaacagaaattagcggggactgtggtgaattggaaaacctgtgcctttctctcccaatcagctctggctgattgtcctacagaaaatgttggctctgtgttactaaatcttaccattttttaaaagaacagtctagctgttcacgagagatctgatcttaaaatgttgaaaactaattcacatagaaaaatactatgtagtacccacccctcaaaaataaaacttatgtgagcactcgatccagcataaagtctctgaatttgtaagttctgtattacacaaggcagctaataagtaactactgggaaaaataattaacaaacaaaaatcaaatcaaaataattttcattactcttccaataattgtgccttccagatttagtactgtttgtgtattgtgcctctctgtggtagaggcatgacttctggtcctctatctgcccttcacagagtggagatgaggccagtatgcaatgactactcaagttttagatgttctgagcacttgtttctgtgctttctctggatagatctggtagtttggtgagcagagttggcgtggctcatcagcagtcaccctttggcaatggaaccagaaaagcatcatgctgtctgttaaagaatgtgtctatgcttgtagctagtttcctaagatgtttgcctctaggtatttgcctgcagaaagttttttgaagtcaatacaaagtagagtggcaagcgatgcatccatgtttgaggatttgggaagcatttttctgtattctttcaagtaaggcctggtcgataagtttagccacactcaatctaattccttgtctgtatccttattatctcccctcctcttctttaagttttcacttccttctgaccttaatcactccctcaatgaacccataagtatcactgaacatgggtgtcaccagttagcaacagtaagataaccgctaacttctgaaacatggaagctctagcattgcttggatgatgtcttccctgactgcctgtgagcctctggccaggatccggggtaagtgcctcacaaatcactgttcatctaaacagctaaagctcttctcctgatggaagagggatacctacagcagaaagcaagggagtccaccaggcacgtttggaaaataaaagattttatttatatttattttgactctatagtttctaaattccataaatgaaattttgccattatcaaggaaatatttgctagggagtataaggaaggccctttgggtaagagagaagatattctctaagctgtagcatgtttatgaaccttaaaaattacttgtctgtgtttgtatatgttcagctctgagagtcttccttaacattcaaatgtctctgtcttggcaaaaattagtgaggttttagaaagtagaaaagctggttgatagtgtaaggaatttttaggccaattttctattttttccttctatagactgaattttatttttataccaatagtttcaatcttctaaacttctcccattcctctttactttctcaactgcatccacttaaatacatcttattgtttcagtcagccttggctgctataacagaatggcatagattgggtgacttaaaaacaacaaatatttattgctccccattctggagactaggaagtccaaggtcaaggtgccagtcaatttggtttctgctgagggtccatttcccgactgacagatggccaccttcttgctgtatctttacatggaggagagagaaatcatgcctaatgtcttttctatctccgggcaggtagtgcaggaattgaacttggttggaggacatccagctggtgtctgctgcagattgcttgcttgcttgcttgcttgcttgatgtgtggggaaaaacctccacacatctagcgtcagaagcgtgttgtgagagtataggagaaactgagtttgttttttctacacagaagaatttcctatcctgaaggccaggtaatgaatcctctttctctggttacttgggcaatttatcaatgactgtctgtggatatttatttggaaatattatatgggaacgttccttcattttttatatctcaatttaggaaaccatgtgcttctttctcatttctcttttgtccccatcagcgatctatatttttttaaattgttattagaaacatctcttatttaatctccatcatcacccaacaagctcagcaatgtgactttgtcttacggatgaggaaactgggtgcagagtatttgtggctttccccaaaacctgcagtaagtgaacaactagaattatatccaagccttctgattcaaatgcagttgccctatgcaccacaccaaagtatcgtttacactcttgagggctaaagaatgccagatgtatttatctaacttctgatgtgcctcccaaaatgccctatacagaggataggatcaatacacacttgatttcaaaatttctatgacttgattctacttacacatcttattgatttggagaaataaaggtacttcttgggggaaaacatgactacatgttaaaattctgaatttggcaagtctagtgcaaactgaaatggatggtggttgaagtacagccaactcatggtggtccaaaagactgtggtgaggggatggcctcccaagaggcagggattgagccctacactgaccagaaatcactgcattacagaataatggagaaggcaagacaatgaaactgagtttctctgaaagcttggcatcttggatatttcaaagattaaagttgtatttaatgggaatcacgtggttcaattaactggtaataggatggatcagtgtccacctctaggacttcaatttgagtctaatccaaacacagaagcagagtaggttgaagcccttggtaatgaacactaagcctttcacctcccggtccacagagaaagttcctctcaggccacagaggcctgctggcaattttcctgaagacagtttggtagactatgtgaaacaagtgaacagctatggtcacctgagaggtagtggtactctacattttcaaaagttctctcccaaagcaaaaccatagcaaaaattgaaaagcagtaaatgaaccatggatggagatattgcactatgcacttgtcttgctagcagaagaatgcaaaggtgctttcaccattgtgtcagatgcttggctgaacatttattaaacttttgatatggaggaagacatagaacataaagatgcattttcttccctcacaatgctcatggtgtgacaggaaaaaaaaagaattgttccattaaaaaaacattgaaatgaatcaacacaaactgatgttattattgaatagataatggagagattgtgggataattagagaataaatctggttatcaaagatgtctctggaaggcacgtgtgtaaagttgttttcagctctgtacacctgtgcacactggccaggaaagctggaccttctgcagagaaaactgtcttctccagataggaaagtgtgcctcattgagctttgggctaggccagagctagaagatctttcctgtgtttgggtcattcctagatcagtgatccctaatgaccagttccattccctaaagctaatgttgactctagatctttctgacatttgattcatgctggaatccatagtttgttttgagtcaggtctataatagattcatattcctgagaggcttcctattgaaagtgaagactcaggattccactgactgttctgccactgtttaaggacgatattacagttggattatagatgacctccagtggacacagaggtgcttagattctactgagccaccattactttgcctaaaagaaaataagagggtcaaagggactaacttttgtgtaagttttaaggttttattcaaacacaaacacacacaatcacacacacatttacatggcaacatatctacaaataactatttctctagcattatgttcctcagcctcttgaatgacatcatttaccttcgtcatgttaatgaacaaaattgtagctcactcataaagaagagagagaagaatgtttgtgccctttaaatgtcaaaaaataaatgcttcttcatattgtgtatgagttcactataaactcatggataatttgtgtatctgaagctctgaccggcttccagagggcttacagtgcctgccatatcttaggggaacaatgacctcatgctgttccagggacatttctatttctccatttggctgaaacttactcactttatactttggtagggatactgaattcaagtaaattaaaattaggagatgtgttctctaattattctatcgaaagagcacatagctttgaaataattctcaatgctagtatggtggactcttttcaaaaggtatgagtcagctccctgtgacatgttttccagtgtctgcttggggtcacctttactaatttcatcaggactgagggaaagcactttccttttcatatttctgcttgggtgtccagatcattctcccctacagaggctttgatgctgtcatggaggtcatagggccggccttttttcgaagtactggagctttttaaatttcactttttaaaaaatttttgttgcttttattatggtggttgggggtaagtaaggacccaccttttgaattagaattactgatcttatccaagagagaatgttgtagtgggtgatagttgacgaagaagagaaccataaaatatcacctggatgaaagacctaactgcagcactatctccaggacacacacacacacaccagagtccccacgtgcagacaggcactgctgatatattacagtctgttggccattttgtttatgataactaggaaaggaaaaatgagcccttatttcagtgtgttcatcccaagatgatgacacagtagattccccttgcaggtaaaccgagagagctcagttaatcaccatttatcactcaagtgactcaagtattttgcagatgcattggagccctggagactgagatattcattgggctgcaatgctattctcttttctcattccatctaatataataaaataaactcaaatcctaacatcagagtgatgtgtgctatcttttagagtcccaagcctttaaaatgtatttgattcactcccatagaactagatacattttccaaacgaaatgtgatatcattacaattttaatgacttataactttgctccatctcctccattaccagactattcctagctactaccatcttttgccagaagcctctaatttatttctctgcatctgcagctgacctccttcaaacagtgttattttgagttgattttagtatataaaccactctcagtgggatctaagatagattagtttatgcctaattgagtgagcttttgtagatcctcttattttatataacttattagaaaatatctaagatatattgttctatttgccaaataataattgtgaatcaggttcattgtacactggttaccaatatgcctgagcctagtgagagagaacacccccacacacaagtcacatataggcagtaaaggacagcagaagctggggaatcattttgagctcattctccaaggctcaggaaagctgcctatggcaaatggaatccacctgtgcacgtactgcacctaagggaccttggaaagtaccccactctgggttttataccccaggggcaatatgactcaataagctgaagtgttgaaggacatcctgttctggtaggaagtggaacagagacttggctattccagccagttcctccttatctgagaatgttacatttctggtatattctttagttatttttgagaactacaagtgagaaaagaacacaaaccaggttggtccgaggctacctagagaactttcttccaataggtgaatgagcaggtatgttacaggttcctcatttgatcctctcaccctatttgagttattctgaccacttgtacatcaactattgattaaaatctgaaaaaagaaaatcataggtgaccttaaattaaacttaaattaaacttaaaaaaaaaaacttaaaaaaaattaaacttaaaaaaagttccacaacgaacaggggtcagcaactttttctgtaaagggccagaaagtaaatattttaggcttgtaggccacatgatctctgttgcagctactcatgtctgctgttgtagcatggaagcagccaaagataataatacatcaatgaatgagtccagccgtgtcccaataaaactttatttataaaaacagggaacaattatatttggcacacagtttgctgatctctgctctaggccaatctatctcctccaacttttgcatattcatacctcaaacatatcataaaaaactgccacaatctaaaccgtattatctgatgaccctaagtactaaatctctccattctgaaatgtgtatattaattttttttcaggtagagaatggtatagaatttagacagggaatttatctgagggattgactgaaaatgccttacttatgaaaaaagagttcttggttggtgtttattattcatgtaggtccatttaccttgaagccataatgctaatatagcctgtcatttggaagttagataaatagtaaagcactttaaagaatcactaaaagtttcctcacaaccacagaataggtcttggagggttactcacgctttgctgatctctcatttatagaggagcagctgctcatttttggcctagaatatccacctctaagagaagaaatttctcctttgcatcctgttcagagctgatcatgcatattcttggaaactgactaaaatgacctagtctgtagtaaagtaactaatttagagttgggactatcaactaatgttattttgccagaggagatgaatgaaaagacttccttagggactagcagcaatcagtcagtagggaacagggttaccaagaccagatggagaaaatggcataggacatgtgtattagacctgccactttctggctctgtgagcatgcatttcaaagtttatacctgcaaagtgggcatttgacagagtaggggacagtcggagagcttatcgatacatacttattgctctccttgtgttctgtttgctggaacacaattttagatcaaatatttaaaaattcacacgtgcgtgctcatggctgtgcactcatgtgcatgtgtgcctgttgtgtgcgtgcatatataccatacagaaaagtactgtctggagaatacattagactatgcatgtaaatgtgtgtagaatgtttttcttttttttcatgcaatacatgctctatggatatttgttaagtgactgaagttttgcactccctggtgcagtttctcaatagtggcactattgatattagagccagctatttctttgttgtgtatcattgtatatttagcagcatgcgtggcctcgacccactagattctagaagcactccacttcagttgtgacagccaaaaatgtctccagacattgccaaatgtccctggagataagcatccctgttgaaatcactgccttagtgaaccaagacattaatgtaagaaagtggttcctaaactttagcatctgaatcaatcaccttaagttcttgtgaaaatacatgttactgggcctcacactagagtttctgattcagagggtcttgcactagcactagacccaacaatttacatgtctaatgagtccgctggtgatactgctgctgggggtcttagaacctcactttgtaagcacataagtaaggtgtaagatgttctggaaaaattccagatgagttaaaatgtgtttcctcatttcaaggactgtaatgtttgttgttagtgtgagcacagggcttaaggtttctttatgaagaccgctgggtggttcctcacagctgtggttgagatttagcggggaaaccggacgtttatgggagacgttcagtctgtactggattttagtcagcactgccctgccagctgtcacctgagtcctgccaggagactgctccaggtcttggcacagggctggggcacctatggaaatgaacttgaagtttgccttgcagtcaaacttaactaccaaataaaccagcatgacattggggtctgtgaatgagaagtggatgttccgagtagatttgaaggacgtgatgactcaggatgccagttgtgactggtgacttagagccgtggtagctttgacttgcatcttatttacttgcatcggctgtcttgtccttccttgcttctcgccttttcaggtcatggttcctgatgtcctaagctgtcatccctactctctctctctcttttttttttttttttgcttggagtcagagatggagctgtctcgagctatttatcagtcttatctctctgcgccctctgttagcatttcagactgtggatctaatccactttaattgattgacctcgtgcaaccagacatcagtaaaacaccaggtgaagcacaactgcagccaggggagaggtggatgtaactttcctggttgggtgcaaagttcgctgaggcctataaagatttagaaaaggagaaatagttttcaagccatttaatatgaattttctagggacaatgtatacagatcccagagtcgatgaccttgactgggagacagtcgttgtaaatagagcagtatcctatagggagtgtgcaaatgcctctgactcacctgtcatccatattagtactatttctcagctagcatcactattatcaccatctccaaacccatcattaacatatttttacatcattgtttgtagataccttcagaatttgccaagattttatttatttctcttaataagtactatttaacacaagtattactgttgctcttgtcttcgttatcgtttttctagacaaagcttgagccatggatagttgagggacctgctcaagatcacatggaaaaaataatgtggagcctcaatcagtcccaattcttttgattctaaatctcaaattcttctagaacacaaagtagacattttcctctcccctgcttttcctgccacagccacacttcagcttctcaaggggaggggactgggtcattgtcatgaggtgatcatggactttgaaagatcttcaagctctacagccgtggtcttgtcagtttgggtgatttctgaaaggcatcttctctgatttagatttttcaacggagagacctggtctcttacctctcttgaaataccttaataatgaagtgcttactctgtgcttataaaccaacaactgtccagagtgtagaacaagaagaccataatgttgaaagagtagagactaatgatcttcactgaaagacacttaatagccacaaaaagagcgcaaattatgttctactgagttcaatgttttattctaaagaactgcagtaaaagcctctgttagtcaaagtcaaaattgatcaatcaggtaagctgtaactcatctttttgtattttacagatgcatttataaagcatagtgagatgttttgcctaagatttattgcacgaaatttgaatatggtagcaataatttattttatcctataatactgaaatcatatttggtctcttatggtacaaaaaagattcttctaatttttttaaaatcacaaccacacattctaattcatcatttattcatttccatatccattaatttaacaaacatttactgagctcatgttaggatacttacatttaaaatactcacaattaggctaagtggacagataagttaggcctacataaaatatgtaatatgtaacacatgtatttctgttatagaaataactcaattataacatgtaaaagctgtgattgtcgaaaatgcatggattttagagtcagacctggattctatttttccataagtctcttattgtgtgaattctcttgtaattaattgtaagaatttgaatatacttctattataaaaatatttactgagcacctattctgtccatttaggtagcctggtttatgttgcagtgacaaaagcctcaaacacttggtgctataaagcaaccaagctttgtttctcagccatctgcatgtccgtagcaagttggcttattgccatcctcactcaatgacccggaatgacaaagaagccgctaccaggagtttgctgggtgcagtggttgacaacaaatgagagaactctcgtgggtctcacaccagcaactaaatgcatggctcaggaatgatactcaatttatcagttaacactgttctcttggcccaacccatcacaacgagacccaaaagtcctctcttactacaaccctataatggaggagaactaggaaagtgtggtaaacagtgccgctcattattttctttactaggaaccagactttgaaatgggtatggaagaccttgctgtgcctggcccacaagaggcattatttacatattgccttccttgtgttcttgcctagcactgaactaacaaattctgtgggaagcctagcagttaagacactgagacctgcttccattgcccatatccctggcatacatttgaaaatcccagttctgtttctctcagctgcaattttctaaaatagcggatgatgcattccgtcttccccaggggcagtctggaatgaacgaagagatagccttcagtgacatctttattcctgagaattcttcttgcccctgagcatttctgctcctggagtctgaccctggtgtcggtagcatctcttaggtcagcaccaataactgcagtgtgactgattgaggatagggcagctgaagctggactaatttggggagccaggtgggcttataaacagtcattattgatgaagagtgacttactggctatttaaagacagctggtttctgtgctgttcagttttttttttttcctgaatgcacttgaggattctttggtaatgtcttctgatttaccacttgtttttgtttttaatatcaaggaagaatatagattgaagcaattgtcttggtagcaactttagtggtgatggctgtggagttattaaaatttatagtcatgctgtttttgcagctacactttgcatttcttagagaggcttataatatctggttacaaagaatgtagagagatagcaactaccaaattgggataggaaatcaaccctgcataaattgttttaatatatattctgtttgctaaaatttacatttattttcacaatatgtcttgatgacagtgcccaccaagccaactagcccttagctcatgacactactttcagttacactaatgaggagaaagaagggagaaagaagactgacattttgtgggtccaaaattatccacagtgaatgccaggtgcttcacatgtctgtgctctcctataaccctcacagcaagcttcagaggtaacaactggcccctctttccctccacacatctctttatgaaagagaaatcagaagtaaaataaccagaccagggtcatacagctttaagagccatcgctgttatttgaaccatgctaggctaaaacccacatttattctattgaaacagtttctccaaaaatcagagtgttttatatctgatcaaatgatgggtggttccttctcctgatctgttttatctcatatatttatgtaatgttttattacttataaagtaccatcatgttcatcatattatatcatccttacaacagccctatgaagtacgaaatgctgatatcctgtccttatagtgtattatcaagaagtggcttcagaaaaatcaagtaatttgcccaaggtcagtcaggtctgacaccaaagccaatgcttttgttccctcacatcttctcttttctagacacatgagccagcggagttgatttgcatggcagctgtgcatgatagtttcaagcctgggcaactctatgggtattcgccacaaggcttccgtgacttctaatgaactgaaacaaagcagttagccatggattataatgccaccgtggtcccatgacaaatgacaaggaggttgcagtaatgaaattttattactgcaaatagagaccacatctgagatctagcacggccacatttaccattgtgggaaacaaaatgaaacacctgggaaaggatctccactgactttagcagtgagctaacaggattaagaagatctcccagaaacactgattacaatggcaaatgtgtggcacctaagataaggaccaaatatttattctggcagagattaaatcttttcttttcctgaatcaaatatggatcttgcagaaaatctgcccaagaatatatcttgctgatcagcgaactcactgagccagaaccgtacttggccactgctgtcactgaaaagctacagaatgctgctttaaaggtctccatgcttcccctaaaactgttttccatccatgattaattagtgacttaggggtgaattgaatcaccagctgtcctttccatgcatccaggatttatgtactggtttctcattgaagaacagtggtgcaataaacagccctcatttgtggggtgggcagaggagtaatggtgtctgcagtcatggtttcttaactcctctagtacttccattctgctaagcaggttatggctcacattattacagcctagcttatttaggcatgagggtcgtgggcagtgacacacacacacccttagaaatgaataccagttctttaagagaaagcagaaaagtcatattaccatttctgaattccttgagaaataagaagaataaaatggacaataatattagctatgggcatgaaaagtacaaaaagaacccataatcaggttcatttatatatgcatgcatattttaaagctaggtgcttttcctagtgcagagatgtagatagcggtttcaacaaacagatttacgaaatcatgagtgtgtttagtcacaattttgggaggtacctggaactcttttcccagagaacagaacatggggattgcagacatcattttatattgcatattatgtaatcagggcacaaaggaaatactgaggtccaccctgtatctctgcatccttgaatgctcacagcctgctttggttgatcattctatattcctcgcttctaagatcaagacttctgcatgacttgtccattcttttattggatacaagatgaactgacatactaagtgataaatggaaacttgaggaaagccttcattttgggaaaagaagtgaagtgtaccaaactatatatagaaaccagtgtccctccctccagaactcttaatttgttgactttaggtgtagtaggtgcttaataaattttgtatttgtgtatttaatgaatacatgaatgaataaaacaaatgactaaatctgagatttagaaaaactcttttctatatcttgatttatatggattctggacttttctcacattcttctttttcttttcctccttctggttttcctccttctcttccttttacttcttcttgaataaaaaaataatagaagataacaaaggatcgtgaactagtactgtgactcagtcttgtagaatgtcagaattactactgatatggtttggctgtgttcccacgcaaatctcatcttgaattatagttcccataatcccaacgtgttgtgggagggagccagtgggaggtaattggctcatgtgagcagttacctccatgttgttctcatgatagtgagtgagttctcatgatatctgatggttttatgagggggttttcctcttttgcctggcacttctccttcctgctgccacgtgaagaaggatgtgtttgctttccaggcccccacagccatgctgaactgtgagtcaattaaacctcttttgttcataaattacccagtctcaggtgtgtctttactcacagaatggaaaggactaatacaactactaaattttattatccttgaatgcccaacatattgccagtaatttggaaaactaaagaaattgagcaagatgtctcccttctgtccttacacatgcctccaacaccctgcaatgctatgtctttccaagagcttaagagaggctgattatatttgaatagtaaggttacatttatttcatgtctcattgtgactactagttccaacttttagtcataaccaattattagagaagagtcagagttttaatagcattattatgtatgctttgtgttttagtgcacttcccaggaggttggtgatatcaccaccagcatcaccatttgcatcattattatctgtattagtccatcctcacattgctataaagaaatacctgagaatgagtgatttataaagaaaagagtttttaattggctcacagttctgcaggatgtataggaagcatagcagcatctgcttctggggagccctcaggaagcttccaatcatggcaaataggggaggaagagtctcacatgacaggagcaggaacaagagagacacagggaagatgccacacactttaaacaaccagatctcataagaactcactcactatcacgagaacaggaccaagggaatggtactaaaacgttcatgagaaattgtccccatgatccaatcacctcccaccaggccccatctccaacactggagattacaactgaacaggagatttgggtggggacacatccacaccatatcaccgtcttcactgccatagtgttactcttatctaattcattgcaatttcccttctgacaagtctttgatggccacagaggttctcttctgctgtgttgcataagctctggtcttgaatatatctctctttggattaatctgaggagtagggctacaagttgggaagcatggcagccatctaatcatgaaaattctaggtgagtttcattggcctctactggggttaccttttctatgtggtttggaactgcagaaccattatgtgcatgtgtgtgtgtgtacgcgtgtgtgtgtgtgtgtgtatatttatatacacacacacatatatccagcccctctgacattggctcctaaccattctgtacacctctgctttgccttgatcgcatgaaaatatgctgagaagctcatatttccactttaattgtaaatctgaattgataaatgatttaaggtccagtgtcttggtgtactctcttagtaaacaggcctaattcatctcacagaaataaactttgcattgtcattgcatagctactaggtagttccaggcctgatttgccttgaggggaattgaatgatgtaacctgtgcggtgcagcctgtgagagcaatttgggtggtttttatgccattggtttttatgctcaggatgaaagctcatggagaaatgtagaatgctattattatcttatcttcatgctgacagctccctctgggcacctacaggtttattgctggttggaggatcaagtttaaagggagagaacttcgtggttggtgataactatgccttttgtgtttctttattataggaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggtacatgttgttcgctcaatggtcctactctttttgactctcccattctcacttttcagtggtgatttttctcatgactgtcaccaaattccagaacactgagtgaagtacacattcatgatttttttgtatgagaagataagtcatctctttaggacttgatccagtatagggagcttctggagactttaccaactatgcactggacactttttgtcaacctttgactgatacagcctgactggctcataccaaagacaattacggtagattttgcagggcctgtagatgaggagcagtgaagggaaggatcatctctatcatgagctagtgtcgataatcataagatgctccatttgagacccagactttgtggtgccatttagtcggatgcagttgaaggtgcagatgccagagagagactctaaaaggacaattactgaacttgaagacacagatcaagtcatggtaacaatgagagaaaaactaaggtggaattttattcgtttggtggactttgctagtttttattttctcacttaccctaagcctgcctggatattcaaaggttggtcctagtagtcattttaatagcaagcatgctggtgtggcaggaaaaggggttaatcatctgtttaaattttacagtcaagaaacattcagcaacaaattcccagagccagatggctgaatcaagcacaacgggagaaaaggttgccttccttaaaagagatcattcaaataatccctcagctttccctcttgcctctcacttctcccaggaaaagtcctgaatgctgatcgtaaaagtgccaggaatggaagggacaacccttcagcaaagggccattgttccacaattgcactgtcatctgatggatgcaagagaatagtgagaatattgcacttctcactaatgtgggcatgaagtgatgtgctactctctatcctacacaccaaactcctcacaattttctcaccacttttctctaacttcctttacagtgaggtgggcacaataacaaagaagcttgaagcacattttcacatgtctaagagccattagctaataatggttatgcttgtgagaaagatacaaagtgaatttgcctatttgtaggccaagactttgaatggcttgaaggctgttgtatctccacacctaactcagcattaattttctttaaaagcctatcagaagtatctgcgctgttgggttgttccctaactgctagagtcccgctatatctgtttaagaattgtaagagcatctggaaacagcatgcaagacccccaaggtattgaggcaaaaagctccacccactattgatttgccatctcggtttccataaaacagccagctcagccattgctaggggtctcagaatttcttagattaaggcacataaatgcccttatgaggttatctttgagtatttgaagaaagccaaagctattaacagcttctaggaatttttatcattcaaattcactacacactaatagacttaatttttaaatgcttcctgcttaatccctgatggatgggggagagggtgaaaggaataaaagcagtccagtatcttaaaagctgttcataggctcatagaaaaaaatcaatctctctctccatatgtgttatcattggccttgctagtgttgctgaagggtttgttgtgtttctgttaggaatttcaaagatttctaaattgatgttaaccacttgccttgagccaatatagaatctacaagtttgctgccagcaatgagcaggctctttaatggtcatttttaaagccacagctatgtaaccaaaccggagattcttgctgtgcgcctatcttttggtgtctttctttagttccaaattatgggttgcttcctatatgttttcaaaacagattaagcctttctttaatagcattgctccctcctgaaaactattattatcattggaaactgttatttagtaacgatatgtgttattatttcaggacagggtacagtatagcatttataagtatgggccttggagtcaactggctagagttgggatcttggtttcatcacctgtgagtctaaagaccttgaaatgtcctaagcattgaaatatttggtgcctctccccacatgtaattcaaaatacagtaacactgaaccataaaataagtgtaagaatttctaagagtttttatttttctcctctgatgatttctgtaatgctttcaaaatatattagattctttcttcccaaattctcattttgtactttctctgttttgttgttctttaagaagatgttcattcttctccctgagactgtttcctagtctagacaaccagggtaatgataatacctggttaatgtgaagattaagtgagttgaccacatgtataatgctgggacaattaagtcaatcctcaataaatgttagctgtgaggattaccaatcatttggctagcattttaaattaggacatatttttgagtacagatttcttcattttgaagatgaaataccctatcaattagacaaggtagatattttttattctccatttcaaataaaaacagagacccaaggaggtgctatgcccttcctaaggtcacatagcaagtgaaggaagacctaggacaagatttttctgtttccaattgggcagttttcactattgctcccccagagaattgggggatgttctgaaaaatgcatagctagaaatgagtatttttcttcttgtgtcatcttagatttctttctttaaagaagtgtcatatctcaaaggtcactttccaatgatcacacaaaagtggttattgtgaggtgttgagttcaaaatcctcatttaaaagttttattggcaccagtgaccccaagctgctctccttacaacaatggcaatgtgctcccatgaagcagctgaaagaatagtgagtatttaaaggagctatatccccttaccttgctgcctcaattaaaaagttgttgtgtgatatactagatcgaggtttatgttccactctgccaagacttcctaggagcggttcactttttgagccttggataccttattttctctcctctctgcttccctgtgctattaaaaggatcaatttaactattaataatttaaagtatcatgagaaaaatctggcaatgtttattttaaatcataagatcaaaattccccgtgtctgggccatcaaacaaagccatcaacctggcaaggcagtcttgacagtttctacaaaaatgtgtccttttgttttctaaagtcattctattttattattttatcaataacagtaggtttagaaatcatcaagggtttagtctcactactcacttattactaatgtttaaacagtaaagacatacagagtagctcctatagaagatttatgttaagttatctcacttggagaacatgctctcggggaattgttcctgcctacaaggtctgaatgagtcagctgtgcaccgggatgaatgggtcatctccacagtcttctcatgggcatttatggggctctactgaaacatcccaccgtgaaatatttagaacccagctgggcacagggcatgtagcactggctctttctttgtgaatcagggaagaaacagaatgaaaatagttctatagcaatcggaatcttatatcactaaattctgggaggtagaactgaaaagcaacttctttctttgaacctgaaaatagaaaagctaagaaacaggagagggaaataaaagaagaatcagcccagagctatcatccaggcactgacaaatgttccttataaagtctctgattgttgtccctatacaatgcggtggtaggaacaagggagggggggtgaaaggtgacttgagtatgaggaattaattttagccacagctctaggccccctggaaggctgagctgactgggtttgttccatatcttctctctgctgtgagtgggtggccggtgatactgtcactgctgtaagatccctgagcatggtccagtaaaggcttttcaggtcctatctaggcttcctgggacatgcagactgatacacagcttcaatctttgtatgtcagggggtgctgaggagagcagggcataccaactcagttcaagtgctcttcacagaattcctcttcttcagtctttaaaatgcacacggatgacctacatttaaatcctatttgaccacccaacttagaacgtgaaaaagaggtaaaagtagctccctttcaaggatgctacattagaaaactctctttatatttgagtttgtcaaattccacagaaacttgtctttataggggttggaagagaaaacattgctatggtacttataaaacattgctatagtacttattgatgaccaaaataccttcatatcggttattacatttgagcctcactccatcctgtgaaggacagggtttggtattattactcctgccatacccattttaaggttacgttatcaaggctctgaaaggctaaataactttcccagtgtcacacagcttaaggagcagagccaacacttttctatcctgatcctcagactgcacagcctcaaactttctgctcactttcctatttctcagagccacgattttattaataatgacagtatttctttttgtaaaaacatattctcaaatggaaatctctgcctggagtagtctagttagtaaggtttttcaacctattgacatttggggctggacacatctttgctgttggtgtgtaaggaagggggcggggtactgttttgcacattgcaggatgtttagcagcatccatgacttttaccccctggatgccactctcatgtttccacaagtgccaaataccctctggtcagcaaaatcacccccatataagagccgctgacttagagaaagtttccaacatattttgtttaaatgttcatcatgtttttgtaatttagacagtatacatcggtataagaaagattttttttttgtccacatctcttcctcaattattgagactttaaaggattaaaaacaagtctatgtacttgacatgatgctgaaatttctcaggccttgggttttcattaattcctagccaggaggtttactttccttttctttatgtcttttcctgcgaacatttgagaccttgccagatttgaagcatgcattaaaacaagccccatctacctgctcattcatccgttcaggactagcgttgctttcagttcaacagggggaaaaacagagagagcagagtcctgcagagggaataagaagtataaatacaatcaagaaggaaagccatatttgaacaaggtttcaggactacagacatataagggcaaccagagaaagcctcacttaatgaatgtgtttgaacattgtgaggaacattttaaaaccatcttataaagaaggtgctccaacattcagtcacaaaatgtatcaattaatcactcaaactagtgtatcttgaatattcacactgctaactagtcatcctttccaatttgtcagaaatgaattaggattcacatgtttgtgagtttctatttccaagggaattatttccacattatgcagtttgtcttcggttaacaaaaatgttttaaaagaatgttttcaataggcacttatatatacatatttgtgtaaagcaatggtctgcaacctggctgaaattgagaatcccctgggaagtttaataaattgccagtgctcgggcactggtctcagggcatctaatttaactgaactggggtgtggtccatggatcagcagcatcagcttcccctgggagcttgttaaaaatgcagactctcaggcaccaccccgtacctgcaaaatcagatcccccagtgctatgggtacattgtaaattgagaaacactggcccaggcatttttttgtttgttttttgttgtttttaaaaaaagctcctaaggtgattctctgtgtagctaagtttgacattcactgatatgtagaagctaaaaaatgtgtctttctttcagactgactaccggtactgttcaatgtggtagccgccaaccatatgttgctattgagcagtgtggctggtatgacggagattctgaaatttttgttttattatgtacttatgtcctaggcactgaaggctttaaatacatttctcattcagtcctcactccaacactatgaggctataggttagaggctagtattagccagtgcaggactacaatatgccatcttttatttccttttatgtgttttctaccatgtaaacgatgggcatttgccttcatgtaccttctgaactcatctaatgagttttgatattatacaatcacagggataataactccaccctatccaagcagctgttggagagtcattaaagggtgatgattaagcatgagggttttggagtcagactttctaggtgtaaccaagggcccctggccctgtcacttgccagcttgcccacaaccttgagaaggttcccgctgtcgagaagtttctctatgctttgatctccatgatcatatatatgcattttctcgcattaaaaccaagtgaatgctcagattgacattactataggacacttcacaaaaaaagaaagtactggctagaggtatgtttcctaaacacacatggcaaactaccctttcttaagctatatttgtatgctctgacagcatggctatggtgcaaatctatcaacaaacttgaccctaagaagccagttacatgacctataaaatggggattgtgttcattgttctgtcttagaaagtggaaagttctttgaataccttaaagcattgcatgaataataattgtacctgcaggtgtattgtctggattatctaccacccgtatacattttaggaccattttttatcttgactttctacaatgaagtttacttatgaaaggtgagaataggggactaagagattttccatcttgctttctcatccttcatggagaattccacaatagtagaaacggttccaaagtgagggacatgtgcactgaataaacactttctcccagaggtgtaggaagtggcagatggtgccattcaccgtctctcagccaaactcacccaggtggtgatggctgccatttgccgaacatttatgacatactccccacttcatgggcagcatcctacttagtcttgaaaccacccattaggacagcgttggtcttattcccatttttttagattaggaacagtctatgggagtgtagcttagtttgggaaatgctggtattcaacccagaaccatctgacttaagagtcttaatgtttaatcacactctgctccttccttagattctcgtaaacaccctagaacagttgcatatcctagaaattctgggtttaactcaaatcttgacaatttagaatttttctctcaagttaaattatagaattcccccctcaggttaaatctctgatttctgcccagtctagaagtcagcatttccttgggcatctatacatatttggctttatctatatcatcggtgtggcctctggaagccttgtcagcctctttctttttgcgatcttgttttaccttctagtgccatatctatgcaaaaagaaagaacttttaaatgaaggtttgttttgccatttaatagtcttgcttggggagtgacagagtggcaagaaggtgcttagtatttttttaatttaatttttgttttatcaaggaaacttcctttcttctctgtgaattcccagccacagataaacaggcttgtatcttataagttaaatacaattactgctatcaaacctagagcctttttctctctcccataaatgtctctaagaagctgataagcatttcaaggcaaactggagcttggactaatgctaaaattaaacataaccacccagaagacaaagagaccagatagaaatacataaaacatttgaggtggtgggaacacatggacacagggcacatagaaacttgcccccaaaacattaggttaatacatagctcaaggttatttataaaggaattaacatacacaaaggagctttttataattataaggatttacatcagataataacaattgtagtagccaaagatattatttatctagaattcacttgtgaacagggcatgcttttggtctacagggctgttgagcaaaagaataattttgctgcaaccctctgtaggactttataggatgcacatttacattttccccatttttagtagactatcttgggatttaaagaagaagttggaattttaaaaattagaaagcacatcatatttatttagccatatgttaaatgttataaatattatagtttagggactcagtaaaatgaataattaaaaatttgagggtcacttctaggtacaatgtaaccagggatgtaagataaagaatttcttgatttccaaccataatgcatctattttaattaaataatatctttcaagattagaaatacagtgtagtcacactttatgggatttttaaaattatacttatctgaaatagtgtgacataaataaaaatattaataacatctccctctatgtgaggcatcagtaataacatacattcttctgaattaaaacaatcatcaaatattgcataatttcaaagctggttagtgaattacaagttttgttttccctattgtcacatggaagctctagtttaagtagttaatacaaattctggcctgcagaagttgtctctaattacgaaaacttagaattattatcccagccataaaatacaattaccctgtaccgtttttcctctgccccagagctgcctgaacaccaagtgtcctaccacccatacaagagcatagttttatttatgggaaaagtttccaagttccagtctcttcaatttaaattttgcacaaggttgcagagtctctctagttatttaaagtctaaaaagaacactgagcttctttgagaaaggtggtacataaatatccaataataataatatatattcacatacagtatgtcatttatacttctataaagcagagaaggtaatgaaaggtgctctatactgtaaatcactcaatcgattgtaatcatattgcagctcatctcaaagagataaagaccttccactcctctaaaatccctgtcaatatcctagcaggctgaagagaggggaaagggggtcagaagaggaaggagggaatgagtcaaggacaaagcggcactttgagtcttcagttcatggagttaacatgaatttgattggattcccagtgatatttacagttttctccataagatgcatttcttttccacacggtacttttacagcctttcagtaagtccctgatgctctgtgttggccttgatggcatagtttactaagtgccaatggtagatatatagcacagcataagaagacttagggactaagtttataagtagcaaatgtcaattcgacagaacttaaatgctgaagtgtatatcaaacaatagaagtcgattgatcatgggctagcaaaaaatttatattgcactttcaaacagcagaaacactgtaaaaacctttttactaactgctgttgcctttaatgtaatagaagtattcccctatcctcatcaccggggtagctctgagtggagccatttctttatgcacttattcattcaccttcattcactattcaacaaacatttgttccacatctactttatatgtgaattcatactaggtgatgggtatatggtgaaaaatgaaacacagctcctgacctcaaggatcctcaagtgtagttgaagagaaatacaagtacacaaggaagacatttttattgagcagttattaattgccaggtagggtactgggttcttgtatcaagtctttgcagtagccccaaggggtagatattactgttatcatttcacaaatgagaatctggagcttctcctagggtcaagctagcacatgaatacctggaactgaagcctgtatgtcttagaaggcaaacccaaagctcccgtacgctgccctatcttgaacctacaattccacaaagtgaaagaaggtgctactattgaggtgagatccaagttcagtagcgggtacacataaatgcctaatggagcctgaagatcagacaggggcgagcatggaatacaatttgggatgtgaccttgaattatctggaacaatgccaataagctctgctcccctacctagtgtgaaagatgacatgacaacttatacctttctcattgaggaaattaatgaccatggaattctttcttttacttaaattttttttttacagttttattgagggatgattgataggcaaaaaaatcctgcgcatactttgatgagtttagacatgtgcgtacacctgtgataccttcaacacagtcaaaataaacacattcatcgtaccttattttacttagtgtcatctccccagtggttccaaggtagaagtattaatctccctcatttacagatgagtaaaccaaggttcagggaggttgagcacatttgctgtggtcactgtccaccaagggtcaactctgagattccacacagatatgtttgccctcatttgccctcacaacctaatacccaggttgcccactccacttttccaatgtcttccaagagcactccagtttgcatcatctacagagctcaaattcacatggttgacagatacaaattcacatgcaaatgtactattatttcctacatcccagtgcatgcagaacactgtaatcccattattaaacatttactagaaatgtgcttctgcctgatgcacaattgccagcctcaatgtttaattaaactagatttgttttcattttaatcacattagagaaatgtgtttttctcagagttcagtggtgaaatcttcattccaaatgcctccaagtgactgaaaactgtatatcccagaggaagggatgagggtattacaacctatccttgcataaaatattttaggggaaaaatattaattaataacaggtaagactgggatacactatttgtttttgaatcatcatagcatcctggaaaggggtcctattattattattaccattttagagatgaggaaacgaagtctgagtggttaagtaacacactccagtgttgcacagctagtaggtggcagaaccaacatttggatgtagacagggaaaccctgatatctttatttagattagggatcaccaaaccttttcccccaaaggccaaataacaagtagcataggctttagaaaccaacctatcttataaatataaatatatttagatattaacttcaatattttattaatataaatatgatatgatttgcatgatctttgttgcagttattccagtctgctgttataatgcaaaatctactatagacaatacataaatgaataggcacagctgtattctaataaaacttgctttacaaaaacaagctgtgatgaaccacgtttccccattaggtttagctgggggaaccctgatttaaatcacggatagttggaagcctacagcttttactaatccatcagctttattttttgaattgtcttatctgtttggaataaagagagcaagagtatctctaagtggatgggttaaatccctagagagacagagaatagtactaccgtgtagggtgacatagacctactggtgaggttaattcaggataaagaaataaagagatacaatatgtaagaaggacaggcactccatttacgtatagttaaaaatgacaaacaacaaaatagctaaataccatttttttaattcaacaccaaagacagacacagattccattctagagcaagatttgaagatgatggacagaaagcattgtttctttacttctgttacttctacttaataagccgtggtgatttaaatacacccctctctcctaaaaaaatagtgcttacttttcttttaaattcaagaattttgattagccaccctagcctatttctcatagcccttatgcataaaggtgccagttgatgccttgcattgatctttcttttctcctacccgcaccctgattgatatgtctgtcttctaagtcttagagagcatgcccttcattatctcagcattggttgtccctgtcttgctgctgagagcttcctgcttgagcttcagttccattttcaagccattgatctgatgttctgaggatggactagcccactttagaggtggctcagcccacttcatgctattgagttttagagattttagaatcagatcccctatttattaaagcagcaagaccaggctatcagtttttatagatgtgcatatgcctaaaaccatgtagtatttaaaataaattttgacctacatcctctattccccaccacgcctggtacccaccattttactttctctttctatgtatttccttcacttttattttttgctttttggattccaaaaagtgagattgtatagtattttttttctgtgcaaagttataagggatgaataagtctagagatctaatgtacaacataaggactatatttaataatattgtattattatatattgataatttgccaagagagtagattttaggtattcatacgacaaagaagaaagaaaggaaagggagagaaacaatcactgtatgagatgatgggcatgttactttgcttgactacagtcatttcagtgtttatatgtatatcaagattacatatataccttatatgtatatataccttaaatatatactttttttaaaagccaaactaaagcacactgggtttttatttacaaaatagggacccccttcacagtttgctgacctcaattttgactccaattaagttatcaaagttctaactaccagaatagaaagcatatactgccagatttggccctatagtgcaagaaaagtggtcacagttttcttaatcctcttttaaaaaggaaagaaacaaacatagtaggtaatcagtaaatattaaactgtacaactgaggtttttggagctttctgacttcaatgactgcatatacacaacaaaaatataagttgttatacagcatccttgacaagcattaactataaatacttttataacaaaagaaaaatatcatttactacaaaacttttaagcttttgctttagaaatgtttctttattgaaacaaatatgattttattgaaatattttttatattagtacgatgactctttattggtctcaaagggtggattgccaagtataattaaacaaaatgataaataggaggaagatttcagtatccttgacagaaaaatacatataaatctaatatagatatatatgtaaaaagtaaatctaaaatcttagccaaggtttagaaatcttattacttcatttttatacctttataaaactgttgcgaggtgctgtttcaaataaaataaaaatttatgtaagtaaaatacaagctaaaatagaactgaaatgtctttaggtttacaaaatgaatagctggattagtttactgaatttttttctgtggtatgggtggcactggatctctagaatcggtaaaaataaaggcaatatattgttctcagggagcaattgagctctcctagaggaggcaaaccaagtgaaatctaatagttttgcttcattctgtgactttcccccgctatgacctcagaattttgagctacaagtaggtctataaagggaattttggaatactcttaatagatctgttcttgaaataagtcagctaaactgagtgaggtgctttgccaacacattaactgaaagtcctgaccaaccctgatcccagaccttcatggacaattctcttgttttatttccatttccagtagttgtatgtaattcttctaagagacttgttccaagccaaccttcctagtggtcttgttgaaatgagatagtggttgtaggtatcattgatgaacacataggccaaaacattattgaactattcagaaagtaaatctagcttattctgtggctgcataattatataactgtagctttctgtcaggttacagtggctttaattttctgatcaaataaaacaatcaatataattgtactttgttcctccctcttctggcttcgattctttgatttgtgccactcaccactctcattcttccaacctccccctactccactggcccctgcagctacttagaatagctagctgttgattaaagggaccaagagtttgagcagttactgtatactttcaaaccccactgccatttggaagtgaagtcccaactgacatagccaaactgtaaggacaaaagcaactctaatacctgctttcctttgtttatagcaactgctcaaattctcctctaaaagtattcattaagcatccttctctataaatctctgtggtagaaactgaataataggacttgaaccattattcaatcagaccaagtttaaacccaggttaaggaaagaggaagtctacacgtctttgctgctcactgtgtttagtatatatcctctataattcacaatcaaaagtaaatctttggacagcattcttgtttgggttagaagaaaaatttcaatccttgttcagaagtctaagcacttgtgaggattccaatatgatttttaaaggccaccatccctgatagtcagaaataaaaacattaaaccaagaagactgcaggctttcttctcacctgtccatctcttgtcctaattacaccttatacttactaatgttgtaagtgctttttgacaagacagcaatggtacatcaatagatactgcatgaacttgagtaggcaaatcaagtcactcagaggccttcttttaatctcttggatcattattgcaaagataaaagcaggtttctgaaggagtgaaattcaaaggaacctagtaattagaatggtgaaaataccaggtcacccggtccgtttccctgcttggttcagatatttctaacaatatgtactagtttaattttattcatctaatttaaaatgagagactttatctttcttccaccaagataatatatctgatttctcctctttggcttaaattttttttttcattcacatcttttattattagggttgtcagttgaaattattttgaataatttctttaaatcatggatttttttcttacatctcatatctaggagctatttcttgttgcaaggtgcaaggttctatggcacatacaaaagcatgctttcatttgggatatttataaaatctctctatacacacacacccatcaatgggcaaatataaaaagtattgcctttgtgctagcatgtagttaatattcaatgaatatctttacacgtaaaatcacctataatctttagacatgttcctcagatagccaagatttaatattacatataaagtcatatgaaatagcttaaagaaggaagaggcattgttattttatgtatatgtctcaaatgttataaaggttataagaacctttctgaacatcgaaaacttcaaagctaatagtttaatagtttgttggatacctgccatcttttgaggtggccaatagttgtcaactttttgagtatccttgagcactgaaggtatgtcaatgtttggtttcattgtgtgttaaggagggaattatagaagtagaatggagtaaaaagcttaaaaaagaaaaagcactgcttctaaggtgattctaatttcataggaaaaaaatactttaaggactaatattcaatacagagtagcggaatctgggtgccagataaatatttaacatttgtggataattttacataatcattggccactttcttaaaagtgttttttaaagccctaattttaaaaaatgctattctggccatcacatttacaatgtgaataatatttgagtcatgacgtaactataagttacttctaatgattgactgtcacttgagttgtaaatcacagcatttagcagtgctagttgtccttacttttggtaaccccttagtccctggatcttgatcattttggggtctttactctagagtctatctttgctctagagtctagctgccattcacatgctaaagaaatgccccttaaatagtacctataacatcctaaggaaatgatttctaaactcttctcaatgagtttaaaaaggctgctttttgctaatccataaactttaacaggggctgaagaggcagtgcctgctttttaaaaaccaatgttgcaggctgggcgcagtggctcacacctacagatgcatgcctatagtcgcagctatttgggcggctgaggcaggggaaggcgggaaaattgcttgagcccaggaggtgaaggttgcagggagctaagatcctgccattgtactccagcctgggcgatgagagtgaaaccctgtctcaaaacaaaacagaacaacagaaaaaaaggtaaaaccaaggttgcaaggtaggactgtttgtgtgtgtgtgtgtgtatgtgtgtgtgtgtgtctagttttgatctttaatgagagttttggtttgtttctattgttgtgtgttagtagggaatgtggtggaggagtgcctttctagtctaagtatacgtaagtgtattcatgaccagtattcaaagggtattcataccctgcagggacataaatggttttgttttggaatgttagggttaagaatgaaagtgatggccctgtttgctcagaaaaaaaagaaggtaatccttcagtgctctctgtgaaatcatgtatggaatgaaaaaattcattgatggggtgagaggtctcagtgccagcaagtcttactagtaaattcagaattcagcctgctgttcctagagatcttcctctccactcctcatccaaagagtgatagaaggaggtcagataagtaggtccttgtccctttagggagctacttaactctactcattatcgtcttggagtcaatccccacctcattccctgctcttcccctagtctgtgtctagaatcaaggatcagagaagcatcaacacatgcatcaacctttctccaattttccttccctttcccaactccctcagccttaccctctcctctcaggaactgcattattgcatctcttcttttggatttggtaattctttccttagaaagaggaacagggctaaggataggcaacaggggcccagctgtccatgtctccatccttggacccctaagacttttgccacacaaactcctttgaatctggagactgcaacggagctgcttccctcctcctgctgagccttcatggaaatcctcataggagatagtgtttcctttacccactctcggacccctgttcttcctggatctcctgaattcctggctatatcatttaggttcgctgcattgcaaaccactccaaaatttccgtggctcatgtgagtgtttttttctcttctgggttggcttggatggagctagatgatcttgatggcctcatgtacccctctggggtctcagttcagatagccgagtaggttcacatggctgggtttcttttctcatggaagttcacatggcaatctcaggtgtaggcagcaggcaagggcaagcattcatacacagatggctcttcaagcttctgcttatatcacatttgctagtgcccatatgcccaagcaagtctcacggcccacccagaaccccaagggtgaaaagatagattcaaactgttatgagaggagtaagagtctcactgccaagagacagattttgaaatgggattgtagctattttttttttttttccaatttaacacactggaaaagaagaaaggctctggttctactaatcatatttccctcgtaaattttctccttccaaccctgattcaggtctcaagctgtggttggaaatcagtgactttcactaagggattgtcctttcttttctttaggacatggctttttgaaattaatcttgattctttctgccatatcccaagccttacatttttttcctttttttctctatgtctgatcattttgctttaagtcaaattgattttttaaaaattaaatgcccattaagaaaattatccacattcatgttcccttggatgctttcaaatattttattttcctttgcttttggcagttacaatctatcagtgttatttgtaaaatgtcttatatttgtatagggtatgttctccctttcctcttttcttcttttctttttaaactaagatagatgtgttataaaacagcccccatgctgatccatacttttctctagacatttctgtgagctcagtactttgttgtttatcattatcctttgtttgtagccagatttgaggccatgttgcagttctcacaaacaaatcaatttgaattaatttgccaagtagaattaacgaggcattgtatgaattcaagacatactacaactacggcatcccctgaggttatttcttctctgggaaaattttgattcttgtaccacattttaatagtgtatatctgacctttgaatcttgcactaaatgatacatggctgccagctggtttaatttttgagaagccttaaaaattctatgcagccaaacaaataggagtgtagacaattctttaattattaactttacggggagaaagttgtcttcaagatcgatactctctgatgcttgcttgttgctaggagttctttttctaatgatgttctaagcagaagtttgagaaacatcaaaatagagaatatatatttcttagatggtctttgaggtctccacaacctaaaaatgatgggctccttctctcaaattataagctataaatcccagcaaactctactcccagaaactgtttttatttaattataaaatgggaaagcatttactctaaagagggaccatggtgattacctgaaattccttcactccctaaatggacatctacatctgtcactaatatattatttagcaaaagaatttccttcagactatgatgaccaatgcaaacaaaataaataagaaaatccagtcccctcccacccctcacacggtgaggaaatggtaatagagttcttcaaagaaactctaatttctgggtcttagatgaataacattagaagtgcttaaggaacttgaattctaagcccctttaatgttcgctcagaaataattaacaggagccagtcagaatagaaaactagtctgggaaaagtgtcctaaattttacactgtataataggatggatctcttaaactcgggactgatatataaaacttctccagtgtttcatttgaccaaaaattggcacacatttagctagatttaaaaaagaatatggtgatggctgagaactaacctgggctcattaaaaaacaaacaaacaaaaactcacgcatgctagtgtaactttctcttggatagcaatagcaaattggcaggtgaggaggatattataaataccatgcacagtgtatcttcatttccctaaagcagtatactgtaatgtacagagaactatgaagggatcttaaagagacctgcctgtgttccatcatttgaagctttctggttacactgtaaagtttgaggtaaactaaaataataaaagtaaaatttattatctcacagtttctataggtcagaatttgatagcagcttagttgagtgattctggcttaaggtgtctgatgagttgcagttggtatgaactacggctgcagtcatctcagtgctatctagacctgggagatctgattacctggaaatctttcactcacatggatgttgactggaagcatcagttactctctggctcagttccttgccttatgtatgtttccatagaacttcttaagtgtcttcatgacatgagtctagcttgctcgaaatgagtggtccgagagagagcaccttttatgactcagtctctaagtccacacactgttccttctaccgtgttttactctgtagaatcaagtcactaagtccagcccacaatcaaggttgaagaatcaaacctcacctcttacacagaggagtttcaaagtatttttagatattttatagctccatcataatcttcctattcagggactagaatgaatgcacaaaaaatatgcttattaaatttgcagataacacaaagctaagagaggtatctcctaccagaaacaaaaaatcctagagttaaacattttcttaccatgtttggatgctgttatgaaacaaaaagaatacatttaatgagatataaatacctgttggacgttcataaagtatgttgtatgaatgcaacgtggaacaatttctttgggaagccattcaactagaaactggcttgagttttagttagaaacaagcctaatatgcggtcctgttatgatgtggttgttgaagcaacggttgcaaatcagtatactagtcaggcctcctgtgggtggtgactagaacagtgattgttacttttagatattttgggaataataaattcattcttaggcaagggggttcaaggatggtctaaaatgtctacaattttataaacactggcaattctataggatgtatacagaaggattactatgtcataagtttcttgagcatcggagatattaataatagcatgactttcctgttgtcgggatgacaatgttcctgtgttgtgcagcggaattgtcctcccaaacctcctccctgtcctctgagctgtgtggggacaccacatatgtatgtttaaatgaacagaattttaaaaaatcaaatattctggcattctggcttcaaaaaccttgcgtttgatgttctctacttagaaataaataaccaaacatgagaggaatgagaggagatggggatggggagtgggaggaagagggtagatagaaataaaaggaagaacaacattacagagaagcagagatgacacagagggtggacacgtgggaaggcctggatcacaggggaaagagtgagccccaaaataacactgtggcttttgcagcaaggaggaaataagtgataagaggaaaggcacctggggaaatcttgaagggatcatatgtcaaacggctgaagagcaaacattaaagctttattttgaaaaggatatttgaaaatatttgacaccaaaaattctgtagggaagtaattcttgtggagtttgccttctttttagtttaactcttctgaatcaggtacttgttataacaaatcatatattgagggattattttgtgccacagatttgcaacatgctttatatacatttccttttaattctcaccgcaatcccatgttgcaattattattacgatccccttttaaatatgaagaaactaaaacttaaaatgcactaagacatggctaaaactaagcatggttaccagaaaggaacaagacaaaattcagacattgaaatcaactactgtagcttcagtgcatatttcagaataattgtggaaggaaaaaaaaagtgacatttgaggaaagaaagcaaattttacagtcagtttatgttttgttaatttataacatggcctttttgagaggggctcttaaataaagaattggtgccaggttaacctggcatactgaagaaagtttcatttgaagttgcttgaaaatattctcttaaattataggaatgaataaagaggttgcagtcgcctgggcctagttttattaacctaactgggattgaaagtatccttgatagaggaggagaaatgagcttcaggaagtgagttacaaatggcctcaaagtactgagaaaggataatgattggtaaaatatgttgtaattattgcatcaaagtaaatcattttagtacataatacctcagcagaaatggatttttgatttgtttaggatatgaaagagaagtctaatattaacatgtatgcacaaaacatgtatgttcaaccagcaacagacagcaaggaataggggcatgaacattcggatagctggacgtaatacaccagggttacatctccggcatggttccattcccattccatagcctataagatatttggacatgataggccaggtgtggtggctcttgcctgtaatcccagcactttgggaggtcgaggcgggtggatcacgaggtcaggagttggagaccagcctggccaacacagtgaaaccccatctctcctaaaaattagctgggcatgatggtgcatgcccatagtcccagctactcgggaggctgaggctgcagtgagccaagatcacaccactgcactccagcctgcctgtctcagagaagaaaaaaaaaaagatagttggacatgataactacatgtctacaggctcatcagagagagagcacaggcagaggctagagctcaatgcaaatatcgagactgaaaaaggttttggaaggctctcaaggcaaggatttaccctgactcccatccccctgctgttcaaggctccttactgggagaaagaactttcttttctaagccttaggtgagtgttagggaaggatcctaagaattaaaacaaatcacaggctctctcaactcccaacctcttttgattccccacaagctaagcccttgcctgagttattgcatttaatttggataaaaccatgcaatatagatattaccttttttaaaaaaacaaaaaacagatgaagacaccaagagtcatctagattaaataaattgcccaagttcacagaactgataaatgtctggacttgattcaaagtttgtctgactccatatccaatattcttttcactcatgtttgggccatctttgcttaaacagatcaactagcacagcctagagttggtaaacccatactacaactttaatttaggaaggaaatgatactgtctgctcgtatatatttgccattatcagaacatatccagaagacatgtagaggtgagctttatcagccaacttggtgtacgacagggtgatttgcacttctttccagggtctccctggctcaaggagccacttaaaaagctcccttacttaataatgcccttgtgctctgggtctattaatttacttcccacaagctgatcaattttctgttccaagacattaatttctttaccttggcacattaaaggatcaaagctcacaacatataaatagttctttttccttctgccccaaaggtgtgtagtgaggattaatgagatgatgcttataattgcattttgagctccttggtcgaaaggcactttataaatacaagatattagttttttgctgagatccatctatcacttacaagtggccaaacattctagatggcctttgggtgtgcaacacctccctctctgactctgagttggtctgggacaatgccagaaatgtggctcaagccaagttcagagtttctggagttcccttcctttagtgtcatatactttctctgaaacttaacttagaaagtgttctttgggggaagagacatggcaataacctctaaactgccctagtacttgagggcagcagtaccactacattgattttcttttgcctctgactttaatacatagcatttattctttgactgttcattagacccacagtctgattttttagtgtcaacaaagcaataaagaaaatttgttcctcctttatttcagggctcaagacaaaattcaaaaatgcctttggcattcattttgcacagacgaatgttgttaggatattcctattagcatgtccacgtgcttgacaacatttcaggtggtattaatagtctacctgcaagaaagtgctttctgccagcctggtgcaaattggcagaacctttaagccactctttctcagcttagcagcagtatatcatcattacctgtggctggaccaagaaatcacatttgtcaatgcctgaattgctcttttactttcagtggttttagaaatccactttgttttggaaatgggcttagctgagtatgttagaagatacagaaacatataaagtgatagataagggatttaagggaatattaaggatgttacattttctatggtcagttgatctttggaagatgacttttgtgggaccaaatagaatatggtcatcttttgaatgaaggactggtaagtgggaccaaatagaatatggtcatcttttgaatgaaggactgataaggtagtgagacaagggaagcataccgtggaactaatgagcttccttctgatcactagaaaagagtcgagtcatattaataatgatagtttaaatatgctgtactccctattattctatactaagtcctatggtaaattgagaaatggggaaactgaggccaagtgacttgcccacgatcacacagctaataagtgataaagttagaactcaggaccagatttgtctccagagcccatggtcttaactcctatgctgtattgattatggctttaagagtattagtataccttctaattaaataggacccatgtttggaccaataaagtgtaagcgcagtgttgtaaaagttattttccatgttatacaagagttctatttttcagttttttcacttgaaataattgtattccttggagactgttaataaatttcgagtctcaccttaaagaggaattgatgtatattgaggcctactcaagggtcagtttgctttccgtttctttcccttttacttttatcctaagtggattcacccaaagtggaaaatgtgaggttggagtgtaaaggttggaactatgaaccagttgggcttcaatactttcacctcaaagtattctgttcttcacaatattataattccacagtgcatgtgcttgttgcacacgtctccaggagttgaaatacttgatattagagccagtggtccaaatgaaaatgaccagaagaggccaaatgtataatgttctcaatcccttatcaaaaatagatgggaataaacacacatatatttaagtacaataaaatgtgactaatatgtttttttctaaaacccagtcccatataggtgtcggatccacagaagtaatttaagaatggtttatttgaagatctctttgtataatttatagatttctcagtgtgattaagaaatgaagttattacatttttttctctaattagtaatgcacgtatgcctccttttaatgatattatgatgtttactactcatagggccattctttcttgagtatagccatcactttctgttgaagaattgatttcactctttgtttaaatgtacatacttgttgctatatgaaatatatgactgaatatcattaaagatttagcaagaatgtaggtgaatttggtgaggtttgttcagcttttagagtagccctgtataagaatacttatatttagaaggttgtttgcgcttcagtcaaactagcaaatgaggcatggggcaaataactcattctcatgcacatgtttctaaaacagttcttactaatgtttgagataaattaaaataaacaccaacaagaacatgaaaagagactaagaacaatgttaatgcggcaacttaaacaaatttggttttccaaatgaccttccatctttcacaacttttaacagcatgcaagattgctatccttagtgccagatactatcaatctggtgtggaaaacttaaaacttttttctaaatgtctttaaagctgaggtggagaagaatgactctctgtcactttcagaagggtctaaggttgaatcatgaccatgctgtccttccccatgtcacttactgtttatctaacatagttatctctttttctagcctgtatcatgcccccagattattttctatggtgctttacgtttgaaagagagtagatgatgagggtggggatgcttaggagggacaagggccctgtgtatttggaggaagtaaattaatacagcttcttaattaatttggtgtatattaaattctagaaatttggaattttagttacttctgattttgccctgcattttgctaagaatatttagctttatacttgctatcgactacaccaatctattccgtagtgagtagaatgaaggtcattaatatatttaatgtgtagccaacaatggcagatacagaaaacccaaagtaatagaatacattcaaggcagatctggcgcaagccaattaccttttctcagtatagtattctgttgtgtctaaaaccctagaggatgaatgacatcctttatgatatctgtcacctgtagggtaggattatgagttatagatgtatattcgtttcaaaaaggtacacgttctttttctatgaaaacgtctaaaaagtttactcaactttattttgaatgaatagaatgttgtaccaagatctaccaaggtagaccattataatgatctctaatcgatagctatattctttcgccatgggctattgaaacaccaagaaattaacttgcctgtctctttttcctctttgcctgccctctccatttttttctatgagaaatgattccttgaggaaaattttaaattatccactgcagttcgaaactgttaattgttcctattgcattttatttttcaatacattaatatgttataccctgtaccaaccagatacagtcccaaaacataggctagaagcagattcatagttgcctcttttatgagttcttattttaaaaattcctggtagtaaagatatgagtcagcttgttagaataatttgtctgtatgagaagtgaatggggaaccttgtgaacatcctccaatattgctacccgtttcctatcctatacccccaccctcacaacacagaaggtaggtaccagtttattcccaggtggaatctcctcagccaataatgactcctatatggagatggccctgcaattgaaatgctttagcatgcccctattcatttggtctgatgctatatgcaattctaatattctttatggcttttagaattctttgtaaattgtttccaagccacctggtttgagatttttctttcatttttaatattggtagtttggaatggagttccccaagttgcaatataggcctatgaatcaaaagtaatgaattacaattcactaatttctgccagatcaatgtgaggttggttgatgagatagaacagttcccaaggcatggcttcatcattttgttatttgaagcatattcattaagggtgtatctccacagcaccactctccaagtctgtcctaattatggaaaccattcagcagtgttaataacagttacgaaggaagagggggggcatactggcagttaaaaccactatgtttgagccttgaaactaattagatatttcatgcttggaagaagtattcctaacaggctttatgaatggatgcttgttcagaaaggtcctcttacagtaaggtaagagaaagagaaagcaggagggagagaggaaaggagggaagtggagggaggctaaatatacaaaatcagtgtctattataaaatatcggtgctcaaaagtctacaaatgttgtaccactatattataattacctctatttcctttgacatttgagtttccttatttttaaaaatgtggaacaaatctggaaagatagtgatataaaagcttatctgtactgatctacctctttgacaaagataatgagatgcaaggacatcctttatgtaataagaagtctcccttggccatcaaggcttaaattgtcctctcctcctttcccctgtcggaacataaagctgttgcaaacacttgagaggagaagaaaagaaggacatggccctatgtttctgatgggaatacggtagattaatagtgcagcttgcgtgactgtggagcgagggtcccgtctcacatgtgaaactgatctggcaggtgaattagtcatgggtcaaggagatccttgtgtctcaactggcccaattaaggtgtggttgagatgagacagagagagagtgaaggtaaatccatttccgtaaacggccagacctcttaaggattcccattccatgccacttttccaaaacatgatggagtactgcatggctaagactaacctgacctttaaacctatcgaccaagggcagagtgacttcaactccacctctactaaagataaattgatatctatctctaaaaacttcataaaacaaaccaaaaaacctaggatgttttttaatgacttattgacttttcagattgttctttaagctgttttttaaactttaaaggcaacactgataatgaacgcttccaaatggtaaaacagaaaatccccttcaaatataatcggcctgtagaggagtggctgcaggaaaaaggtaaccgtcattaaaactttcattttaaaatcatttgatcctaaaccctcatttttaaagcctgcaaataaatgttccttaaatgataatcgcctgctgcataaatgactgttttaattttcattataatttgtgtcagcttccacctgccatatgttgataaatcatgctataatacattgccattaaaatacagttaaagggactaacttctagcctgctatcagcatgacaaacacaaacaagaaattccaggaacttctaaaacagaaatgtattatggcaatttaaccactgcatgacattatttattaatttgttttaaattaccttttacaccaaagctttctaaagaaattccaaaagggctttttaaacttacacctggaggctgttttggcttgtagcatgcttaacaaaacaaaaaacaaacaaaaaaacaaacaaacaaaaaaccatagattgactcttgtaacttaaactacttaaatattgtaaggggagcatttttttttaacatttgttcttaaagaaaaaaatgaaaaagatgaattttgcctttaaaacctacagaggcaaaattattttctaagagattaaggttgtgtcctagttgctgactgaaactaaaaacaaaaacaaacttattttacacttcggttgtgtgcatacacttgtgtatttgatgttttatgcaacaaaagtgtaagaagttaacataatgagttggaaaagaaaaggttcatgaaaggcaaaacagcagtctctgatttgctggagacaacaaccactgttaataaaagagggcagcggttataactgatgttagaattttcctgtatagcttctagctgttagaaaataaaccattgtttttcaatgaaaaacagtctctaagaagatacgtattctttgttgttgttgttgttgagccagtgtaagctactcttgtctcaacacctaaagggagctcttaacatttgtagagatttcattgagttatatagaagaagtaaccaggtatattacttagtatacaacttaaagagcaaaggactactacagttttaagttggaggaagacattcagacctttaaacgtggaaaatcctcacggagtgttaactgtttgccctgtttttaatgtatgtggtctaattaaaaataagaataactctaaaaagcaaataattttgtttagtaatcatcagctcataaagtccctttaacattaaagacaatgattgcctcactttaaacaggaaaagcaaactagatgcatgtctgagtctcatgtgcctgagaaacctttttgtttctttcaattttatgttaataatttttattttactccattgccttttaagtctaagtttaatagcatgccaggcattttcatttgtataaaccattataaagttattagtaggcttttagtttttcttacaatagaattgttacccgttggctttcacataaaaggtgctttcaaatatacaagttgaggggttgggatggggggaggggtggctgaggtgggactggggaagatatcctagtttcttaaatatatgtatgattatatatgcatataaatctgaaaagaattatttgcaaaccgtgagtttctcttctacattttgttctctgaaaaaaaatttttgttgtaatttgggtgagtaacatctatgcattctattgtcttacctcttcctctgcctagctaaccttcccttcaaaaggaataaaatataccaaagacttgtaaagacaatgaatataaaggataaagatagatggatgattagacagatgcatttggaagtatttggaatgcctctttggagttatttctgtcactggggtggagagctgggtcatagcattcccaagtctcttttctggctctgtctactattgactaactttctgaccttagacaatccacttaacctctctatatctcagatttcccatctgaggacgggcaaaataatactgcctattccccaagggtgttctgaggtttaattaattagtctttgtgcaacactgactggagacatgcaaagatttaatttaagcagtatgtgaacttgatgtccaaatgaggtaataattaatgacttccaagaggatgggtatctaaaacaaaaagtaacctgctacaattcctctaccagtgtttgttataaccaaattttgcattaagaaagataaaatagttctcagattaggatatatatgcataaatatgcacatatatatatatgtttttatgtacatataatggtcagttattataaaaatctgatcataagccatgagtgaaaataatgagaataatgagatctggcattgatttggggaaatcttgggcaaatgataaaaagaaactggtcagttcttcacattcttcatagggaatgaatagtgatggttttttctgttattcactaacccctgtttatctgagagataaattaatcagagtaagggatggcaggacacgaagagtgctctactgttcctttactgattgctagctttgccattaaccacctaatccaaggtacagggagctaggagagggttttactacagcagaagagcagatctagccagaaacagaccatgaaacaaacaagcaaacagaaaagcaaacactccctatggcaagatgaaaaactgaaacatagacaaccccctttactgtctcactccatcagtgtcttattctcaagaattgattagtcagatctctctgggaaagtagctgtagtcaggagtagaggggtagtttaaatcttgtagcccaggaaacctgccttgcctttcctgatgcttgggtcagtcttgaacaggcaaagagcactttgtggagtgaatgatggcaactggaatgaaggagactcatcatctctagccagtgtaattcagctttgcattttcagttttctctgatcctctttttatttgtaagcactggcataataacaccactggagagataagatgagaactattatagaggttatcattgtgaagtattttcaaggatattagaatgtaagattttctacctgtaatcaagtataactgttaacttatcaccagtgctgaactatacacaaaataaagagatggataaatattatgattcgccagcagttgtgtgcatggaaagtatctcttggcattaggctgtctaatgtaagatactgaattttttcctagaaatctcctgctaggcagctgcttctaatttctaattcattatgttaagctgcttcaaatgcctctgtggggttgagggagaatttattttccccttccatcatttcatgtcttttgtagtaagctcagggcttccagaaaaaaaaaaaaaaaaaactgtcatcaacaataaacagtaaagaggtatgaactccagcatattacttagtattattatgcattgaactttctgctgtgtcttgtgtgaagaggacagaggacaaaatacagacagtgatgcatatgcacaacacactaaatgaattgctgagaaaatgatgaaaatctatgagatctgttttgattgcatccttgggatctgggtaattctgtagtcattaaggccagcagatcccatattcaggttctggagatttttataaagtatagatcattttcactataacaaagttctctggccaattcaccatactgcagtgttgaaagcttccaaagggctattatttgtaaatcattcttgattaatgggcactatgagttgcctagtgtgcagaattaactcttgtctaaggagtatcctctgatcggatgagcattctcttctctgccacttccatttctttcattgttatacattgagaaggtatttcacattatacaccaggaattcaaggacagatcaacattgtgtagccttgaagaccatgtaatagtggtagatttttaaagcccaaacgtgacaatatccctctattcatattggaaattataaagcaaaaagctttataattttgttaaaaaccctctttttattaagtagtcataaataacaaaattgtttctagttatttctagctaaggtaattcaggtgattagattaagaatgagtggagcgttgtttgatcactaagtagagaaaacttcagaaggcgtatatttaattccattaataagtctttcttttttcctttcttcatatggaaaagcaaaatgaagtaatctggagacataacagtaaagaaggccttagcatattgctgttctgataaattgcaataaattttaaaaagctcttactttgagtttgcttgggaaaaaaatctcatacttgagagttttataagtagaaagagttgggaggaattttagttgggtttcattcttctaaactctatactggtatgttttttcattttgatacttttcagagcagtataaatggtgtcaaagtgggaactcgaaataaagtgaactattgatattcttcaactcattaacacacctctatgtcattttaaggagttttatatgttgctttcttcattaatatccatccattttaaaaaatttattaaatctgaaggacaacttccccaggactggagcattaccaatatgcttatatttcatactgagggaataatttagttgtgggaccataatccatcctcctaaaaacaaattaatagagataggaatttatctctcatgattttgttaaccagaaaatagaatattatgcccaatgaagatttataggaaatgatacgtttggtgactagaaatgatacgtttggtgactagtagttcatttttacaagtatgcaatgaatccaagtctcttaactgaaatttaatttcagctaatttaattatcagacctggtttttaaatttagttttctgagtcacctcactgagtttttttggccatatttaattcttttcattctcattattttacttcgtagctttaaacattaatgcagtaggtatccgtaatttattctggtcatcacctgatttgagtgtttctttctgtcatcctcaattatatacccaagaagaccataatacttcttatcattgaaccaagatttcttcttcctcactatgaaggaatagagacttgattgttcaagttatcaaagattttcagctagacagtggaagagataaccataatgaaatgttacttgctaacgtcagtactgaggttttgttgtctattttttcctccccttcaattgctcaaggaagcctgttatgatgcctggtccattcagaccaggtaaggcaaacaaggaaaacgtatgagaataataatgtttcctccacccaacccactaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcaggtaggcctttttccaagtattaattgcgtctgtatttttatctttgcaacattgttatcatggtcattgctttatgtagctaaagagtttgaattactatgtaagaaggatgctggcagatactcatagtaatgagacccaggagaagagaaaggtgaagtcattgctaaagaagtcataaaagtctgtggcactcctgggttgttattcttattgtatttatcactgaaatggtaaagctgttattcaaaacgagcaatggactacactttcagtatgaaatactctctcctttaattttattaccttttcaaataacagaaagggcaagggagggaaggaaaatctgttatcatatgaaaagctatatcctagttcaatttcattcacattctccagatggctttgctataacatgaatctttcattattgaggtcaatgggtaccattaaatcaagggcagttaaagttagaagtgcaactactccttgtaaaatgcagtctttatgtttgttatcaaatcctgattaatcatgtgtcaggtttgtgcccattttgttttctttatatttgatcaagatactaattacagtagaaaatttgaaggtttgagtttggctataccggaagtccttgtttttgtggcagtttttttccacttgaaagtaattatatccaaactaagcttaatactttgctgactcccttggcatttcataaatctagttagtagggggtaggaggttaactgaattattagccttaaatgctctggcataccatgagacattccaattgctgctgcgacaacaattacttacccctatcctagttagtgtttatagaaaaatcagtagattagcacttgtcctgtttgcttctttgttttaagacattatccaggagctcagttgtgtctttaacatcacctttacactgactccaatggacgtggttaacttaaagtcaataatcaattataccacctatgtgttcccatttttcagaattaaatgtatgtgagctaggtaatggtaagtgtattatctgttgccttcctttttccttttccttgagcagaagtatccagacagctctttgcatggctccacagtaacaatttggagttatatatgctgacagtgtcataagggcaattttatcgttttcaaaaggcttctaaaaacctggttagcatagtactgttaccgtcacacatgctattacctgcatacctacacacatgctcacgagaaaaaaaatagctcttctctactgatattaaaccaataactcctgacaccttgctctactcactgaaaagaagataaaaggcaatatatatttctattatgactctctctagctcaagagcagatctgtttattgttggtgaaaggatagttctgtctgcacaggtcttggcagacttgttttgtttctgtcagaatgtattctgctaactctgtgggaagcagagaagcaaatggctttttcttcataggaatggctggtcctgtagttctttttaaggccaaattttcactgaccttgagatgatttaatgttacacggggattcgggaaccaagctgtagtaattattggttttttggctttccctcctgtagcacatacataaatgggaataaactgggtgagttcctgaactctttccgcaaattaagaaagtcagaactttggaagaaaagtagggtacaagatacaaaatcttgctagtgattataactctaaacgttatagaacctatggccattttagaggagatgaacaactgggaatgccttctccaatagcctctctctggcatgtgtttctttaagtccagtaattatcgaactacatctacatgcttttccttttacttccaccaagtctacaaaaatgagttataaacctgttgagactctttggttttaagggtaagtacatcctcttggaggaaagccaatagcctacaagaattgattagactgcgatgagggattttaaaagccctggattttttggaagactaactagaggaaataactttctgccaagggttttggaaatcttttttgttcttgaccactagtcatcagaactctgccctgtgctccattaaaaacttaaaagcctcatcttcaagcctagtctggtcttaaacacattctgttgatcacatcaaacctatgttaggactggggacccaacaactattggattctattcaaagtttaggacaattcccagactctagagactgcaggtaaggaaggtcagtcccagaagcattaatatgcctatgtgaccccactacttttcttagatgaggaggattcataaagttctgatctctgggagatacttcagaagtgagtggggaaaaaaaggtagggaagactggatttcatattcaccgggcccattattcacttttttatctatatgtgaaatcatacatagaacattttccaaatgataccactgttctgtcctcttttgctaaatttaataacattgtcaaagcaaagttttcctaaaatgagactcctctaggagaaagaaaataagcatgtcagtccaccagtataaaaacctgtctgttcaaaaatcctctagttctttcttaaagcataagcaaagaaaacatcctttcaagagttctttcctggtcaacctgaggtagtgttgatttcagatcaaaggaaaactgtaaggtgctttcagtgctgcttttaaccgtgtgtgaatgtgaacaagtagtttttgagttggtatgtctgtctagtgttatagcctcttagaagtaattggtgctttgatctttctgattccattttgttacaggtaagagtgtagaactatctgtgaataacctggctgatgttaatttactcatagcaatcatgcccaagcatcaggtcttgatcctacattgagaaggatagctctaggtactctattgaattttaaaaaatttaagatgtgcattgagaaagcaggtgtgtgagtgataattctcaagtaaaggcctggcacttcataggtgctcagtaaatatttactgaatacatctgaaaacaagacaggctttattacctactttagagtcatttcacaatggaaggtagcatagcttgaggaaagtgtttcctccacagtgatcagggtgctttggccaaatttgttgtatttttcagtagtaaggctatagcatagtgattcagtgcatgcacttggagctagattagctgggtttaaaactttgttcatcctcatattagcttacatgaccccagacaagtcatgtaagttctagttaactatttatatgaaacaaattttcccataacttggtggtttaaaacaattatgtcattagatttcaaaattctgtgagacagaaatttgggcacagttcagcaaggcaattcttctgtgccatctagagagatgattgtgttcactcagtggctgactttgcctggagggtctggctttatttacataccttgtgctttgctgggttaactgggaagatgggactcagcagggcccttttccctctctatgtattctctgggattctccttgtggtttctccagcaaagcagatgggctgtgtttatagaggctcagggcttccagagagagtacttccaggggcaggaagtagagggtgccagttttatatagcctgggctgggtaactggcagtgtcacttgtacaatatgctattagtctaaacagtcacagagctttcccagtttcagaggaggagacataaatatcacttctcaataggaggaggagtagcaataatttgcaaccaacctaagtctaccacattactaaggctaccatattataaagtagggagggtggtgtacttctagtggctatgttatatgattgtcataaggataactgagttgatataagtaaaatgcttaaaataagtgtaccattcaaagtaagactgcatgcgttttaaccattattattatattctgtttcccacaattggtgtattaaatcaagatcctctcaggcaaatatctgcctcagaaaatggggctgtgactaccgacagtagtggctatagtttagagtaagggctaggaagtttgggggaaatagagatttgaaggtggatccaagcagaatttaggggctgaaattagtcctggcaaatcaaaatttctatgatctcaggaacagacttctctgacacctcactacccatctttaaagttctgttttattttaaaccaacttagagttctatgagtctttgaaaatatgttctgtctatccacatgtcttttagggttgcaaagaagacaaatccagattccttaccatcgtggaatttacaatctaaatagggcaagagggtttgacatgagctatccatatgaagtagtgactcatgaatggctctttgtgctggggatggcaagtgttgcatggtgtggcttgactggatctcatgcactcattctactaggccttgttgtaaaaagagcacaattggacaggtggtgagaggaacatattcctggttggtcaaatgtcagccagaagctaagttgttaaaagcagagattataatctctgggagagatagccaagtccaagtagaacagagaatgcataagagggagtttgtgagtagcaaggggtccagaatcaaaatcttggcctgaaactttgccaagtgggagagggcccagaggggtaaactgaattgggttccctgtgtaccttactaccaggaatgccccaataattgcacaaacacttcctctacaactgactccaatattggtgggtaattattatggtgctgataggtcagcttctaaaatagaaaagttcaactcagtctacactcaaattcgttggtcttccttcaggatagaaggaaaaagtgagaaacaagtcttttaccttatgtctccatcctgagttatcagcagaaaaaaaaaaaagctcagtgtgttctgtgcaaatcaccatttggaatcatttataaactatttgcaggatactgatcatgacatactttttctgtgttgggcattggtaaagtcaccttgacattggcaactgctgcctgaaaattgccagaaaatcacaatgctcagcatggattggaactatccttataactagtcaaaatgaaagacttaagaggtttgtgagatttcattctcaagcttcacaaacttggtggttgaatgtgaaccacttttgcaaattccagaaggaagccacaatttctcatgttttgtaaaaattcttataggcaaagtactcttagcttttcagtgtcagactggagacagtaagaagcatgcttcagccttgatactgatgattacaaaacaaagaaaaaactttggattaaaatgttcatcctgcgcaacgtctgttctgggtagagtctcagtgtgttgaagagcgtgggcttttgcgtcagagtttctgagttggactccaggtttttccagttgcttagctgtatgtataagtctgttctcacactgctataaaaaactacccgagactaagtaatttataaagaaaagaggtttaattgactcacagttccgtatgcctggagaggcctcaggaaacttacaatcatgatggccggagagagaaaggagagtggggaaactgcccccctgatcccccctcccaccaggtccctccctctacatgtgcggattataatttgagatgagatttgcctagggacacagagccaaaccatattgctgtatatctctgggcaggtgattagcctctctaagcctcagttttactgtctgtaaaagtggccttacagtacctttcccgtaggctccttgtaaatagtaaagtgcaatcatgtgtgaaaagcaccccataacttttcagtaaaaattttcacataaggaaaccacttcaacctaagggactctcccagaactcacagatctccctagagcttagccttcctgtggggctggataagcccaggaacaattttgtttatactcatacaaactcacaagggcctggattgtgagttcttctaagggccccagattgaatcagagccccaagctcatcaatcaggagagattgctacggcaggctctttcatattctggagtgggaattggctttgctgaacagttacaacacatagactattctattaggttgaagtgtatgaaaccactatttttgtagatcaaaatggttaaatattagcaatatcacatggttctacgatgacacacagatttacagcatgttgttatcaatggcacttcgaggcccagactagaacctcagatattctccaggtcttcaaataatcaaactgccttgcactgggagacaagatagatccaccttatccccaaatactgtgctatagcaggatgtagatcacactgtatcaaaactggttatatttacccaaagaattatcccctctgggtccttccaccttttccctgctgccaccagcttgagagaaatgagataaggaatctacacagttttcatctccttgcttttaccactagacaacagagcctccgggggaagtttatttttaggatcagggctcaactaatattgattaacagccttacataatgtgaggctccagggtttgttcttttcctgccaagcctcataactggagaaggcgctgaagatttgtcagtctaatcagactttagctgccagccaagaaatatcttctgtcttctccttacccttacgcaggtactttctttttccctcttagagaataatttggggggagagaaattgcactctaatttacttgttgcctggtaagattctctggtgacatttactctctggaactgcacagttctaacaacaacagaaaagggagcttgatgggtttaccttcctcttaaagacttagatgttggcagtacaaataggcaagtgaaaagagtgcagtgtagtttgttttcatccttcctttaatacgtaattttggtggatggaacaggtgctttccaaaactaggtctagtcgatgaaagggtcctgagggcagacgaagtgtgaaagctcccaggagaattcatagagatgcccttccaattaggatgtaatatttacaggatggaatttccaccagaactactaataaagtgctggctcttatttctaggcatctgaacagctgggagggaagtggggtcagttcttggctacccacgggtggaggtccctgagtgtttttaaacctcagggtggtttttctaattacctaacagactctttagccgaatctaaagccaaaatccttgctgcgtggcatatggttctcctccttcctattgctctgaccatattttccaccacgttgctccaatcacacaggtcttcttgatccttcttgaacacagagcaagaagaagggtgaaaccggtgaggcaggattatgcaattgcaagcttagattttcatcttaaaattgatatttgactttttgcttttgcagatttttttcctgcattaatattgattttaaaatatttcagcaaatgaaaacaaagttttagcaaacccccgttaaatcttacaccttaagcgagtgtctcattcaatcttctcagccctgcctgaatgtgccaagcgtgcctgtgccttttcacctgccatttcctctgcctgcagcagcccttccctgctattcacagtactcactccctcacttcacccaggtttccgcttatattgcaccttccagaaaggaccttcttgaccgtctgtaaaatacaacactctatcgccttttcctgttttgttacctctcatagcacttatcactgcctgacattatagctcacatttatttgtttattgtccctatttagtagattgtgagttctaggatggcaagatctttattttaggcactaaaatagcacagtgcctagaacagtagcgagcacagagtaatacgcagtcaatgttggttgaaaggtataaatagtcaaccatccaccagtaccttctcagggagtccacaggccacacaatatttacaggctgaatccaagcccctgtttcccaggacccactccctcatgaggctcaccagtgagggtgggcaccactgggtttgctgctcttggatctttgctctaggaataaggagtcccagagatatctccttgtctctggtatgtaagattatttttgttagcttccagtcttgttgctcagccaaaagcaagggctaattctagcacgtatagttttcaaatcacttttggaaatgtaatatcacccacctttccctttccagtttcttcttcttcctttccaaataacttaatccttaattctcctaaaacccactttcaaatatatgcaaataaaaattacttggtaaggatggaaaattaacttgaggcttttttacttttttttttttttttttttggtctgttgagaaaagggcttgtagggtggtgcctgcataaactggccataaaaatatgggacaataagttgttgaaagccacaagaggcctctgaggaggaaagcctcctaaatgccatcatgttcccaggctcagagcgagatctgctctcttatctgtaaacactgtgttcaaaggagaaagactctgctttgaagcattgaaatgtggccagatatgctggctcctagtgaggcccactccccccagctgctctccgataaattaaagaataaatcagtagttaattttatgctgcttcagcacaaagaaaatttacctaaactgccattgctatagattaggtgtatgacacaccgcccccctttcaccgtttcacccctgaacatctgcttcttagagctaagtgattgtactcaacaaatagtgtggagaccagagcttggcgcctttgcagcctccattttacacttggccccctggcactccactctttatgcactcttaacctgtctattctcattcgtttgtcgccaccggacttcgggtaccctacgggtggtgctgaggctggtccccaacattggtctaatggctgagtatattgtgtgagcaccatttattcatgtctgaaaccctataatttgactagccccatatttacccatttttagtgataatttgaaaaaacattgatgattgagagaaggaacaatagctatgttgctcatcattggacatttagagcctagaatggtgcctgccacaaagcagggctcaaaaatatcagttgaagaaaaataaatgtgttaaacgaatgaaagtaagttaagcaaatgcttatcatcagagtgaagaggcagtgggggccaatataatttatttacaaagtaggcaaagggagttaggaggaagcagcctggtacggaggaaagtgcattgaagcaggcatcaggagacttagctcatgactggagaagttcttaaaaccatgactctaggcagaccttcatttctagctgtagaattttggccagggtcctttgtggagctatgtttttttattatctgaaatatggggatgatttccaacttcaagggtaggttaagataatataagtcaagggcttaaatgggtgcggctcaaagattattattgctgctgtcttaaatgggattataatctggtctcagctgataaaccagtattgcaactatattttcttttttattctgttgctagtttgtggtctctgatatggcaattagcttccttgggcctatgctctttcctcagaaaagaaagttttattttaacattatctagcatagtgtcttgggcacacacacacagggacagttaaatgtaggaaacaatgaattagaagaagtaaaagaaaggagaagaagtaaaagaaaggaaaaattgagaaggagagaaagacagcagcgatgctctgtaattattgctataagaattacgtgcccatttcatggatttgtatggcttaggttgagagagatgaataaaatatctttgatataattaaaatcataatataaataatattttttctatatctcccctctttgctgaaagctgttgggtgagacatcacaatgaccacttctatgtaaaaggtagattatagatggccctctgcatatgtgggattgcatctgcattcaaccaactaactgtgaatcaaaaatatttttaaaaaattgtgtctgtactgaacatgtacagacttttttcttactattattccctaaacaatacagtataacaactatttacctagcacttacattgtactagacattgtaagtaacctagagatgatttaaaatgcacaggaagatgtgtataggttacatgcaaatactatgccattttatattgaggacttgaggattttgccatccatgggaggtcctggaaccaatcaatcccccacagatgctgaggaatgactgtacttgataaatgtctcttgaatcatccaaaaaaaagaaaaagccaatggtttcaatttaaactgaggtaagaattgttttttttttttctgaaaatatatgatgttctatttatatataataggaaaacgacttcaagcagcaatcgtcacttgccaggcatcaaggcggatatttccattatgtctatgacaaggtggtgggaggggtgggatgtggtttcatacctttctggtgcatgtttgaatgattgtaaaaattagaaacacactgaggctgttatgacagccttgccttttgaaaccttctaattaatgccttgggttgtctagagagcttgttctgttagctaaatggtgatttgtaaggttctccttgatttcctcatcattcatggatgaaataattggggaaataaaatgattggggaaataaatgcacaccacgtctgtggtggctagcagtcactgagagaattacttgatgggaatttgattgacttgtgtgtataatgcaacctcttatatctctggccccatcttattatgtgtgtgtgtgtgtgagagagagagagagagacagggagagagggaggatgctcgtgtttgcttgcactatggagaacagtgcttcttaaactttaatgtgtgtatacagatcacctgggtaatcttattaagcacagattttaatgcacgtccggggtggtatctcagatcgtgcacttctaacaagctcccagatgatctcatgctgcagatatgtgtacctcactatagagtatagagcaaggctctaggaaatatttacggttccttgctgagtaatcatggtatctgtttacctatctcttccaaatggtcttcccaaacttagctcagttctcttcaagacaggaaattttgttaacccaaagtattaatgtaagtgaaagggtggataccccaactaaggattagaagagaaaactgtatcccatcagacaatgctgctccgggtttcagatgccccttcttcctgtcccttactttactgcatacccccaaggcagatggaaaaaaacataggtaaaatttaacttgtcataatatttatccccctttctgagaggtgacctccaatggaagcagaaggatgtgaatgattttaatccacggtaacaatggggagccagtcctgaccatcttaagcagtataaatgtataaaatgacagatttttctgctctgcctctccactttctcctcccggatactgagagagacacatattcatgcacccacaactcacactataatgcacaatgaaatttcacccagcctttatctcggggctgctgttctcatgattaatgccctactggctgggaagctattccactgaagacagacaaggagagaggaagatgcatgaaatatatctctgaggccatttctcattattattattatcattattagttccttactaccctatctatctatcctgttagaggatgcttgatctattggcaagggggaggggatgacatttgaaagcaggttttatgagggagaaatgaacaaggacaaagagagaaatagacagtttttatgaaagagaattaacctggatggggtttttgttatgattgttgtcctttatttgggggtttgtttgttttattgttgctgttgttttccatttaaagtcaaaaataatagatgcctccatctgcggcttctgatttttttccctagggatttatttttgcatgtgttcttttgtctttattgagtctctgtctgctagaatcaatatgatataacttatgcaaattatatccctgaccacttatgcaaaaaacagaataatttcgttgctctgtaacactcttaatataattacctccatatcctggttgatttcaagcttttgaaagggctactttaaaaaaaaataataaaaatctatttatgtgttgtataaaccacagtgtctgattctctcctgtttctcattcaaagaaagggtgactgctaaatgatttctggctctgtcatttaagaagactgcacagcagtggtcttagttgggaagttgggaccacaataagagtgctattgtaacacgtgtctactgataaaatggcaaattcattagcctagacaaggagtactatgatctggtttcaaaaatgctgtatacttccacagtccagtttatgagggcatgagatatataactgaggtgcccccatgttacttcaattttagtttgactttgaatttcattaaaaaatatttgagttatttgagtgcctagtatgggctaagtactgtcctgggcacttgaacaacatcagtaaacagacaaaaaccctcttttcttatggagaacattttctattccacaaacattgggtgtctcataagtgcaagactttggagaaataaagaatgaaatagaaatttttctgctttagaggaacacacagtctggtactgttcttaaatattttcagactacaagcggactcacttgcagcccagttttttacaaaaactttagcatgctgattggctagtacagttgcaaaggcagcagccatctatatttacagaggtctattccaagaatagggtctttaatttctattcaaaaaagaccaaatttcaaatgtaaacaatatatgttttgactaaaaaagacagaaaccgtaaagcaagttacaataaagtgattgaaacatatttcggtcctggagactaaatttgcaatgtttatggcaaatatcttcttgtgttggtttgagattatagttttatggaatgtttatattggaagaatctcagagattgagccccacacaaccagatgagcttcagagatgggccattctggtttcaagtactagtttcattgctcaaagctctacgtccaggggcaaattgctcaaccactttataaaaaatgtaaacaacaggtaatttcacattttaatttatttttatctaaacaatatattcacatagtttatttttagtgtatatatgtatatatatttatttcttatttatttcttatttatatatttatttatagagatgaggtcttactttatttcccaggttggtctcaaactcctgggctcaagtgatcctcctgcgttggagtgctgggattagaggtgtgagccactgtggttggcctaagtaatacagccacacaatttaaaaccttgaactgtgcctagatatcccctttggggaaaaggcatcaccttagttgctagagtgctggctgatggctgttggctaaatccttcacgaagaactgcctttgactattgaagccaccttgcccaaccaaggtcaagccccttcctgaagggtggcccatatccaattaatgatggtgaagggtggcccatatccaattaatgatggatgatggagctggggggatctatcaagactcagcccattgtctcaagactggataactgggaagggccttttagctagagagtttcctaaggccagctgaggtctctattgcatgaatgttcacctcccccttctgcccagactctgatgtcactctccccaaacttcccaaacacgataccgggcctcagactttgttttctgaaaacgcagctgaagatagatagatagcatcgtgagacttaaaataagaaaacaacaataacaaaagaaaaacagtagtatctttctaaccttgccctaaagtcctgctctatactggtaacccttttatatccttttcagacatttcccttcatagttctagcaatatgcttgcatttctatttcttgactttttcagtttgacatattaactaatgacttctgcttctggaagtaaaagttgagctttctcatgctctccctgccctacaacccacacacacttttttaccttccagtttcccagtaaaattctatcgcatttcgattaaataaatgttcagagtttgttattatgactttgtaatatcgcctattgaaaacaatgtaagatcatacatgaactgacttgttccacaactattcaccagctgcatagaatgtgccagacactgttctagagactgaggatacagcagtgaaaaacaacagactatatttctacctctgacaaaacattatactgttatgacaatttctgttttcctgtaactctttgtttgttaatgaataccctcgttatctcgttagcttatttttctagccacccatcagtgccacagccaacagctacaaaagacctcacaagataaaccgacaggactccattatttctttttctgtcttggaggtctcccttctggagtcgtctgacctcctgctttagtctgggctgggcgctcgctgagcctgcctcacagctatcatcctgcgtcttccttgctcgtcatgctggaaaatccctgggccctgctcctgtattaaatcctagtttcagctctatttatttcctcattttcaaggtgcacattgtcctgtagcctcctgagaaaggatagctaaaaagtaaaatcattgagacattgctcatctgaagaatgttttattccattctcacccttgacgataatttgcctgggaaggacttgtatcttggaaattatcttcactaataaatttaaaagcatccgtccaatgtttttgggcatccaatgttgcagctgttgacatcacagtttggtgtctaattccttgactgcactgatttttacttttttttttttttttttttttttttaccctctctctgaaatatccttatcagtggacctcaaagtagcacttacaactcaggtctcttgaaccacatgctgctgccccctatagttcttgcttttgtaaagttgtggttatttgccgattagctgccctgtgttggcatcctgactttggtatgatttgatgagctaagctattactaaactataacacacacacatacacacaaaaaatgaatagctataattaattagcataaagttttgagggtaaccaactttagtagagatctgagatatatataatgtatatatatatatatatatttgaacattttgccttgggttagagagggaattggtggtacagtaattcttactggaattgtgtagtgatagctagtttatatatacatatatatatacatacatatacatatacatatgtatgtatatataaactagctatcactacacaattccactaagaattactgtaccaccaattccctctctaacccaaggcaaaatgttcaactcttttttgtattcccttaagagcccttattttttttttcagtttcaccaatcatgttcatttcttagccacctcagaaagaatgagaattaaataatatgtataaaccctttgaattttttacatccagaaatgagcataagctcattcctctgcttcacaccagatgcttatatttttgagaggagcaaggattagaattgtcactctggaatttttatgctacaaaatgtcaatcaatatgtttgcatgtcactgggttccatcctacagtgtttggtgataaagtcttttcatttggctcccagctttatcaccataatatatttatttactttaccttacatgtgctagttggtagaagctgtagaaaaagaattactcccacatatttctttcccctaaagagaaacaatatattgtaagaacacagatggggctccacacaaaaagaatgccgaattaatgttggatggatgtacatatacaagaacttgctatcagtacacaattccaataggaattatatatacacacactgaaaatagaatttgattaaataattacactaggtacaagctacattttacttccattgaaggagagctaagtggaaactagtgtgagacaatcatgaatagaaaagtgcagaaggaatttgatgaggatgttcccagggctatttctagccagaaaacgaagctggaggctttgaagtaaatcaaaatatttgaagaagtaagaggataaatagcaaaactcacttccaacatcatactaaaagcaccatgcaaccatatagaaaacatgcataatttattttgactcaaataactatagggagattcttgttttttttaattaggagatttgaggtaactgtctagactacctatttttatgttgcattcagcaatatgtctgctaataattagagggaaataaattacataaaacaatgccagtcatgtcattgataaaaaggaaattaaagtgtgattgtgtttctctttctctctctccctcattttcagtgagctacatcctcttgttgtcctcctcacctgattaggcatttttgtaagggagtttgcctccgtcctctgttgtaaacattttccttacctcagcatcctttttaaattcaaaagacactttcctttgcaatgcactatgaaaggcgattgtgttagagaatatcagagatggctttgtcatgtctggtgctcttaaatccttttcttttttttcttttcttttcttgagacggtgtctcactccgtcacccaggctggagggcagtggcgtgatcggggctcactgcaacctctgcctcccaggttcacgccattctcctgcctcagcctcctgagtagctgggactacaggtgcccaccaccgcacctggccaattttttgtatttttagtagagatggggtttcaccgtgttagccaggatggtctcgatctcctgacctcgtgatccacccacctcagcctcccaaagagctgggattacaggcgtgagccactgtgcccagcctcttaaatcctgttgtgtcctaaagagtccactaaacgaggttgagggtatgatttgacaattgaacaaggcctcagccagctctcctagactgccccaaaactccctgagcagagagacccaggtggtgatggaagtatttttcctctaaaagactgtggagattctggcaaacctatattttgggtttagctttcaaggaagaggtggcatttgaaaagccaggggcctttgtagccattttattcactacctaatgtgaaggtggtggcagggaatggaaaagggaagattatttagtcgataaacacttaatggccactgcctgctgtgtggacagatctggatagagttaaaaagataataaagcaagtgtaggatgcctgtcttcatggtacttatatcatgggaagaaggcatgaacaaaccaattttacacataattattcaatcacaatcatgacacagtgtgataaaggaggacaggcttctaagacagcagaaaaggacctgaggtagtgttgtcatctggggaagctttcttgtagaagcagtatagaagctgtcctgtgcaggatgagatattagattgcaaaagaggacaagggccagtgttcccgccaaaggaaatagcctatgctgaggccctgctgtagggatcatactgtatcgcgttcctctggctttggactacgcattgatgctaaagtctggaagcataccatattcgaccaagtaaagtgaccagttaaggtccccacttaatgggctaaagataggtcattccaagagtgagcctcccattattatgactcatgacaaaggggtgtgggactggttggaaaagagtttccaaagctggactgcatcacatggtcatgtggaatgggctgcctgctctcccagtctgaaccctacctctgtgctatgccaaaggtgcagatccccttagtgaaaattggagacatgaatcatttaaggcaatgcctcacagacccatgtgcaaggttccatggaatgtgttaatatatcacactcatctcaattttgcacggtacatgaaactatgcttgctgatgagggaccatacacattgaacagatcatataatggttatggatgtaatgtcaataatgtcatggaacctatcatatgttgtaatatcaagaaaccttttagcatgtacatttgtctaggtttctggactttacagccttctggtatttcacttgcttgtgtctttcattgaacactaataaccagaaatcagcaacgtgaaaatttgattcttcttcctatttttctcatgccttactttggtctttctttctgcttggtggaaactgcggagttcagtggaagttttcctgcagtctaattagcccctctgtttaattttgtaataaaaacgctgaaccagaagctggagataatgtgcccaattcaattcacagatgtcaatttctttttaattgtaatccttttcttgagttcttcccactcttacttccctggcacagctgaggcttgggtgattacaaaactttcatgcctacgctggagattatgcctcctgctttaggattaaattcattcgttatcattgttgtaattattagtagtaacaatgggcatttccacccaaacctgatgaatagtagttttcacagtctttgcctccaaacttagcttatttcagttctttgcccagataagttcttcactctttaatggcagggagcattccgttttctgttgcatttaaatgctattttgagatcattcagaagacaaggctctttttcctttttagcaggttctcctgggtgtggagagatggcttctttccccagagtaggagtcaccacttagtgaatgctaatggggtcttttcttcgtgatgcgactgctgctttgaagatgcatttgaactggcaaggggcacctcttagctgcaatctcttccttagaagggtgccagctccaggccctaaaaagcacacatagctttgacttccatgctgactccaaaagaaccttttctctgcctttttgatggagtagtccctaccactaacagaacagcagtgtggcccaaccaacttgaaaatggaactggctcctcagcaacatgctaattctttcaaacttccttgtcagactcaaacctcgatgtgtcttttgttcttaaactgcatttgtagtaagatcttcaggaaaagcaatcagtgagagactgggtcaggcttttatttaattactttgcactttttttccccctctgaaccttctccaaatcaaaagaaagcaatgcagtttaattctgaatatatgaaatgtttgcactttaaattataaatgtctctcaacgataacaccttctgaaaataatgctccgtgggctctttagaagaatatttaggacagttcatctcaggtttaaggtgcccaagctactatagtgccctttcttatcttggttttatgtttttccactatggcttactgatataatttcctaatccttcttatctcaaatgtctcttagaccgttaaacctttgcctataaaatgaaggggtttgactttgaatctaaaggagtggaccatccctcaagcaccctagtctctcagcgcattcattccacaaacatttttttgggagagcagggtgattcctgctatggacccatcacccttgtagactctgaggctgcaatgaaaatacaataaaatcagtaattctagttcttatggaacatacattctgggagtgggggcagagactaccgataaataaattagcaagagaatataatatgcagggacaagtgctatcaagaaaataaacctgcgcaatgtcacacagaatgcctgatgggtgggtaggtagtttaggggaagttactctaaggaagaaacatttaacctgagattggaatgataaaacatgtcaggtctgtgaagtctgggggaagaacatttacagcagagggaacggttagtgtaaaggcctttaggctggaacatgttgagcagtgtttgaaagatgatgaatatggctgtagcagaagaaatctggtgtgaggtaagatctgagaagtggcagggactgaaacagacagggcctgtttggctgtggaaagcagtttaggttttataaaagtgcaatggcaaactattagaacgtactaagtaaaggagtgacatgatgtgacttatgttttttaaagattactctgccatgttgagaaaatattgtaaagcagcaagagaggaggcagagagacctaatacatggctattgctttaattctgatgaagtttgattgtggtttgaactagtatagcagccaggcccccactacaggcccacccagcttgatggcctcaccctgcatcttgtcctgtctctgaactgctaaatctcaaaactttaaagccctaatatcttgctgattaaccataatttccaaatcttatgcttaagtccaggcagtttttaatttttttttattttttggcttcagcaaatttttcatttgtctatatctataaagtacttctcatcatcaacccagattcctttttctctctgttgtgttcattctagatcattccaaatggtctctgttccttctgccttcaacctggtcttagaagacttctctgttttttatctctcccccattccacctccaactcttgatcagcacctatttcaaactctcaacttggtctcctttttcactttttacacacttggattttaaatgttaccttcttttagaaaacaatgctgaccagtcatgagtttctttgaattcctccatgcttatccacatcagtccttactttaggggaatcccttcgtccctttgtttgaaatcttatgctaattatctcttcactcgggtctcttcccaaggtttggacatcatttagtgttctcattttccactggtgccattaatatcatcccgtcatcatagacatatatgtgtgtgtgtgtgtgtgtgtgtgtacatatatatgtatgtatgtgtatatgtatgtgtatgtatacacgcgtgtgtatatatatgtatatatacacatatatgtgtattgtgtgtatgtgtatatatatgtgtgtgtatatatatgtgtgtatatatatatatatatacctttcccatttcaaaaacaaaatcaaaacaaaaaaggcaattatctatgaacctgatttctgtcccttctattagcacttactgtccccagatgaggacactctttcacttccccatatgctcaaatatcctgaattttatactctcactgattttactttctaaacaaggaatatatacgtattgtagaaaaaaatcactgtgaagtaaattccacccgtgatccaaccctccagagaaaatcgtgcataaaaggtcccgcagattcccacctgtctttctttccttccttatctaccaatattttttcacatgcatgcaacattctagtcataccttgttatactttcagacatgttctttctacttgagcacatacaacatacaacttgagcatgcttgtttatctataaaatgaagataatatgatcatttctgtaggagttttgagtcaaaaataaatttatgtatttcaaatgcttagaatagtgtctgttgcatagtgacctttcaataaaaattattattattattgctcttttgtccactttatctacctggaaaagtaataatccctcaagactaagttgaaatataacatccctggggagtgtattagtctgttctcacactgctaataaagacatacctgagactgggtaatttataaaggaaagaggtttaatagactcagagttccacatggctagggaggcctcacaatcatggtggaaggcaaaggggaagaaagacacgttttacatgtcagcaggcaagagtgtgtgtgcaggcgagctcccatttataaaaccatcagatctcttgagacttattcactactgtaagaacaatatgggggaaactgtccccatgattcagttatctcctccttaataatccccttgatgcatggggattattacaattccaggtgagatttgggcggggacacaaccaaaccatatcagggagttatccttctcctctgccatcctgtttcactctgccaggctccttttctcagtgcctccacaagtggtttacttgttgtgatgaacactatgcacagcagagagtttaaggaccttagtcatgtttcctaccaatcagcggttggcttcctattaaacctttctcgatgttctggacctctagagagccattctgtgctgctatgcaatctataatgactcttcaactaggtttctattcatttccaagtcttccctaccactgagatacttcaaggagatatgagtggatcatgaataaatatcctaaaactaaagacagttaagtcaattgcactctcaatattatcagactattttaactaatatgctatagacaaataattcttcagaatggtgtttgctttgtgtgtgtcataagagattcttgtctttagagaattagggaataatattaaaatgaataaatagtaaaggtgggaatatttttaatattattaaaataaataaatgattaaagtagggagcatgtttgaaggtccattttaaaaaatatatgtagacagaggaaacctaagagttaaaatactgagtgagttttgctctgcatcagtggaggctataaaatgcagtatttatctgtatatgagttctataccaatgtgatctatctctctaattagatagtcaactatttttaaagagctgcaaataagccttacaagaatgtcataaatgcattccatttagaaacatcttgcagataaattgtatttttattcttcctgcagcctcctgtagccttaaaagaataacaaaaaataaattcttactacctaattccagacacagatcattactaccagtagtatgttaatcatgcttgccattccttctccttcgatatcattatgctttaggatagaaaaggtgggtggtatgtgagcctccttggataaacaaaacgttggagtgcacaggcttctcaagaggtacaatgttattttcatgcaaaaaaatcccaagtattacaaaggggcttgaaaatgttgaaaacacattgtgaataagtagaattactaacaagagcactgtatcttttgcttcgataggctctttcaagatgtagacaaattggaggtaggccagacagaatctacgggaatgattaggggaattgaaggaatgacttcggaaaaaagattaaaagagctaaatacgtataggttggctaagtgccaactcagagaaaatgacattatgggctatagatatttgaaagtggctggctataagcaaagcaagggattacttaggtaattggattaaatcaagggggtaaacattttaaactcaatatctggatttattttgttgactataagaattattagattttagaactatcccataacctactgcttggattaaagcaagaggtagggtgtggtagcatgaagtctctaatagtttacccagttctgagcatcttgttgccaggaagcagatcttactcacttttaatccctaggatttagcacattaaaagaactccatagagagctaagtcatgtttagttcagcgagaagaaaatggtctgtggagtcagacattacagattttatatctctgctgttttattgttctataacagtcagcaagttacttaacctaagccttatccataaggtgcgtattaatatcaactttataggattgatgtgaagtttacatgagttgtcttgatctcttcttttacctatttaacagcggttaaatacacccctcctctccatcatcactgccattgtgttccttctgactttagtaatgtcttcaatggtttcctggattccaattttgcctatcttcaagtttccacaatatagtcaggaataactttttgcagcgcatgtatgagtaagcaagccctagcttaaaaactccaatggatcccattgcctgcaggataaaatcgaatatccttaggatgacaaacttcatgccatcatgcctgtctttctaattccaactcatattaccctacccttctcacataatgctctaactacattcacttgcttgagtttttcttttgtaccttgtacaaatgtataaacatgctggttcctctgctgagaacccactttccactccaatttgccatttctttgccactctttgtcttctgccttgcttcacactctttctaaaatgccaatctcagattttacctcttttgagattccaggtgcctctcccatgtgtttccacagtaaatggagcttatcattatcctgctattaattctactgtgttctaagtgtcttttcactctgcctctcctaatagatgttaggattcatttgggcagatacttagattagtgcctaccatttagtaggcattcaacatatttttagattcaaagaatgataaatggtagatggatagatggatggatgggtaggtaaaaagatatatggagtgtaacaaagtacctacaacataagaaattatcaattaatttcagttttctttccttggagttttgagattaagaaatgcacttcgttgtcccgaataagcatagtcttgagtgggctttagtcagagttatttgtgtgcatttatgtcgatactacccactccattctatcatattgggaaaataatgcaatctcgaaggaataggagtctaggaaacctaggatataagtgagcacataccggagaaaaatatgccaacatagtagcttggaggaaatacttggaaatatcttgcctttatagctagatatagaacttcattttttacaactagaagctttgtgacttctgagaccatgactgaagaaaaatggaaatgaagacaaaggggactgaaatgggagtggaagtaggaaaaggggatccatagacacaaaacaaacttttccttttacacactccatttccctctctggtgcttgcccatggcccagctatttaaccttaagacacatggccagcccccttgtctagagtttgccctaattgttgggcgcattgtagcgtcttagatgatcaattgctcatgccaaaagcagagtgttaagattcatgaaattcgagtctgtgctattaataacctgagcagggttttcatgcctccttcccctttgttttctcctttgccaagtctccattctcactcttttgtggatgtgtgtgttatggagacgaatgaaatttcagacacagcaatgaattgccacctaaaaggatacaccccagggtcttctgtgttcctttgcagctgtgtgataaattgccatctccaaaattaattgttaccttttcaggaagtgtttactcattttcatctcctcactggcatcagtgaacctctgagctagaaaaaccaactttcctttcccttctcaagcccttgatatgcagctagaacggcaatcagtggagctgacaagggcgagcagtggtacctccgtgttgttctctagcccatgaattcaatgaacatccaggctatgcctttcatctcaactgccttttaatagactaacccatttctctttacttttggctccacattaaaatgtctataaaattttactccaagctaggtcttccaggtttacggaagaaggaacatacattcagcaaaacagttttctctttttgttagatttctgctgttctcaagagctgaaaaaaagtgtgatacttcacatgtactctttaaaaaacttactaagcctgctcagcttttacacagggtacgccggcacacaagtgtgacctggtccttactccatcctcaaagataagttgtccccacagtctgccaaaaagatgtccctgatgcaatgagaatgagctggagtcctgactgtgctacatttttagtggtatcctaactctctattccacagacatcagaaaatgtcacaacatactctttgtaactagtccctttattatgtccatgaatgtaatatatacaatgattttcaaagagggtgatttttcacccctcttctctccctgccccacatacaaaggagactttgcctatgtctggaaacatttttggttgtcacaattgaaaaggaatgtatggaggtgttgctgttatccagtgagcagaggccacagatgctgctatacattttataatgcacatgaactctggaatatataaatcaagtaaatctcagtattctgccatgtactctgggagatacttaaaattataagccatgacttctattttccaagcattttggagaaaaacaaccaattttgtttttgatttctgactatatggtagagttcagctacacagtatatggtactttaacaaagctatacggtagctgcaagacaacaccatggctgggcccttcagagcctcataagtgtattggggacactgagaatctagtaatagactaacacatatgtaccaccattgagtggcatcaaacatgctttcatttagtgctgaaattgatgatataatggaggctagaaagatctaataatgaaaaaaagaggaatttaaccagtcttgaggtgatcaaatgaggaagcagaaaggtaggattgattgtaatgtgtgcacagaggagtgaagcctgattacctgtactactcattgccagaccttcaagaatcgcgtgccaagtgccaggtgcagaagttgcaaaactgtttgggagatcaaagagaaaatatcaacctggctttcaagtcttttcagggtgctttcttagaaaaactgtttttggtcttgaaacatgggcaaacattggctgcgggccaagaaatttatagttcctgaggaactttagattgatacatgtctgacaatttccattttgcaaaacaagagaaggcaaaagtgggcttggaaggcattcaatctttgatgttgtctttgcttcagctgagcagaagtgagaatttagacacactgagccattaccagagtttaagaaaacttaccatcagtgtggtttccccctttctctcagtcaagcacatgggtgtgtgtcattgtaaaaggactataggattggaagtggacacgtgaattccatttcttactctccactaactacctgagtgacattaggcaaacttgcaaatgtggaagttgggccgggctaggttatgttccgctctaaccttaaacactgatttccccattgactttcttgttccattcaaagagattaggaggaaaaaaaagtggtatatcccaggcacgttttgtgatatttcagtgaaatattgaaataagcaatgtcagcagcctcatgttctcgctaatggtctggtatactttatgaataaacaacactagctttatattactggatctcatttccagcagatttataaaattgtaactctacagtgttttctgacagagcttctggaaggggaaaaatgacagtgcagttgtttgctaacatctgggtgtactttttgcaacatggggagaattgttccaaggcagggagctaatctgattcatatctctacctagaagcacttaaagaagctgtcagatgattcccacagtgacaaatttgagtcccaaggagatgatggagtgaaatcagacacattttgggaagaaattcctactatcttttcaaaggataaactcccacagtatttgtgccaatctcttttacagcattcctatctcaaaaaccagagacttaggctaattttttttgtttctgttattctctaatatatttgtttaaaaaggaagttttaatgaaaagtcagtcatgtgacttagagaattaaatgtagggctctagcaaggatttgctttaaaatgtttctctccgatttagttgctgcacctgggtaataactaccttggaagtattagtgttgtttctctgtcataaaattgacatgcttggtgtggataagaatatttgattgtagaactgcttctacctaactgcattctgttatactaacaatttggctagcagaatttttttttaaaatcctccatttgcagctttttgtactctgatcacaatatattaaatcccccagaagaactactaccttgaatacaaagcacatagcggtgctcttttaattgatttgtaaaggttagttgctcagtactagtggaaagtttcatgattacttaattgaattacctgcttcccccagtagagtgcttactgggcaccatacagtaagctgagagttttacatgcctggtactattatttccccagtttacagattaggaaagcaagatgtagcttacaaaatatgctgaaagaccactggcataaaagccttttaattccttgctgaaaaactccctgggttttgaaatatgataaactacatttttgttgttctctgaagattcaggttcatatagtatgacagttttatttttgtgactctcaatcatatatgagataaatgatgggggaaagagaccgctttgaggtcaagcagacctatgtccaattctaacatcaaggagaagccacgtgctttggcaaagtttgtgtatttacactgttgggaaaactaaaagtaatttatataaagtacctagcatagtatctggcagggtaggtgttcagtaaatgttgctggtattatttttgctagtgataacattattcagccatataaacacatagcactaaggttaagcaaaatatgtattgacattacagcatgcctaggtatttattgcctaaaatatatttccgataagcttttcttagcatttgctgctttctactaagagttgagtgaaactacgatgaccacaatttagtctacttatttaaacctttaattggttggcttccggtaaattgcagtttgaatgactagcccaatcatgtatgagtagccgggaatattcgataggtatagaattcttcctgcctaatcaagtcagggataccgatgttaatttctgaaataaatactttctcctctcaagatctacccagtggttcgttgccccttgggatcacttctacttttcaacaaagagcaagggacagtaattgcaacttcagggtagaaggagagtttgcatgcctggcccagaatgaaataaatgtggaggaacagagcccaaatgacttgtatgtttcaggtacagctccatgtatgctgcagatgatttgggttaaaaaaaaaaattggccagcctaaactttgaggcaaagaaattgcatttcccaatgtctcatttctctttccttttactttacttcatctactgtgaatgacccttatttttttgttgttgctttatggcaataaataaacgaacccccattgtgcaaatattatgctcttctcattggcctggagggaaattgctacgagagaaatcctggacttttttcccctttttagaaggaaataccaggttacgaatggcccttctcagtctctagattgagactaggattcttctgtcacctcctcagagccctggatgcagaaagcaattcatttcacatgtgtgcaaatcagacacagaaattctgcaaggcacctcttggcagtaaaagtggactattaactctcaaattgctggcctctactgagaggcaacttctccctgaagccaggtgggagtgtccctttgaagccttacacaacccgacttctgttgctagggtagagtactttagagcaagagtagtcctgcggtatgttaactgagtaggtgtttcccagaaaattaaaagcaaaagtaactacctggaacagtctgatttttaaagcaaagcaggatctttgtacgtttaaaatttagtccagctacttgatagcctatagagcccccaactccttcttccagcccagggagagtctgcagtgagcaaggtaagaggtagctccagcattttcagcatggggttaggttggaagtcccagttgacagggacagtccttcctgctctcacctgccaaaatctctctcctcccaggagatagctcccttttctccctgattgcttcctctcatgaggagaaggtcattggcgctcaccacttccagggcaaccctttatgcaagcagtgggtgcctttgaaaggcaaaccgcagcaggaagactttgaaggcaagaagagactttttcatctttgcaggccccagccagaacattggttctcagtgcagtacaagcagtttcaaagttatctcccttgctgatatggatgtgataacatggagcggagaggtgccataatgatttcctttcaaatggctgcctcaccatttatctttgcacactgtcaaagactgatattgtcgggagttagcagtggcatggaataattaatctcgtacgggggaagtaagttcttcatttgtctcctgagaaattagcactgcattgacagcaaaagtagatgatatcatcggaaagggaaagggaggtgatctttgtaactccagatgccaaattgtaacattgattcagttctgtgaagttttgattgaacacctactatgtgccaggtgctagagatacagatacagattcctgtgctacagtagatcataatcccttgagggtcacagcttatttcaaaatccttgtcaccttgacaaaatgctcaagaccaccatggtgacatgtgtgccaccatcattattattatctaaagagttttaccaagtgtctgtatcattaatatttattgtaaaggctcaacttttataagaaagaatccttgtctcccacaccaccagtgcaaagtagattaacaaagttggcatttatttattttattttttctttaggggaaaatcaagaagttagtgatctagggctaatggggatattgtgttactcccaatatgtggttcccatatttggattcaagtttttcctattttccaatcagtgggaggagaaaaagaaaagcatgcctgcttatatcctattaaggccacacctgtctgcaaaacaggtgggatccatgtgaaccagaagcaagctattaaggatgcaagaaaatgtagtgactagttggatggccatataccttgcttaaaaccagttagggtcttttatttctgaaagaaagaagggaaactagatatttggggatgataagcaatctccccacagagattctgggtgaaatcctttttgcttctctgaatttccaataactcacctcttaaatgagagaattgaaggaggtgtgctgtgtagtccttttcaatttcaaagtcaaaataacaactctaggctcctcctccttcctcagcttctcccaggcagtaggcacagtgatgggctctgtgctgggaattttgttttgagcctgtttcttttatttggaaacatcaggtgctgaacctatcctggattcgagtgagtgcagggcatggctctaagaagcattttgtggaaagagtcaagcttgtcatcctcctcctttgaggcactaattgggctgactgggccaagcaaaacaatggtatgatccatgtgaaccaaaagcaaattattaggcttggagagtggtgggtagtcagagaagcacttctgttgtagacagaaaaacagcatcatgcttctcagaaagaaagggggctgctatctgggtggaaagcttagaatcaagggagaattatacatgtttttaatggaccgaggaagaagccagatttgtgtatgcggagtttgatagggaagggcttctcttctttttcctactaaaggaatagtgtttttgacaaggtgccaaaaatctaggccacagcatcccactttgtgccacagcatcccactttggtgagccataccaggttgcaggaaattaattgctttagactttgggctggctgagtggggcctgaagccaccgtagtccctgggcaagccccctcccactacacaggcctcctccatctccctcattttctctgtgtgctgtgatttggaaaaaattgacaagcacttgatagaggctaccaaccaattagaattggttcacacgagacacttgggaatgaactcagctggtcactatggtgatttaactaaattgtgttatccagacacattagtgaatcaagtctggcatttcaattttctctataagatgaattgtggaaagaagttcattataataattaaggaagatttatgcagtgagtacatttttatctctgtagcctgttataatgctggtattttgtgaccaaaaaaattgagttgtagatattaactatgtaattccacaaactgtgctcccgaacgagttatttatatagttagaatttaataaatggaaactttttgaatgcacctgcttaggaaaatattgaaagaaaacttactgtaagtttttcagcacagtgaacaatcatcccccagtgaacaaaatgctagccttaacccggtcagtaaattatttggccataggcagatatctcatctccctgtaaaggaaagccagtttcctccactgtaaaatgagtcttagtaggaaagggggcattagcaaagtaatccctgtgcctacccaatcgttctaatgtgatgtttcctttggaaaaaacctacaactcagaaatatattgaatgaaaatctccctattacaggaagacactgcgggttgctaaggagtgtggtttctgtggttggagtagagaaaaatagtggtgttttctgagatctcaactcaactgtgcagggtagatcgaatgaacacagcacaagccacagccactgttctgcttctgcctgatttgcttctccagaaatttcccagattacaacaatgccgaagtgcccattggctaccacggagataacttcataaattgttaaacaggcagagctcaggtttaaagaactgcctttattttgagctgtgattttacttgtgtttcagacattccctcagatattttatttaaaagatttcacaggagcatcatgcaaaatggtaaataataaaacattctataaaccacacatcccatctaggactaatcattatattttccaatttaacattcattccttccagatatgttcttactcgttctttaaaactatcataaatggaaagctaccatttaagcacaaataaaactcttaagaaagctaagaaaatctgaactcattaaatatttctaactagtgaactccttggttctccaaatgacctattttttcccttccttcttttttttttttttgtatttttagtagaaacagggtttcaacatgttagccagcctggtcttgaacacctgacctcgtgatccacctgcctcagcctctcaaagtgctgggattacaggcgtgagccactgagcccaccctccttccttccttttttaaattagaattttttattttttatttttttttttaattttttttttggttgcttttagccacctcagttaccttgaccatccgatttcacttactgtagccagatttctaaagtatgtgtttctgtggcttttccatagtttttttccccaatattttggcagtggttgaatagaatccttttattcctccctccctcacccctcccaatcagctccacctatagatatagaaatacaaagtgaacaaatgtgccatgcaacttctatttttgtgcccgttcttcctctttgtctctatttttgcctctagcacatagtatcctggtaaactggatttttttttaagagacatggagaacacagtgcagtgctcattctctctcagcctctctgtttttactgtaatgaatctattctacataccatgttctcaggatcccactgtatgtctgataaactaagtcaagctaaggtcattattaccaataagtaatcaataaactcaatgtttaccctaagtttgatacggtaacttagttattttaagaggaaattttaagttcttgtgtgtgtgagtaagaaggagcatgagaatagggaaagggccgtttcacagaagcggtcctatctggttggcctcaattgtgcctctcaggcttgtatctcatctgcttagctgtaaggccagtcctgttaggcaagaaaaaatttaatttgcaacctagtttatgaaaggataaattaagggaccttgtgggaatttaaatcatctaaggtaatagaacatgaaacttgcctagattaaaaactgggtcttttgtgaggtttcattcattatggccccataataatagctacatgtctatgcacttttgagcttgggtctgtttaaaatacttatttgttatttcacttaattcccacaataactgtacaaatatggttctcttgcctccatcttatatatgagaaaaattaggaacaaaaaaacttaagaaatttctttcactttctatagctgataaactttggagatcagtttgaacccatatactcttaaacactatttatacagtattaatgtgatttgacaaaagtggcataaagagcaatgactctttaagactcaaaagaagatgttcagatttatattttgatattaatattaatatcagcaagataagctgttaaataagcattacatgtaagaatcctgaccttggataaaattaaatctttgtcataaatctactactgtgacaaaactgcaaaatatgcagtgaataattaaatccagatgtctcttccggcaacagcagcagcaaaaactggaggtgggggtgaagggaagatggaagtgacagactccatattcataaaagctctgatgataaatttttttaaaaaaatgtgtttgttttaaataccagtcttccatgaatcctaagaattgcacagtaaaaaataaaatctgcctaccatttaacagcccgcaatacaaaaatcttactgtgtcaaatgtaatatgcatacctggcttcccaatttggttttcttaaggaggagtaatttagttgtcattaaactctttgggaaaccgttttaataatgttctttggttatcaggggtatcctttttttccttaaggcaaagaagagaaaacgtgccgctaaaacctttactgtgtgtggtaatgaagttggtccatttctgtgcaggattgcaacaattctttatcacttaacacgatcggaggtgtgagagcagacagtttctcaaactgcaggaaaatgctgaattcaccgattgctatcttgacacaatgaagggaccatacattatatgaagcccacatttggtttgctgttgttgttttttttttttttataactgtgattattttttgatggaataataatcacagaaaaaagaaaaacctgtaagagaagacaccactgtatcatctttttatggcaatatgcaagagggtagaaaaaatgagagtgtctaaatttatcttattttcctgtgggattttcagcacagacatattcctaccactacaaggaccaaggacattcacttgcctgcttgctctgataatggccagtagctggtcccaatgttgatacaattaattaaaatgataaacatgactctagctagcttcagcacagtaagagtaccacagcattttctggatcatttattcaagattcactgacttggagtcactgatggtaccaatcattttatgaaataccttccactagagacagaaaaacgttgttttgacaaattcatggtctgcacctcccccaaaccagtgcatttctaaacagacttgtttttcctctaaatagctttgccaatccggccaacaccccaatatttctttatattttgaaaagtaggtctttcacctgctgataatggaggatccaattctgtgtaaactctggaattctatttaaaattgcagattttaaatgtagggaccaagacaggatgtaggttgtgtcaacttgggaatgctgaatgactgaactgtcatgacatttacaatccagatgtcatggcaagctgggagacaagacagcttggttgataattagatggcagatgtccatgcagtctcacgtgatacacgttactttttgtatattcaagatttgggactttagccctgaaagataggtgatacatcatcttctctatacaataaaaaatagtttcaataattgtatattattttgttttgctttttttctcatttatttggaagtagcaaatacaagaaacaaaaattactcataacccctatttttggtgtatctctatgcaggcaaatatactgatgatgattattttcattttttgaaaatttagattctcacactcaattaaaaaaagaaagcctgaggaaattaaatgatttctaaaatcacccagctaattagtggcagaaatgagaccagattccagtctcttgctttcccgaataccttattctggaattcaattataagtacaaggcatcccactcttggcttcctttctgaataaatgcttgcaccaaatccccagtggcttcttgagaaagctggctacaaatcttcaaagcctcagttgaagaattcttattaagcctactaggtaccaaagcaatagcctgaagtttggaaaaattctagttggtgaagctagaattttattcaatttaaagaatacttggtaggggggaatgtaatgaattcactccctagcctttcttgaactctacctatttaacaccctatttctaatacagcagcttctcactatagaatgttaggtttatcaaatctctcttccaccctgttatacggcattttccatcccttggatgtttcaagtccaggaccttgggcttaaaggcaaaagtaaaatctattacacatttgtagctttgtacaccaatcagggaaaagtagtaaagtgggctattatgtacattattttacaatgcagtatgttagttgtcaattgttacgcaagactaattttttccacagcaaaaaataaagctattttaaaatattttggaagcaagtcatggttgaagagaagcatcccttgaaaaattagacttaaagctgcaaacttcccggggttgacattagcttgaacttgatgaaaaaggaaaaattttaggaggatttgttcagctgtcttctgagttatgaaagcaggaagaaatgagttttacatattgcctggaggtaatttgtgtacatataagtcaaaaacaattaaacttcaaacttcacacacagccactgtcctgtaaagggtggtagtgtataagcagaagaaaaatgactagaagagaacagggttataaagcatccagacatttcccatgtgaggatcttgaaaaacttctgcagccctgtgactggattctttctcctgatctaatagggctgtttggaggaagtatttctactgctcttgagttgttgctagttttcctttgaatatcctgctcagttccctgccccagttcaagcttccttccaaaatgtgtttaaaataattagctcttcctgttggtataggaaaaaattagtcacacataattggtaattcacatattgtattataaaataatgtacaaaattaccacccttacttctttttggagggcctgtggcttgtaccaatggatttatcttgttccagggcattgagaaattttgccttactgatggcatcaccacttacatttctcaacatctttgcctcccatcagaccaggatttcagttactaggtatcctaccttgttccattgatctgagaccctcattaataccctagctgacagtcttaactcagcactgtcttctattttctaccaaatagaatacaataatcagatacattttactctctcttctgaataaagatattaacaaaatttccatgagtacttataagggtgagtttccagaccaacctagatgagttaccaggatatatagtttgaaatattaactttaaacatttcttgatttttctgaccccatcaggtattttttggaaactggtattaggcttgtagaaatggacaaggagctctaccatgcttgaagatggtttaagccttcagcaaaataattgagagcttcctcttctgaatattccgaatacacaggtctatcagttagtgtatcatgttatgtgtagatgtgtgttggggtgatcagatccaacaccaggtcgtgggggtgacaaaggccggcaattcaaaggaatgagaaaaagacagtttgagagagaaagtgggaccagggggccatcgcgagtgtggaggctgtgaaggccccaagttctgggagcccatgttatttatgggtgctcaaacaggtggtgaggatgtcgagtgaatgagaaacatatggctgtttgacataatgggagtactagaagcaagaagccagcaagtctagcagacatgcaagccctgcctcagcttctctcccaacactcagcttttctccaacagatgtgtatgaataaggcttattaataacaaagcctggctccacaggtgagagggaagatgtaacttaatctactggaagtcaccaacatagccctctaaaatgagtcattattttgactcaaaaatgaacagattaaaaaatgtttcagctaatcctcttagctatttgatgtacatcaagcatccagatgttcacaacatccaagctgcaattttttgtgtgttatttaaaagttttacacttgcatatattattcctttcctcaaagacaaagtatagaacccaaactggactttttaaattcactccttaaaagtgtggtaacttaccattccagagctggtgggtccccgattattggcccatgggttgtccactttgtggttttgctgttaggaaatgttggctgatggcttccttaaccactcagcagttaaccaacaataacttggaatgtgtctaataagtgcagcctaatcttaattttattgggagttatctcagctaaataatggaaaatttgacaaacctaattaatgaattatccactgttaaatcttctgtgccactgagtcctctttttagtaaaatgattaaaaacattaactatagtggtatataattactattaacaactattatgccaatatatattgttattcctgcctaagatactatgtctcagcacggagtttatattaggtattttattttaacagttttctaattgctgccactttttcgtcagattgcatattttgacccacaacattgatttcaccttaatgtcaccagtgggaattaattatctgaagcttggcataatattaattaaatccatatgtcacatcatggtgtggcattcttttctttctttcttttttttttttaagtcagggtctccctatattgccatgctggtctcaaactcctgagctcaagcagtcctccctggttggcctctcaaagtgctgggattacaggtgtgagccaccatgcccagcccattgtgcagtgttcttacaaaagtattctaacaatccaaaatcaagactacttccaaaagtggcaggcttcatatagaatccaacattctgttgcaatgagattgggatgagtgggtttagaccaacattgatatcaaaggccagtttccctttaaatcaaaatcacctgtaaactagcatcttgacattcaagatcccaccagggggatctagctgggaatgtcaccatgcatgtcttgagagagtgcattagcccacctgcagtaggttgaaaaatatcttccaaggataatttcttaagctgtatattttaccttatttagaaaaagggtctttgtgagtgtgattaagttaaggaccttgagatgaggaaataatcctggattatctgagtgggccctaaatatcctcaaaagtgtccttataagagtgaggcagagggggcatttcccccgccacacacacacacacacacacacacacacacacacacacagaggagaaggtgatggaggcagatactggagtgaagcagccacaagccaaggaatgctgacagctgccagaacagtcaagaaacagattctcttttagggtcttcagagagaatgtggccctgctgatgtcttggtttcagctcaatgatactaatttcaaatttctggcctccagaactatgagaaaataaatgtgtttttgttttgttttgtttttttgagacagagtttcactcttgtcacccaggctggagtgcagtggtgcgatcttggctcactgcaacctccgcctcccgtcttcaagtgtttctcctgcctcagcctcccaagtagctgggattacaggtgctcaccaccacgcccagctaatttttgtatttttaatagagacagggtttcaccatgttggtcaggctgatctagaactcctgaccccaagtgatccatctgcctcggcctccccaagtgctgggattacagacatgagccactgcgcccagccaaatgtgttcattttaagtcactcactttgtgccaatttgttatagcagccacaggaaactaatacaatacttgtgccaacttaagtaacagcaccagccaaagtacataaagtggaaataaaggtatttttagaaagtctcattactataaaatatggtgtaaataaaaacagatctgaatatgcaaattgaagtttcaaaataagtctcctgccatcccatttcaaagacactggaaatcttaagctcttttctttacaaattctgaaactatcattgcctgtgggttgggttgaaatgaaggcacgtgggtgtttcaagggtatgttctgtgacaaagagacagaatagaaaaatccaaagtcatagcctggagctaatacagtaatatgaatacataaaacaggaaggacaagaatataaaagtgaatttggggacctgagaaagtcaagaaaatgattggagaaatacaatttgggagaccactttagaacccagccctcactgggcatggtggctcacgcctgtaatctcagcattttgggaggctgaggcaggtggatcacctgaggtcaggagtttgagaccagcctggccaacatggtgaaacccgtctctactaaaagtacaaaaattagccaggcatggtggtgggcatctgtaacgccagctactcaggaggctgaggcaggagaatcactggaacccaggaggcggaggttgcagtgagctgagatcatgccactgcactgcactgcagcctgggtgacagaacgagactctgcctcaaaaaaaaaaaaaaaaaaaaaaaaaaaaagaacccaggcctccaatggtgcgatcaggtgccaggtactcttgtctactgtgctgaccatatgctgttgaggtcatcaccagctacgggaaagggcattctcataggggcaagcccaactctatgtatcttacgttatttaccactatttcccaaataaacctgtttcaaagaataccatctttaatgtctttcacaggtacctatcctccactctgcatccttttccatgctatcacttgcagtgaaggtctgttcaccccttttttaacctgtcttccatcttgagttccaatttccagctgccctctgaatatgtccagaggatgctggctgctgcctcagactcactggatgaaacagtttcctgttttctttactaaaactgccaaccttccttttccttgtttgagttagtgtatcactgtcctctagcccctgagctgaaaccttggaatcatctttcactcctccctccccctttatattcagtcaactgacagtaccaatatttcttctcttctccttttatttcttttgccactgtcctactttgggcactaatctctcttctgaagtataacaatagcctcccaactggccactctgctttagctgctccatggtccaatctcccttgtcacatgtgttatctttcccaaacactgtcacaacttgtcagtctactgcaaaactttccgtgactcctggggggcctgcaggagagagtttcagatttctgagtctgccttcctggctcttcacaatgcagcctgagtccatcttttcaaccgtctctctggatacataccaacacttgccctttgtctcaatgaatgtgcctgccacttttgtatctccttacctttactcatattgtggtttaactatgtggttgtcttctccaccctgacaatagatacatctattgtccatcagcccaatttacaacttttgcatctcttctgatttctatcctctgctaatgacacttattaactactgcctttccactggactttgcatttagttttttatatatatatatatatatatatatatatatatatatatatatatatatatatataaccttacttctgcttttaaacatagatcattatttccatgtctaccttccactttctccaacactagattgcaaatttctacagggtgaagcttatgttttcatcccttaacacccagcttaaatgtcacctcacatactgactaatgctttttatctcagttctaaaacattattaatgtacatcacataatttaactccattttgaaaattagttcttgttccagtatcttatctcttaaaatagactggaaccatctcaaggttagagaggatccactatattaaattcttatatatccctcagtagatggcactttgttggatgatttaattgacgtatcttcttaaaaaataaaaatatctggctcttcaaataattagctttgtgacctgaggcaaatcatttatcctctaggacatttagtttactacatggtgaaataaatgataccttcattccttaaatatatagatccagtgacatgttgctttgaatcacagaatttggtttcgtgctaaatctaagaccaaaaacagagcacaaacaattcagaatcaacagcatgctttctggaagcaatatgaaaggtgttattaatagaattcagcattattctaatttcctcttaaaatttcaagaaatatatctgacatttgtcctgtcattgtaagttgaaatatgtgtgtgtgtgtgtgtgtgtgcatgtatatataattttttgttgttgtttttgagacagtcttgctctgtcacccaggctggagtgcagtggcatgatcttggcttactgcaacctccgtcccccaggttcaagtgactctcatgcctcagcttcccgagtagctgggattacaggtgtgcatcaccacactcagctaagtttttgtatttttagtagagatggggttttgctatgttggccaggctggtctcaaactcctggcctcaagtgatctgcccacctcagcctcccacagtgctggtattacaggtgtgagccaccatacctggccaaaatgtgtatacattacacacacacacacacacacacacacacagagtatgtatacgtatatatctgtatataggtaagtgtgcttatatgtatatacacagacatatacacacacaacatatacatatagatttgttgtctagatattataagagtattgcactaatgtttctataaaacaccagttcacaggcttctgtcttctaacaatatccttatacatatttgtcagccactatttaccttaaaatgaaacagaggggagcctgatatataattacggtcactgtgctttgttctattttgtttatccctttgcaatatagtgtggcagacagaaaaatgtatgaaattaattcttttggtttagaatgacattcctatcattgttagaacaagggattacattatacactacctctaaactcaaattttctgagcactttaactattaaatagcaataacagaaagcattgtaaatcttttggagttttgcatgataatgtacctcttgttaattgaattgagagatgattgccctatgattacctcgattcatttgctgcataatttaccataatgataattaactccttgtactgaatgaggtaagatgtgtgttagttagacaccccctccctcccttcttgcctttccttctttccctccctattttagtgtttaaccattttacacacaatttgagacttgtttcagaatctctccacctatattatcatgtcaatccaagtatttctaaataaaagtagaagttgggccatgtttttaaaatttctagctaattgcctgctacttggcttattgttgtgatctaattatgttctggtttttgaaaaaaggactattgcctggcccactgtatgacatttgatttatgtagtctcacctctccctaaatagcccatagttcacaatgcagcagagcctatattaccgcaatttcttctgcactgaaattagacaattatgaagttagtagattattaaactaacgtatgctttataaatacttcttcattctaggataagggagaaggaagtatactgtaattcccaatatgtaaatgccctcacacatttgatagttgatggttccattttttagatgaaaaaactaaagcacaaagaagataaacaatattttgttctgccctataataaaataagcaggcaaatatttatggatatgattctgggttgcctcaaaactttcagggtcagggtaggcaggcagttggagatatgagataatgttagccatgaattgtggctatttttgtggcacctgggtgatgagtccacggaggttcatcacatgattttatttacttttgtatgtttcatattttctataataaaggtattttaaaggaatatatttaggtatccacagtgtgtgacacctgtcaaggagcacatgctagaggcctggctctgccagtgacataggctacgtgactgtcggtgggtcacaacttcctagacttcatttttccctcattaaaatcaaagtattagaagagatcagtggttcccaaggaggtggagttgcttagggaactgtctaaaatttcactgacaactcagaaatctatttggatttagaagctggaggggaatgtatatttcaaaataacttctcaagtgactgtactgtgaccattccttacacacaaacttgggctaacaatgagaatgacttaaccccccaccccacaacactttaataggtttaggatgggttctgagaaataaagatttttaaaacattccccaagtgattctaataggtggtcgacatgccatactttgagaaacacttttttagctcatctcagggtcccttccaactctgacacctcatgatattacttgagcattcttggttctctgcttctatgatgtactattccatgagcaactggagatttagttacaggtgtatacaagtgtacaggagtcaagaaaatgatgctaagtttcttgcactgactgaggaagcaaggtagaagcagactctggcttaattggaattcatgtttgaggcctctgggccctcactaggaaaaatattcaatttatatgtaagcatatgtataatacacatatctcaccagcattctttttgggaaaagagaatttccaaattaaatttaacctatcaattttatactgactaagatgaacacattattttaatatattgtttcctcttgcttcctaatacttacattgtatagagtttcattctttatgctaatcctaatgcatagattggtaaattgagattaatgagattcttcctttactaccacctgtttttaaccaaatgcctacatgctgcatgagcaggaaatgaggtgactactgttgttggccacagagcttcaatatgtcgtgaacaagggttagatgtgaatgtcagaaaaaatgttatgatcaatttctgcctccaacaaggaactacaaatatgggtcacaaaagttctactagtagccccaaatacattttttgaaaggagacaatataaataaagctgaaaagcagtcacaacgctttaatgtgtcattctcttcttcacctttctatccacttagatgtttcctaccccccaaaaatgaacttatgtcacatcacacttgtgactcccactgacatctaaagtagtgtgagccacacagatagaagcacaggtaaatgcctcaaaacctagttattatatttgaaggaatttctgattcagtagtgtttctgtaattgttactaacatcaacgcttcgcttgcttctaggaagacaggatggtaaattcctaacaatggaattgcaaagttcacagtgtgctttaaggagtccctttctccataaacacagctcttgtgatggctttgcagattttgtttctgcatttagtgtagataagttgaacaatcctaattcctgagttctaactagtgatagagcacattatattgttaagaataatggatgttggagaaagtcaggacaaaagtaggtatgaggtgtccctggtatgtggccaataggaaccacggtcctgaagtatccggagcagtccggacatcctcaagtagacccaaatcagccctatcaggagccaacagaaaagcttgctagggcaaggtcagaagataaatttattagccaggaccagtttaagtcaaaagttgaatataagtcatatctttagaaaaaaaaaaaaaaagcaggtagaaaggcacattgtttttagctaactctacaaaaagttcagagcgaaaagaaaaacagtgatgcagaactaggggagaaattaaggagcaaacattccaaaaatagaatgagttgtacacttggttaatttcattgctcagtgatgcctccatagaccagattcttctctctgccatcctcagaaataggctctagggatgctcttagataggctattctgtatgcaagaccttctgtagctgttctagatgccagatcctgaaatgacaacattcagtgaacaataatagctcttcttctacgtcatttccttagatgtgaagaaaccatttccagcaaactcccctcatgtccacaacacctcattaatcaggattaaatcatatgttcatttctaaaccaataagagaaaaagaagtatcgtggctatattatactgaaatgcaattgattttggagagttaaaaacaaatccaaaccagcagcagagcctggggagaatccacgtctccttctcaatccacaagacatgatgggtctgctgcagtgtggtactaaatttggggttacaagaaatttttggcttattagtttcctagggcttctgtaattaagtaccacacactgagtgccttaaaacaactgaaatgtattatctcatagttacaaagtctagaagtctcaaaacaaggtgtcagcagagccatgctcccccctgcaatctgcaggggaataatttcctcttcctagtgtctggtggtttgcccagcaatctttggccttttttggcttgtagttgcttaactccaacctctttcttcctcatcacatggtgttctccctgtgtgcccctttcttcatatggctatcttcttgtaagacactagttatattggcttagggtctcactcaactccagtatgatctcatctaacttaacaaattacatctgcaaccttcctatattcaaataacttcacattctgaggtagcggggattagaacttcaacatatgtatttttgggtggaacaaaattcaagccataacaggcttctatagacctctctagttttactcagtctagatcccaatccatggagtttgaccaaatgagttagggtgctattccctaaacttgctgaaacataataattgctagaggcccttagtaaaatacagattcctggccctcacaacagatgtactgaatcagtctctctaggggacatgcctagaaatctgctttttgacaactgcccagttcaattttatgatgaagcaagtttggaaagcatagagtcagggtgctgagcactttttgagcatctttgagcactttttgaccatgttattcctggctgtgaaagaattctttttgtatgaaatctcatctacccataacaagtcttggaagctgctcttgtcatcctcatcacagacctgcagaaatggaggttaggtaagagtggggctggaaatggagctaggtccaatctcaaaatacatactttttcaatcatactaactcatcatgttagtagtaagttaaagaatcttgaatcatatggtccactgtagtttacttttcttgccttattcccaggagttttgtttttatttgttcttgtccttggagggaacaaaagacagctggtagctgttccctgtttggttttgcatgtattcaaaaggcatcatcttctactgctctcttactcctttactttgtggtcatttgttttgcagctatttagacagttacttcttaaagaacccctaaaactatttagacagttacttcttaaagaacccctaaaactatttagacagttacttcttaaagaactcctaaaactaccatttgttcctctagaaaggattaaagatttgctgaagcaaagttctcctgacactttacctagagcaaggctgaaacaaaagctacctacacctgtattttccttctcttatccctcaagtacacaatagggcatttggctctcagcagttgatgccaagttctgctagggaagaaatgagacttcagagctccctacaagttgaaatggagtcagaaaagctacatatataaatgtcagaaaagctacatatataagctacatacataagctacttataaagtttctgcaaaactacctcaaagggcaggtagttttgcagaaactggagggacactgttttctggagcactctgccactaggattttacttttagtgtaatgaaggatcactgaagacttttaaaccagacggtgacatgataaaatttcatttcagaaatttcatttctgaaaattatgatggctgttggaaaaaagtagattggaagaagcaagaaaatgctaggttacttcacaacttctccaggaaaatagtgcagtgggagaaccctgaactcaggaaatatggcccatttcctgcactatgtttcccaattcaaaatatcctattgtggaattctacagctcaagtcaagagccccttctgaactacaaaggacaaggactgatctactaaagccgtgtagtaaatgtgaggaatttgcctaactcagccaattgatgtgtcaaaatctaaccaatgtgtctaataatctaacatatattgttattgatttcaggttttaagaaccagttttctaaaaatgaaaaacaaaatcaaagcactctagaggaagtaatcatatgtttaatgtcataagtcactgattgtatacttaatagtaaatggtggatatgaacttgggccctggagtcaaacttaggtggctcggtcatgcccttgatgtgtgtctttgggtgggctactgaaactctgtcttagtttcatctataaaatagaatgctaacatcgactttatagggttattgtgaactctaaataagacaacaaatggaaacccaacacatgttctcactcaaaagtgggagctgaacacgtagacatggggaggggaataacacacattggggcctgtcggggagggggagggagagcatcaggataaacagctaatgcatgtggggcttaatacctaggtgatgggttgatagctgcaacaaatcaccatggcacttgtttacctacgtaacaaaccttcacgtcctgcacatgtagcctggaacttaaaattaaattaagtcaaaaaaagctaaaagcaagctttatgccaaaaaaaattttaaaaacttaaaaaaaagcgcctcttaaagttataagggagggtacacagtaagcacttagtgagtgagtgttgtggttgctgtttttcttaataaacatatttttatccaaattattaagcagaaatattggactggaaaagggtaaagtgtggattattaacggttgacattggaagagcaaagagatagagatgttccatgtggttcctttgccaagccatccagatactcacctccatccttttggtcatttcccctaatacacagtatatttatgatccccttctgacaaccccttgaagagttgcttgcctcctgcacagtgctgagttatggacgatgcatttgaagccatatattcactctgtcttccccacatgtgcctagtaactatggcagagctcaataaagaagaggccagtggcgggtttactcatttttaaaaaaatttccttgttgttcttttctgtgattgtaatggctagcactggtactctttccctctctctccccttcttttgccatagagctattgtcaaatgtacaaatacatagtgaattgcgatggtttctgggactgacagagagaaggaacctgttttccccataaatgctgtagaatgaagggtttgcaaacattgtgattgtggcagattaaaaaaaaaaagtcaagcaggctaaattgaaagggaggcatgagaaaagctggtgcaacctgtcagctcctggtccgaaagaagctgatggtattttttttaatattgtgaagagaaggaaaattttttatagtaagtctatggatctgctttaggaggcttttctcttgatctaattgagctgtttgaagtgtgcttgaaagttctcacccagcctgtgtcagccacctgcctgctacaagctgtgagaagttaatcgtcttgggcattgttaggaggagactgtctggtatctgatggctttccattctgaacaagggtgtacggatatggaaaatgtgtgtgctcacatttgtctttggggtgtggggctgcttcactatgcatgagagcacatccacacctccatccagatggtgcctgctcatagtggcagtgctagataaattcatgtcaaacaggcagataatccaaaaaagcaactgtaagtatccacattgctgttttctgcttccaagcttcagtgttgtttttttttttgtagtgacagggtattactatgttgcccaggcttgtctcaaactcctgggttcaagtgatcctccagccttggcctcccaaaaatctgggattataggagtgagccaccgtgcagtgcctggttttttaacatgctattcccttgcctgaaacaaccttgccatttgccatcaacactggcttcatcttccaatctctttgcctgttgcctcacattggatgtcaccaatctgggaagcctttgtcacccctcaccacattgaggtgaggggtacctcatattctctccctgttccttgatttcccattcaaagcacttaatgcaccaaacatttttttttattgcatgtctgaatacattccttagtagttcaacattctttgaggttatatcatgttcatcacagaatttaaagcaatctcctgtgtatagcagattgacaataaattagctatgaaaacaaatgaataactatggtttgggaagaaagacattgtctgagcacacagaattctaactcatgacttgtgcactgtcaagaatcacttgctttcagataattttgatgagtctgattttacgcttttcagtttgtatgtctcatgatttgtccttaatagactgaagaagtcctagcccttataattgaccagtgcctggtaggggaagggcagcagagaaggactggattagaaccatctcaaatgcttctattctgattagtacttagggttggttggagagtaagaatagggactcagcctagttgaaggaaagcctgtatagtggtgagtctgagtgacaaaccagggagaagtaataagacaatttatttctatttttttatcctacacctgaaatgtaaacaaggacacattaaatttttactggttagcattttttaagtaattatgtgctcaactatgtccttatatttgcattcttaccaatgtagactctgttatggaagtaacccatgctgctgctgcctttggacctgaatctctttttgcccttgtcccatttgtgaatttagactttcagcaagttgtctttatgattctctattctatgacatactttgtgaattcatctgtaatcaaatctgtttgatgaaggtcacaaaagctaagtcaacatgagacctgaaagtagaacctgggggtactgattttcctacccattaggaaacagcctccccacccaatcagggcaggttatagtattcaatgccatcttgtcttattgactgagtcatacatctctcattccgcaaagtcagggtcctaaaatacttctgtggagtcgcaaggactcttcctcattagccatctttgactttgtcattgatactattttctacctgtttctgataattaaaaccccccaaaaagtaaaatgtcagggtgaccagagagaaccttagataggacagctaatctcttgcttctagagaaaggtatgaaaatatactgtgcttattatggggatgatggtatgctctctgaattgaaccttaccttttaacatgaaatttctaattgaaacaaagctgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtgtggccattttcacgatattgattcttcctacccatgagcatggaatgttcttccatttgtttgtatcctcttttatttcattgagcagtggtttgtagttctccttgaagaggtccttcacatcccttgtaagttggattcctaagtattttattctctttgaagcaattgtgactgggagttcactcatgatttggctctctgtttgtctgttgttggtgtataagaatgcttgtgatttttgtacattgattttgtatcctgagactttgctgaagttgcttatcagctgaaggagattttgggctgagacaatggggttttctagatatacaatcatgtcatctgcaaacagggacaatttgacttcctcttttcctaattgaataccctttatttccttctcctgcctaattgccctggctagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgctggattacattgattgatttgcatatattgaaccagccttgcatcccagggatgaagcccactcgatcatggtggataagctttttgatgcgctgctggattcggtttgccagtattttattgaggatttttgcatcaatgttcatcaaggatattggtctaaaattctcttttttggttgtgtctctgtccagctttggtatcaggatgatgctggcctcataaaacgagttagggaggatttcctctttttctattgattggaatagtttcagaaggaatggtaccagttccgccttgtacctctggtagaattcggctgtgaatccatctggtcctggactctttttgcttggtaagctattgattattgccacaatttcagatcctgttattggtctattcagagattcaaattcttcctggtttagtctgttttggttactgcagcctatactacaaggctacagtaaccaaaacagcatggtactggtaccaaaacagagatatagatcaatggaacagaacagagccctcagaaataacgctgcatatctacaactatctgatctttgacaaacctgagaaagacaagcaatggggaaaggattccctatttaataaatggtgctgggaaaactggctagccatatgcagaaagcagaaactggatcccttccttacaccttatacaaaaattaattcaagatggattaaagacttaaatgttagacctaaaaccataaaaaccctagaagaaaaccaaggcattaccattcaggacataggcatgggcaaggacttcatgtctaaaacaccaaaagcaatggcaacaaaagccaaaattgacaaatgggatctaattaaactaaagagcttctgcacagcagaagaaactaccatcagagtgaacaggcaacctacaaaatgggagaaaattttcacaacctactcatctgacaaagggctaatatccagaatctacaatgaactcaaacaaatttacaggaaaaaaaacaaacaaccccatggaaaagtgggcaaaggatatgaacagacacttctcaaaagaagacatttatgcaaccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggaccaagaactagaaataccatttgacccagccatcccattactgggtatatacccaaaggactataaatcatgctgctataaagacacatgcacacgtatgtttattgcggcactattcacaatagcaaagacttggaactaacccaaatgtccaacaatgatagacaggattaagaaaatgtggcacatatataccatggaatactatgcagccataaaaaatgatgagttcatgtcctttgtagggacatggatgaaattggaaatcatctttctcagcaaactatcgcaaggacaaaaaacaaaacaccgcatgttctcactcatagatgggaattgaacaatgaaaacacatggacacaggaaggggaacatcacactctggggactgttgtggggtggggggaggggggagggatagcattaggaaatataactaatgctaaatgacgagttaatgggtgcagcacaccagcatggcacatgtatacatatataactaacctgcacattgtgcatatgtaccctaaaacttaaagtataataataataataataataaaaagaaatttctaattgagttgcctaagcctgcccacctgtcattctcatatgcctaacacgatgtgagattttatatatacagtcctctgtatatatattcacaggttccccatccacagattcaaccacccatggattcaaaaagcaaagcaaacaaacaaaataacaacaacaaaaatacaaattttaaaacacagtataacagccatttacacagcagttatattgttttaggtattatacctaatttagagatgatttaaagtacatgggagagtactttaaaaaaaaagtacacaggcatgggggcagtggctcatgcctgtaatcccagcactttgggaggccgaggcaggtggatcacgtaaggttgggagttcaagaccagcctggccaacatggtgaaacccctgtctctactaaaagaagaaaaaacaaaaacaaaaacaaaaattattcaggtgtggtggcacatggctgtaatcccagctgctcgggaggctgaggcataagaatcacttaaaccagggagaggcagaatttgcagtgagttgagattgcatcacttcactctggcctggacgacagagcgagactccatctcaaaaacataaataaataaagtacagggaggatgtgtatagattatatgcaaatactgtgccattagggacttgaacatctccagattttgtatccacaggggtcctggaatcaatccccttgatggatacagagggaagactcactctcactctctcttgatatatatatatatatatatatatatatatatatatatatatatatatatatatatatatgcacacatacacacacacacacacacatatatatacacacacatacacacacacgtatgtatatttacatgtatttataaactgatattttattcaaatgtttcaactggcccctaggaagaaagatccactctgatgtgttctggctctgtgtgcccacccaaatctcatcttgaattatcatctgaattgtaatccctgtttgttgtgggagggacctctcgggaggtgattggattatggaacggtttccgcatgctgttcttgtggtagtgggtgagttctcacaagatctgatggtttcataagaggctcttcccccttcgctctgctcttcccttctttaagctgccatgcgaagaaggtctttgctttcccttcatcttctgccataattgtaagtttcctgaggccttcccagccatgcagaactgtgagtcaattatgcctttttcctttataaattactcagtctcaggtatatctttatagaagtgtgagaatggtttaatacactctgtaaaagcaaaataatcactcttcagaagcagaaaaaaactttttataagtgactcaaagtcaagatgacccatttctcatttatatgatataaacctatacatatcctctcacgtactttaaatcatctctagattagttataatacctaaaacaatgtaaatgctatgtaaatgcctgttatactatgttttaaaatttgtatattttgttgtattatttatatttttgttttttgaatctacggtttatatgaatatcattctctctccctctgcatctatctgtatctacatatgtatatttgtttttttcttagaacataacctagattcctctacagtgtaaatcccttgctttctggttttctgcctaataaaaggctctcatttctatcttggtctggaaatacccccacttccattttttatgaagtaaaaataccgaagatttttttttttttttgctagaagtagtttactgtctttctctacaactcattctaatatttttcttttcaactccctaccattcttattgtcttccagcaatgtctctatgatcatagagagacaaactgcagccacacttagccaggatcatttacatttacttgcatggctctgtgtagcttgctttttatgctaggcaggttcctgaatagtcagataggaattgaattcttggaaatcatgccattgtttaaggatgaggaagaacttactattttaatgaactttattataaaccttttttctaagcaaataatcaccccttactttatcttatctcctatgcaaatcctgattttcacatttaagctttacttaacagtgtcaatttgtatagttatctttaaacaatggtcagtccccactcttataattgaaaagtaagtaattttcatttactttctggcttctacctccagaaaatctcttacctctatctttattttggtaattctcttgtagggactttaatagcccctggaaaatcatcatagctctgcttcaatctgaaaacataactggcaggcatgagtctggaacacatacgagggaacgaagtacccagagccaagttaaatgaactgttgatgacttttctgaaaatcatagtaaaccatgatttcctcacaaaatatagaagtgtctgatttttggcatttaattctcaaacatactcagatacactttccttcttcctctcccactctgggttcatatcatcatataaatcagaaatgggtcatcttgcctttgagtcatttataaaaagtttttcttttctagctctgaagcgtgattattttgcttttagagaggatctttctttctggggccagttgaaacatctgaacaaaataaaaatcaattgaatatggatatgaaacttaacttgtctttttaccattaaatatatatttgaaaaatgtgctcttcttttatagcttttgtcacatcagcatgtaccaattccaaccagagaacgaaatattaatattctgccccaaagtgctgttttccagcctgtgccaaagcagataatgccagtaacagggagttttccaatctaactttcttataccagtcaaattatccatttcaaaaaagcatccagtcaaagtgctcccaataagtgaatattttgcctagagaattttgggcttgagttatccatccctctgaccaaaatctataagcccactcacccaggagatctgagaatgaaactaaatataaaaactggctttactactgggaacccgaaagttcagctagtgagggaaggaaaacaaagaatagaatgttttccgacaatccttgcttttgtgagtggtcagcagatgttttgtgcctctgctgtattccttagctaagggttcacatgaaatgtaccctctgaaggctgtggccttgttggaacgccaaattagtagttattcctcatgctctgaggtctagcttcaccttcagaaccaggtgagcttggtccccacaaagccctactggtacttaagcttcccatttcaagaggacatttgggttcactacacctctccaagccgtctgattaattgcagctgtgtgcaaattagttttcttcaggggctctctcctgctctcagattagcaacaacgtattcagatggaaagcaaataaagatagttgtaaaatgaggacacaaaagagatgcaacatgtttgctcttgatgggtgcattgatgtcagaacaactagggggaaataagaccaccttggtactgttatcatcgtcctgatgatggtcccgtcttgcagaaaagcccaaacagaagcagggcgttgtctaatcactgatgggtttcctgatattattgagaagaccaagcaaaattaatggtgatattatatctggtgaaattattataaattctccctgcagttttaattagctctgctctttttctcctcctgttttaatccaaagcatatgtgtatgtttgtatcagcaatttcaaaattctgtgaagcatttggtgtcatccatctagtttcaaaataggtacagcatgatgcagtgggaagaatgctagcctagaagttaggactcctgagttcctgcctaggtctgccgctaagctgtagtatgaccttggacatgacctttcaggaccttgatttcttcttatgtgagatgaaggattaaaatccaacagtttgttaaatcactctcaactttttagatactattaagtttaggatcccgtggagaggcctatcatccgagagaccatcctatcatcaaaaggtgaatatcaggtcaaagcaaaagaaaccacattaatttttttctgttgtcagctcacaaagctattttaagcctttggacaataagaaatatactttttttcccctccaataaatatacattatccattaaagtagagtgtgttgtgaactgaccttaagggaatttgctagtttttttgtttatttttgttttttacaggaaactaagtcctgtggaacaaaatagaattaccttcatggagcaagtttaacaaattgtcttcatttttggtcagcaggttgatttctaattccctcttattccctttatatgtatttttggcttcctgtctttgttttgcgttgctataaagaaacatgtgagactgagtaatttacaaagaaaagaggtttattagggctcatagttttgcagcctgtgcaagaagcatggcaccagcatctccttctggtgctgcccctaggaagctttcactcatggcagaaggggaaggagagctatgtgtagagatctcatggagagagagggagagcaagagagaggataggaggttcaggcagtttttaacaatcagatttcatgaaaataaaagaactcactcattacctcgaggaaggcaccaagccattcatgcgggatctgccccatgaccaaacacctcctactaggccctacctccaacattggggatcacatttcaacatgggatctggaggggacaaatatccaaactattaaattcctaaaggacataaaagggtgaactgcacaaggatactatatctccaaacaaatgcccagttaggtccaggacgtgttcaacagtgtccaaaatccaaagagaaccagagatagtgtggcttagtagaaggtaaactgattatacacactcagcattgcaagaaaccttaacgggactgttgtccaaccacacaagcattattcaaaaacctttttacctctcaaggtttggttttctagcatgggttgccaagctacaactgcccagagaagtcatttaaactgcaagagactcagctttctcatccttggaagagagaaattggacaaaattatctttaattttttgtttgccttaatatcctcttattctactaaacattttcagtattacagaaatcagctcttggaggaaaagacattgcagggggtgggagacaaagttggtgataccatgtaataagatttttttagatagtggcaagataaaatgttttgaggtttggcaaaaccatctagtagtttcagttctccctgacagtaagaagttaaggaggccaatttctctttcaagtcagaacttcttgttataactgggtagtaaacatactttttaataagaagtggctaaggcttaagaagaccaactgctgatacccagaaatagccaaagaatacttcattactgacagtgcacactttgatagacctgtcttttactattgacagtattctttctctgctgtttttacaagaaaaaaagcccaatgaaatgtaaaccttgttttcttcagttattggtcctaggagtattcagagtaaataaaaaaaaaataccttacgtatacttctataaaatcttttatttgagcaattaaaaaaagctatcttctttcagtcttatcaaggagagcaaattcctcctagaagtcttatttctacttctaatgacaattgctttattatgtgacattcaaaggaaaaacttgaagtcatatttctagtaaagtatttaatttcagaaataatttaaactgttacttcaaagcaaatatctgctattcctgacataaagtttttacccaagcttggtaataaagttatcataagaataatatggattattctcaggatggaatagaatgtcttgattaggaagaaacacacataagaaattcatttttttggaagaaagaaaatctgtgctgtttatctggcaatggaagtcagatcaaaatatatctatatgacatttgaatggggtcacgtgggaagacaagatctgtctgtatgaatatttttagcttctgaatttgacataagaataggatcaggaaaatgaattctgtgttacatgactaagatgcatattagaactcaggcaagatgattcctgtagttggtctactgggaaattaccctctgcctacagctttcaaatacatatatatactatgtgtgtgcatgtgtgtaaatttccaactgagtacatcagcacataaaatacacttgtccaaggtaaaaaagacaaacagttattaatagggcaaaaataaaatggggttatatccaaccatggcataatacttctcattagaaaaaagtgtggcgagctaattaagacccagtgatagttagaaagtctgagaacatttatctttaaaaatggagtggtaactaactaaaagaaggacccagaacctcctaatacaaatatcagttatattccctgagatttaaaaatataataattcttatttctaattcaaaggcctagagtgtaagtagggataacttaacctttttttttttttttaagcctctgtgagaaataacgcagctgtttggcccgtggtattctctttaaaggaaagaagttacaaagacaagaagaaaaaagtggaagagaaaaataaggagaaaaaatattcaaacagtacataactaaaaaaaaaatttttcacaaacagcaaggggaatcttgaaacaaaatagatttgttttaaaatgcaaagaaagagccttacccgggatgaattgctcagttctcttttgttggttgagttcacttccttccatttctgctaactttgaccagctgctaacaagcaaaagagcttcatagaggccatctacacgtgttctcttctgggttatcgcgatgctgacaaagtgcacctaccgcaaattagaagagcacaaagatttctgtgggtatgcctgcaaaactctggctgcgaggcatcacctcagctcagtagccttggatttacatgtgcctgcccccctgcccatggttactgagggtggcctgaggatggattcacttcataacccttttccataattatgtgaataacaaatgagctctatccaatagagaaaaagaacacattttaatactttgtgaagtgatcatgaggaaggggacagaggagttgagatggccaagagagatcccgccctctggagatgtaatagaacagtgacagataatgcaaaaaaagatttaatatatttttatatatttaatatttgtcttctgttgttgaccttagcttttgagtcaacagtaactaagaagcattttgtcatccgacggctcctcttcctttggccttctgtattgtattatctgataaggaagcagcgaacttaaagctcagttcaacgcaatgatccttcatcatagctgggtgtgaagaatgttgttccctcaaatatgacacaaattgtttggtcaatagagaagagaactgcattctatttttttccaaacatctgttatactccaaaacctttctccttaggccatggctgtctgaccaacagtaggtggatttctttgaaatcttatcttctgtagaactggatctcatcctggccaacatggtgaacccagtatctactaaaaatacaaaaattagctgggcgtggtggcaggcgcctgtagtctcagctactcgggaggctgaggcaggagaatggcgtgaacccgggaggcggagcttgccaagatggcaccactgcactccagcctggcaacaaagcgagactctgtctcaaaaaaaaaaaaaaaaaaaaaaaaatagatctcactagaagtattctcaattcagcagtagtgtccagttttgaatcaaataatttatattttgattatgtgtattaagaagctaaatctactcatatacaaaaggaaaatctttagcttttcatgtgttctggctaaaggccagaattaaaaggaagaggatgtcttatctatcagacatttttgtgcctttgaagccataaacttgagagaaacattagcttgttcctgaccctgcactcagcataagcatttgcttgtagcagtcactcttgggtgactataaattcacaaagtcaagaatttgcatcctgaattgatttgtgtaagatgtctaggggaatgctgattttatattggaaacaaggttagggggaagcctcaaaactgcctttatggagttctgtatctcagcatattataattcttacttctaccatactccagaggaatcagtctgggtgacttcataaaacagtattagaaaaattgctagcactacgaaatcaagcaggttatggcagtatattccttgtaagaaaattagtgcattaactctttccaataagtgattgaattagttttgcacataatctgatttatgaaatgctgcactcgcatgctcaagtagttagaaagtgtgtcgaagcagatgttgaactgaagaaagaaggttgcttgaaatgtaaaggtattataaaatggctaatctgtgggtatgacccaaagctttcagagatttcctggcttcactttttttttttcaatttaataaattttttttcttaaaaggtaaaattgccaatgagttaaatgttgatgctctgatgttagcaagactgagttcatatgtccatcgcttattaactccattttcttatcaatatgtttggcttctgtaagtcttattttcttgtttgtgaaaggaagatctaataatagaactggccttatagaattgttgtgaggattaaatgtggcaacccatggttattggtttcgtgcgatgcctgtcacaaagaaaaaacccaataagttgtagtggctatttttcatcttctcattatcaccattacttaagagagaggcaaagtgatagtatcatacaaacattttcatggagagttaaatgaacatctgttttttcttttcttcaattttttaaaaattatactttaagtcctgggggacatgtgcagaatatgcaggtttgttacataggtatacacgtgccatggtagtttgctgcactcaccaacctgtcatctacattaggtatttttcctaatgctatccctcccctagcctcccaccccctgacaggccctggtatgtgatgttcccccctccctgtgtccatgcgttctcattgttcaactcccacttatgagtgagaacatacggtgtttggttttctgttcctgtgttagtttgctgaaaatgatggtttccagcttcatccatgtccctgcaaaggatatgaactcatccttttttatggttgcatagtattccatggtgtatacgtgccacattttctttatccagtctatcactgattggcatttggattggttccaagtctttgctgttgtgaatagtgctgcaatagacatacatgtgcatgtgtctttatagcagaatgatttatacatacgtgtgcatgtgtctttatagtagaatgatttataatcctttgggtatacacccagtaatgggattgctggatcaattgtttttaaggacaggttgcataaaactgactaatgccattcatgacagtgagtttcaaaggcagatagctatcttagtccatttagggtgctctaacaaaatgccacaaagttaggtacattataaacaacagaaatgtatttgtcacggatctggaggctggggagtctgagatcaagaccctggcagatgtgatgtctggtgagagcttcttcctggttcatagatggcgacttccagttatgtccttacatggtggaaaggacaaggggtctttctgcgaccagtttttcaagagaattaatcccacttatgaggtctctgccatcatgacctaatcacttccccaaaactccacctcctgataccattacactggtgattagctttcaatatataaatttgggtggcggggtggggcacacacattcagatcatagcaatggcagctaggaggaagtaaattttgaatcctcatttccatgtaaagacttcatttgctttaaacaatttatttaacttttattgtgctttttctgaaaatgaaataacatttagctacacacagggagggtatgttgtttctaaagtaaaaattaactcttttgtaaatgtggcattgtttaataatagttcaccctgtccaatgatacttagcttttttatatatgtaaataaattattaggttactggtttttctttttcttttggtgggtggggggggtgttaagatcttattctcagtcctcaaaactctgttgaacagggaacatctgccctcattttcaaccttatttctttagtaccaattgcagccatgttataatctttgttttcatccaggtaaagctgagggaagggaaggagaatccactgagaaaaagattttccccaaagagtgactcagcctttgaaaagaaaatcagctatatgaaaagggaagagtatttaatcattcggagcaataattgcattgtaaatattagctcagctgataaggagtagagaaccaagagaatgagggagccgttacattgttttatcttgtttgatgcctttactcagtgctctagcatgggggccatgtctagggagggaatccactgcagctacatttaaggtcacctaataaaccgtgctgttttctttcttttcttctagactctattccttcattttttttttctgaactttaagcaaggaaactgccagtcatagagcatttccttatacacttccatgttactgttatgcagagaaatctgactggcaggctgatggccaggctgctctggaggaaagtaattagctatgtgactttatctaggccaaaaaaatgggataaaaaacatgcaaaaccattcacctatacagacctgttctcaaggcagtgtttaccctagtgcatctgctaattcctttcaagtctggaaaactgttttgtttgacatttttggaatgctgtgatctgaaccattagactatttttttctcctttaaggtactaatattctgatttttaaacaattaaatatgctctaaatttgtctcgcccacttctacatcttcttccaacatttacatagacatccatgcacattcatgcacaccacacaactacaagtcatttcagacaaatggtcttatctaattctttttagtgtttccattttattatttgtcaaattgaatggaacttccatgttttgccctgctgacatttaggcagacttgcataaaatacaagattatttctagctggataagaagctcagctatcagatagtgttgctgatttatacagtaggaggaaggagaaaagaccaatgggtgagtataataaatagaaacgtcctgaagcaattcacttgtagcctatccaaatcttgcaaactctgcataaaacatcctcccagttctctttcaatggaacaatttttcttttctttttctactcttcactgaacatttcctgtattctacatgcaacagtgcaccttttacattcgtttggcttatgtgctcttgcaataaccctttgctgtgtggtaatatctcatttgtgggaacttctgtgacactattaggggacagatacaatggctatgtgcctagcaatgccttcaccgtgctctatttaaatagattgctcatttatttgctactttgctcatcaccctgtctctcattcactataatatctttagcaaatcacatagtgccaggtaaataaatggtactcattcaatattgaccatatggatgaatctctgcttatgaaatatgagagccccgtgcagggtcattctgtccaggaactcatcttctctggcggtgtgagaccatatgtttaacatgaccagtaaggaagtagaaggaatcttccactactttttacattcttttttctttcaaaaagttttgtaaacttcaagtatgtaaaaaaacagttcttatatgttcatacagtttgctttcaacaataactccacacatgtgcattgacatgtaaagatgtttccagtataaagtagaaaaaaatgggttttaaacatcatatataaaattaatcaattttttaacatatagcatacctgtattcaggaacatgttctttggttattctcatttaaacagtcccctattgttgaatacttgatctgtttctattgtttcattttatatataatatatcctataccaaatatcctaatataacttctctgtgtgcttgtctaattattttgtttagataaaaggtttcatatggtgtccacttcatgccattatgtgatatgatttgcctctcagcctctaggaatgggtttttctctaaggatagtggctgccactctatctagtggctgaagtaatatggcttcatgtcatgtggctaacgattcatgccaaaggttgtccgcatcttatgtatcagtgagttatctgacacccctaatagacgcttatttcttttttcaaaaagcttgttcctgagctgaatttccatgatcagatggtggcaagagccaagtcttctcacataaagagaaatcacattgaatctgctacctacgaccactggccaaggggtcttgtcatcattgcattctggggaattggattcaatttaaaaagttgaagctgcttgctggcttccttcctggtagttttgaatgtgtaatctcacaaagatcttcttagctctggcaaagctgagcctgtctaaaacatttatgttagaatttacatgagttcatttgtgctggcgtcaaacatttcttgagtatttaccatgttattggctgatcttaaagccaagctacaaaggactagtaggggttagcaggcaggcaggaagaagaagggcatggttggcagagattgccacatgcacagaatatagtggtgaacctacatggtgcatttggaattgcaagtagtctggctttgctggaagtgggtttgcaagctgaggagtaacaagaaataaggccgaatagcataccaggaagtggtagatggcagagacccctggatcaccgtgatacttatgacactacttgctcacttgttttttggtttatttcctgataagctttgagccagaacattaatgcaaattcttgttcttgtgtaaaaattactgcaatgacttcccattgctcttggagaagacaaaatccttaatatggcctacaaggtccagtacaatctgtctcctgcctctgtagtcttattcttcactaggtctgccttcttcctcccagccctactggggcccattctctgggcttcaatattacagaccttactttaatttcactaatgggaaatgttgctgccttccaacaaagggcttttgcatgtgctgtttatatgaaatcctcttttcttcctgccactcttgcctattaatgttcttatttctcagcactcacgttatttttttactcagagaaatcttccctgagttccctgaccatgtcagatttttcacttatatgctgtcataacctcatgcatttctcttttacagtgctataaattgtcagtgacacatttgtgtaattaagtgatgaatgttcctttcttcctaataagtaacatcatctataccatcattattaaatcagccagcatcagctggggtacttatcatatgtcctatactgttctaaacacattatatgtattaattcacttaattctcataacagtccctattaaatggataacactgaggaataaaaaaagtaagtcacccaaagttacacagctgataggtgatgaagttagaattagaaatcaggggggaggagccaagatggctgaacaggaacagctctggtctacagctcccagcgggagcaacgcagaagatgggtgatttctgcatttccatctgaggtaccgagttcatctcactagggagtgcaagacagtgggcgcaggtcactgggtgcatgcaccgtgcgcgagccaaagcagggtgaggaattgcctcactcgggaagcgcaaggggtcagggagttccctttcctagtcaaagaaagtggtgacagacggcacctggaaaattgggtcactcccacctgaatactgtgcttttccgacgggcttaaaaaatggcgcaccaggagattatatccctcacctggctcggagggtcctacgcccacggagtctccctgattgctagcacagcagtctgagatcaaactgcaaggcagcagccagactgggggaggggcgcctgccattgcccaggcttgcttaggtaaacaaagcagccaggaagctccaactgggtggagcccaccacagctcaaggaggcctgcctgcctctgtaggctccacctctgggggcagggcacacacaaacaaaaagacagcagtaacctctgcagacttaagtatccctgtctgacagctttgaagagagcagtggttctcccagcacgcagctggagatctgagaacgggcagactgcctcctcaagtgggtccctgacccctgacccccgagcagcctaactgggaggcaccccccagcaggggcagactgacacctcacatggcagggtactccaacggacctgccgctgagggtcctgtctgttagatggaaaactaacaaacagaaaggacatccacaccaaaaacccatctgtacatcaccatcatcaaagaccaaaagtagataaaaccacaaagatggggaaaatacagagcagaaaaactggaaactcttaaaagcagagcgcctctcctcctccaaaggaatgcagttcctcaccagcaacggaacaaagctggacagagaatgactttgacgagctgagagaagaaagcttcagacaatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaacgcagaagcctcaggagccgatgcgatcaactggaagaaagggtatcagcaatggaagatgaaatgaatgaaatgaagtgagaagggaagtttagagaaaaaagaataaaaggaaacgagcaaagcctccaagaaatatgggactatgtgaaaagaccaaatctacgtctgattggtgtacctgaaagtgaccgggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcagcagaaactctacaagccagaagagagtgggggccaatattcaacattcttaaagaaaagaactttcaacccagaatctcatatccagccaaactaagcttcataagtgaattagaaataaaatactttacagacaagcaaatgctgagagattttgtcaccaccaggcctgccctataagagctcctgaaggaagcgcttaacatggaaaggaacaaccgataccagccgctgcaaaatcatgccaaaaggtaaagaccatcgagactaggaagaaactgcatcaactaacgagcaaaataaccagctaacatcataacgacaggatcacattcacacataacaatattaactttaaatgtaaatggattaaattctccaattaaaagacacagactggcaaattggttaaagagtcaagacccatcagtgtgctgtattcaggaaacccatctcacatgcagagacacacataggctcaaaataaaaggatggaggaagatctaccaagcaaatggaaaacaaaaaaaggcaagggttgcaatcctagtctctgataaaagagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagattttaacaccccactgttaacattagacagatcaatgagacagaaagtcaacaaggatacccaggaattgaactcagctctgcaccaagcggacctaatagacatctccagaactctccaccccaaatcaacagactatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacatactagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctaccagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagagaaaaagagagaagaatcaaatagatgcaataaaaaatgataaagaagatatcaccaccgatcccacagaaatacaaactaccatcagagaatactacaaacacctctactcaaataaactagaaaatctagaagaaatggataaattccttgaaacatacactctcccaagactaaaccaggaagaaattgagtctctgaatagacgaataagaggagctgaaattgtggcaataatcaatagcttgccaaccaaaaagagtccaggaccagatggattcacagccgaattctaccagaggtacaaggaggaactggtaccattccttctgaaactattccaatcaatagaaaaagagggaatcctccctaactcattatatgaggacagcatcatcctgataccaaagccgggcagagacacaaccaaaaaagagaattttagaccagtatccttgatgaacattgatgcaagaatcctcagtaaaatactggcaaaccgactccagcagcacatcaaaaagcttatccaccatgatcaagtgggcttcatccctgggatgcaaggctggttcaatatacgcaaatcaatcaatgtaatccagcatataaacagaaccaaagacaaaaaccacatgattatctcaatagatgcagaaaaggcctttgacaaaattcaacagcccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttcagctgataagcaacttcagcaaagtctcaggatacaaaatcaatgtacaaaaatcacaagcattcttatacaccaacaacagacaaacagagagccaaatcatgagtgaactcccagtcacaattgcttcaaagagaataaaatacctaggaatccaccttacaagggatgtgaaggacctcttcaaggagaactacaaaccactgctcaagggaataaaagaggatacaaacaaatggaagaacattccatgctcatgggtaggaagaatcaatatcatgaaaatggccatactgcccaaggtaatttacagattcaatgccatccccatcaagttaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaagcaaaacagcatggtactggtaccaaaacagagatatagatcaatggaacagaacagagccctcagaaataatgccgcatatctacaactacctgatctttgacaaacctgagaaaaacaagtaatggggaaaggattccctatttaataaatggtgctgggaaaactggctagccatatgtagaaagctcaaactggatcccttccttacaccttatacaaaaatcaattcaatatggattagagtcttaaacgttagacctaaaaccataaaaaccctggaagaaaacctaggcattaccattcaggacataggcatgggcaaggacttcatgtctaaaacaccaaaagcaatggcaaccaaagccaaaattgacaaatgggatctaattaaactaaagagcttctgcacagcagaagaaactaccatcagagtgaacaggcaacctacaaaatgggagaaaattttcacaacctacttatctgacaaagggctaatatccagaatctacaatgaactcaaacaaatttacaagaaaaaaacatacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcataccagttagaatggcaatcattaaaaagtcaggaaacaacaggtgctggagaagatgtggagaaataggaacacttttacactgttggtgggactgtaaactagttcaaccattgtggaagtcagtgtggcgattcctcagggatcaagaactagaaataccatttgacccagccatcccattactgggtatatacccaaaggactataaatcatgctgctataaagacacatgcacacgtatgtttattgcggcattattcacaacagcaaagacttggaaccaacccaaatgtccaccaatgatcgaccagattaagaaaatgtggcacatatacaccatggaatactatgcagccataaaaaaggatgagttcatgtcctttgtaggcacatggatgaaattggaaatcatcattctcagtaaactatcgcaagaacaaacaaccaaacaccgcatattctcactcataggtgggaattgaacaatgagaacacatggacacaggaaggggaacatcacactctggggactgttttggggtggggggaggggggagggatagcattgggatatatacctaatgctagacgatgagttagtgggcacagcacaccagcatggcacatgtatacatacgtaactaacctgcacaatgtgcacatgtaccctaaaacttagagtataataatgataaataaaataaaaataaataaaaataaaaaataaaaataaaaatacaaaaaaaaaaaaagaaatcaggcagactggatctggaatctgttctcttaacctctctctctgctcaccggtaggttatagacctaacataaagtagttgctcaataaatatttgttgaaagtataaatgaataaactaattaataaatactttatatgtgtcccactcttaactggggaaaattgggtgggtagatacaaaagaaccctagtagactgttcgctggcaggaatgtgttctagaggattggggaaagagaaacccccgaataactgtacgtgatttatgatgaaaatctttcaagtagtggaaagttataaaatgctaaccaaaagattagttatttggtttatatgttgatcactgtgatctttcccaatattgactggggtttgttgagtgtctgtaatcccacaggtggatgttcatgatctgaagtgacaatggtatatttgctcagcatttcctgtacctgaaacaacccttgaaaactgaaatagaaagagcaagtcaatggtaatatcatccagcactctgccaggcttatggcgaccttgcttacccgaaagcaaattacttccctctcatttctatataataagtactttacggctttgtgttttcatgcattgagatttccctaggagtctgagaagatgtccaggaataaaagagggaagaacaatgattaaactatttctaggactttagacattggattatattcagaaacccataatcagaccgttaatgaatgtcttcgcattcattatcagactctgaaaaagcatatccagtctctccatggactggccttcacatatgctttgctatctggtagaaatatctgcccaaaagattattttttatggaaataatagtgcacatgcagattctagatattattttctatttatcaactgcattcaggcagtgctaagtagatgactgatgctgaaattttactagatgatctttgctctctattttgttatatgacacatggggcaaatacgtgagatgagcaattagtgaaattctggaagggacagatttatgtcatactattgaaagggacaggaagtggattaagtatgatatatatatagtatgtgtgtgtgtgtaggtgtgtgtgtgtacgtataacaagttagtttccttttcctaccactgaaattgttaaatggaatggtgacgtagacactttacttctctactcctggacttactagtaaagaagaaatatataaaagagcaagatagtattgatctggggtggtactatggtatgtattaataccataccgtaattctatgatctattaatgtcacaaccagctacatttagctggcttttatatacgaatgtgcatagtactgttttgtattaaatatcaccagaagatatttgtcacataaaaacagtgagattaatgtttatatattttggcactcatgctagagttgaatgaggttctgtctgtggggataattctaggtatcctggaaaacctccacatatacaccaaacccagaatcaattcagataggcattactgttcgcagtcatctaatttcaagttagggtagtaggatatggattggggggcgtgattcttagtgccagagaaagattaaattattcatagggaaagatattcagcctaagatggataagactgaaatcaggtgcctggactctagaggattgggctctaaccgaaaaaaaaaaaaaaaaaaaaggagaatccagtaggaattcattgagtaagccaaggttacaatctgctggacttcagaggtagagttctagatgcccattttaccaccctaggtcagaagtggggagcagagagacagaaggctataagtgaggagacagtactgagacactaagtagacattctagccaactctgtagaggattctcatgttatgagctgaagtagaaaggctatgtttgaagattctgtctgattttgggcatcttggttctagatctatcataggtgcagattaaattgtttccaggctgtacttgatagttggtaaggatcaaacaataccctcacataacttgtcctagaactggttgtgctatggcatcattgtagtcccacatcctagcatggagcctaaaaaaaagtaggttcttcataaatagccaaggaatgaattaatgagtgatgggatgagtgtgagtggagaaataagcaaaattcctagaaatatggggtgggagtatggcagacaaacgttggcatcatccttcaaggaccagatcaaaatgccacatttccactacagctttctctgagttaattacttctctccactgttactatggtgatgtatttattctgctttaatagcatttatcaatcattttgtggttatattttatgatttctctcttcctcctagactatgaaatccttgactgtagaattgttggtttgtacctacattactgcagatagtatctggcaagggctgggctctcaataaatattgaccaaattgaggctgtaaagattccaatggaccaatatggcttgtgacccatgcttcatttacctaaatgaggccacaaggctctgtgatcacgtggcagtcaaataacaaaactctccaaaatcaggatttcttcttccattccttcaggttccctcccccatgggcatggttatctcatcctttacctcctggaaattatatattggaggttgtcagtgtgtgctgttctgtattgccctatagttaatgcacttctctgacgtagaggactgagctctctatagaactatgcagtgtcaaggaccctctgccttgacatagatgcttggaccacactgttaggtaactgagaagacaaagaatgtggctagaggctaaaagggacagagcaggaaaagcatgaagggcatgaaggaaggagcttgaatttttttcccaatgtactggggagcccaggagtggcatcactttgtactccagcagtgacattttaatttacaagccaagaatgcactgatcgccaactgcaaaaattgatttggttgttcatctgattcaacccatgtcagagtttgaaagtaattatgatagtggggctgataggcaggcaattacatttttgttctcttgctttctggctccttctccctctctttcccttcccacacctccacctgcaaggttgttcttgtcaggaaggcaatgtaagcaggagacgagagagtaatctttggagatgtggtatatggactcttgtggcagaggctataataaataatagtatggctggttctttatcctaatttttgttagcctcttatgaactctaaccagataaaagatgcaaactattttgtctccttctttaaagtacaaaatagaaaaagcacatgtactgtaaggcagtttctgtttctgatttaaatttgagttgtctttgcaacatctatagattcggtgtctttctaaaaaggtttgctccaaatcataatacaaaaggaacctgggatagggagagatttaggcaaagctaaaatccatctgagttggggagcagattccatgggagactgaaaatgtgtttcaaactgtagtgcaagaaattgaacaaagtattggaatttttctaaaaaaaaaaaaaggttcctttgctgaaagtagtacctggcatgtaaacctaaagtaatatagaagatgaagtggaaaagtatatcacaaggcaaaaattactttttagactgatgaagagatggatggatggatgtgaattttttttatctatttcttattttgaaggttatttatttattcacaaacactggaaaattcagtgtttttcactgagcaaaatagcttgtctggtccaaagccagtaaaataagaattttgtgggtggggtatctactccattagtatagcaaatgttgagatatataaattattttaatatatttattttattgacaatataaaaaaaaatttaacaggctccacaccaaggtcaatagaattcagaagcacatctgtcctcccaggaaacttgtggtttaactatttactatagctacctcaagattttacagaaaaaaaaaaaaatgagaccttctcttgaaaactaccatatcccagatctaggcttttctatgcactgtaacttctctataaacctcctttctactgactgccccacttcaatttggcacatacaccctttaaccagtaagcatgtgcatgtagtcagtgtgtcagacaggtttggctgaattgatataagactggtagcataggctgggcgtggtggctcacgcctgtaatcccaacactttgggaggccgaggcaggtggatcacgaggtcaggagtttgagaccagcccggccagcatggtgaaaccctgtctctactaaaaatacaaaaaattcactgggcatggtggtgcgcgcctgtaatcccaactactcaggaggctgaggcaggagaatcacttgaacccaggaggcggaggttgcagtgagctgagatcatgccactgcactccagcctgggcaatagagtgagactctgtctcaaaacaaaaaaacaaaacaaaacaaaacaaaaaaagatgagcagcatggaacatgatgttggcatgaggccctactacccggcagcagactatcagggaataaactagataaacctggaaaatgttttaacttcagtttattttattcacattaagtaatggagtagcatgttgtttgtttgtttgtttgttttacctctaaacctcctgtatagcccccttttaaaagaagggcaggggaagaggcttaaaatatggtagtattgactcccaggcctgttcagtctatacgaattttcaggctgtatagtttaaaaaaaacattgttcaatttcttatacgtttttactagtgatattactttagaaatgggcctcgaaagactcaggttacttttagatttgttcagggtttaaagcttcttttaggcacttcttgggcttcttctacctttcactgtaatatagtggtgaagagaaagactttggaatctgatagatttgggtcagaattgtagttttgccactcattacctttgggtaaccaagctctgtgaacctcagtctcttctgcaaaacagaaatggtgacatatttcctaagtctcttggcaggattaaatggaatacagtgcacaaaatactcagcacagtgcttggcacatagtaaatgccgaattaatggcaatgaattgttgttgttgttgttttctttttgagacagagttttgcttttgttgcccaggctagagtgcaatggctcaatcttggctcaccgcaacctctacctcctgggttcaagtgattctcctgcctcagcctctcgagtagctgggattacaaacatgggccacccatgcccggcttttttgtatttttagtagagacagggtttctccatgttggtcaggctggtctcgaactcccgacctcaggtgatccgcccacctcggcctcccaaagtgctgggattacaggcgtgagccaccatgcccggccaatcaattgttattgatttattactgagattgctttaaataaattcatccttatttctgttgtagtctttaccttgtctccagatctttggaagtctcaggttcatttgtctggactttgggggttttgtttaaaactgcctagtctctgcagccacatcctccaccactgtagcacatgatcaaaaaacttttctctgaggatactgagtatttcttagacctatgtcactagctccctgggaactctctctacccccatcccatcaactctctgaccacaagttttcaaggaatcttcctcattatactcatctatcattcttgcagttttctgtctcatcttgagctgttggtcaagagtagaccagagtatccatttctcaactcatttcttaataaggcaacaccatgttcaatgggcattcattgggccagttgaggctcctctgtaattttattttattttttgagacagagtcttgctctgttgtccaggctggagtgcagtggtgcaatctcagcttacagcaacttccgcctcctaggctcaagcaattctcctgcctcagcctcccaaagttctgggattacatgtgtgagccaccacgcccacccttctctataatttaaatgttatctctctttataacattttcataagaggatccacaattctattttcccattcacttataaagaacaaaaatatatccctaaggttccacaagtacctctggcctttggggaaaaaaaaaaaattcacagatgcttttttgaggaggtaattatttgtttgttgtgtccttgctattcattttgagatagatactcaagctctacacctcttagcttatataccagtttcaaatttatgtctttattatttattataaaatcttttaccagctgggcatggtggctcatgcctgtaatcccagcactttgagaggccgaggcaggcagatcacaaggtcaggagatcgagaccatcctggctaacacagtgaaacccggtctctactaaaaatacaaaaaaaaaacaaaattagccaggcgtggtggtgggtgcctgtaatcccagctacttaggaggctgaggcaggagaatggtgtgaacccgggaggcggagcttgcagtgagtcgagactgcgccactgcactccagcctgggcgacagagcgagactctgtccctaaataaataaataaataatctttaccttgaatattgagatgggttcaatacaatctcaatttagaatacttaaaagatgaaaagttccataaaataaattttctaatcaacagaaaacattttgttaagatgttgctgatgcaaataattctagcatgtatcactgttagttttctatctttgaaaactatcattcaactaccatcgtagttactagacttccattcaggatcttgcatgcctaagagtcatttcactgccaaaaatgaggaaatatagaaaactgagctgtgtttttatcatctaccatttcaaaaaaccctgtggaaaaaatatttcttttagcaaatctcagacattatcttgacttatatgtaagatgtacctctctctttaaatccaagtgcattgaaacttctggctcataaggtaatttttttttttaaataattaactaaacccttaaaactacatagaagtctactttgttttataaattaaccccattattttaggaattaatatagctttgtcttgtgagatgctgaagttatttttcctggttcttaatattcagtctttccgcttatctatttaattcctgatcactagccaaactatatactacagtttggttcatccaatttaaatagctggcctgtaactaagaaaagaaaaatatattttgtgaagaataggtatgaggtagagaaattagtggtagtatgatacgggaaaagagtaatgtcaaaatgcatggtaatttatgtgatatgccgaggactgcaagaagtcaagaaagaaacataacaagctaacagctgtcaccaacaaatagcaattaatttcagcattcattcccttgctcatgcttcatgaaagtatataggtaaacaggattcgtatcatgttctattttcttctctgggcctcaggcttccagccctctgagctactgtcttataacattctgaggatgtaagaaagaacttgatcctgttttctttttcagtctggagcagagacacggtgaagttcagtaaggtctgacacccattagcattttgtgtgactcaggatacgaatcaaacctactgttgtggaagcagctttccatataaatctaattcccaccaactcctgccaccaccaaagctaatagtcaagtgcttgtattgctgatagcaaaggtccaagattattcttattgttttactggggctacttatcaaaatctatttacttgtctattctatggatggggaggtggtaaagaaaaggcttaagtgtcctacagagattcattctatgctgcctcaaatgctttgaagcagtacaatttctcttttaactgcctcgatgtaggtgaagagtcttgcaggatatgttcactgctgaagagcaagcctgcctcattcataaccactagtagctgacaacctttggattctttccacagcttgaaaattcctccattccttgaaagcaccctgcactaatgctcgaagtattaagtgtgtttttatttcctagaaggatgcattttacacaagtcacttaaaagcttctggaagctttaattacaggttgactaatatttagaagaattgaaatacccctctctctcctctgtggtatgcatgagccagattctggttcattaaccagaagtctattacttttcccctatagtttcatggagtaaaatggtagatgcaaaccaagagaggtcaagggacctgagcttggttctgtctttgtcacaactaagagtctgaccttggatgagtcatggtaagactctgtgtcatatataaagagtattctgagagtaaaacacgcatacaaatgaaaagtatggttattatggtctcttgaatattcttagatcaatttcacccattggatggggctagtatatggttgatggatggtatttgtttcatttatctggcatgcatttaaatcttcaggtgcattaaacgaacaacacaaatttggtatatgattttcatgctctcttgcatgatagatataaaatcttaatcagtgattgtctggaaaccacagtctccaaaatgctgcctaggagtgctaaagagctgtcagatctaacttatatgagttgacaacatagagaagagaaagaagttgaattcagttaaacctggaaggagaaacccatagggtggaattatctgaatttgaatttttctgagttttattcccccctacattatgacacactaataagtggtctaccttgacccagagatacgaattttggcctcatttgtagaatagcacctggattcaggaataactccttgaagtgtcccccttaaatctctatgtggcattcaatgttcacttactcatagaccaaggagataaggacatttatcttctcaggtaaggtccctctgttgaacactgaaacaaaggggttacattaccactgcctatctttcagaaaaatgactgctgtgatagcataaatgtcccgagagctttgctttgatagaagtgtgtttttaatgatatgattttggtgtctggccctctgtggatagcttggcatgtgtcttgttctatttaaacagcactgactgataaagtggacgttaattggcagttagtgacgaggctgcaggtctttgttacccagcctttcagctaactgatcattaactaggaggaaatgtgtgacccagaaggtcattactgttattacgtgggaaaatacatttaaatgttacagattgcttttttatgaatcaggtgagcatttttagaaaagagagagcttgatttacaatggagtctgttttcagtcctgctcttttcctgtccctttgaagactaaacggtatatttctagattcccattgctgtattgcctagaacctcacaatgttgatattgactaaaaaacagaaatttcttcaactccattaagagcttttccaaaatcttaaaatttccaaataaaatcctttcgtctggatgccactcactttaacaagctttgagtaactttttttaatgaaaatgtgatagaaagtaatgtaactgcatatgttttattatgtaaaattctgatagtatcatgtatgtctttagaatttccgttgtcacacattgtctgtgctttgtaggattttgcagattaagccttagcactcattttgtgaggacagtgaatcctaattcctcttcttcattctttctgtgacctttttgattttgcctctttagtaatctcctcactgcccttgtaatgcaaaaaataagaataaaaatggtctgtttgggtgctgtgagtcttggcaattaaaacttcacatgaaatttgtctcctgagagaaaatattattctcccttttaataaaaggatacaattaaatactccctgaaacctctctccttcaaatatattgtcttatgtaaaagatggaaatggagccttgtttagctgaaaaactgaagagccaaaaacatttctaactataaattagtttatgcatattaaatatcccagccttagctctaataaaaacaaaaaaaatgtgaagcatggtgtgctctgtggttattaacctgttgttgaaaccctgacttcagttctaggcccttagcatgattacttctttccttctttgggttgcatgatgcttcaaggtctagaaatgccaatgtctttcccaaggggttttaccttttacctctgaagattgaagaaagcaactgagttgttcagaaatctctttaaattagatttaaaaggtactgggtttatttttgcatgtcttctttattttttcctccaaagattaagattgtattttagaaggctcttttggctcctttaaaaagaaagtttatccttgtatcatataggactgaaggagataggctgcagtttgaaggcaagagcatctgatctccaaagaatcagaaaatctcttcttttgttgcatttgtaggtactttttgttgtgttgcttttttttttttttttttttttttaatacaggtaaagttcaaacgagcacagcatggtccaaatggtgtttaaagctgtctaagtttcctttatgtaactttcacttcaacaagtatgttccagctgggagtctatcgggctgttaaaattaactttattcttcttttgttattctcatgcacacacacatacacacatgcctacatgcacatgtgcacacagacacacaggtgtgaacatgaccatttaatcacatccagcagggctgaatgtcactctgcggggctttattgactgttgtacaggctaaacatttcattcagttgcaagacagaaaaactctgcaggatgaatttcaaaacagagagcagaattgttacccacagataagaattctttgtaaggctttcaccttctcataaaagtgttagttaagaagaggtgaaaacaggtattccattcatctctgaagtgtatgcagtaatggcctcattcggctgagatttcccagcagcaaaaaatgtgcttggcagaacagttgctctaaatacctgggacatacattctttctaggattaaacaaataatacttgctgccctttgtataaaaagatcacttttctggtgcaccattagtgtacatttgatttgatttgtttgttaagcagcaaaggtgggtttccctggagccacttacacctcctctcggtcctctttgcctctggctgtatatgcatgttcattctaccacctgatgacttcatgcttactctgtgttctaactaaatcgaatgagtctcttattcccattccttcctttttactttcctgcctctaggcattaatttgtgccatttacctggactatctgctcccacctttgactattaatatcctatttattattctatcaaagccaaagaccatcatccccatgaattcctctgacatcccactcagaatctatctctctttcctcagagcacagttttttttctttttactatcatttaaggacagttaggccaaacacttacctacttaattataagcttcttgaggatttgggccacttcatatggcttttggttttccccaaagcattagctccaaaaagaaaggttgaatgaatgattggtgagtcatcaaccttggcatagttgggactaccctttgagaccactaaccagaatttttctcaatgaaatgaaatttattccccgacaaattgactgcaccatgttagtctccttaacatcatctgctgaaccatctcttaagaaacactttgatactagatggtaaataaccactgtgtcaagacctccaagtgccctttacctccaggtcacctgtgttcctgcagcaagacacacctctgtccccaccatgaggcagaatgaggcttgggacagataagacttccagaacccagctccagcactgtggccactgtctgattaatcagttcttcttctgcactgataattaaatactcactgttaaattttatattacccttgctagtatcattgttataaccaatgtgacagccacaaaagagaattaaagctatagactgtttatggactgtcttcacttcagcacagcagggaagaaaccagggatctgaataagtactagggatccttgctcattttcccaatttggctacaaaagttaatgaaattggggccaacgcttaaaatgcagatattgttatggatacattttatgatataaatagagatacacttgtttcatggaggggtaactagggacttagatttcatttggacctatgtgtgccgagcaattggaagcatattaaaactgttttatgtgtaagcatttattgcttttgcctataagatgttgcttatgtgggaaattaagagtccagtccaatgtattcctgggtatacagcttatgaaggcatttaaaacctaaagcatatttattctgcatttaaaagtgtttagagactgccttgtgtgttaatgtgtgctgtgcgactagcactatttaaatcctatccccctgcatgcattaatgtgtgcgtcgaagggaagaagagcaagggatgataaactctgttaactgcccaatgttcaactaagatttatgtaagaaagaacagtctagtgcattaatgtgaatattctaagatagatgtttatcttaatggactcagaggtacttacaaacagcataattgctgaagtcattttacagggcatttattcagagtgattacactactcttacttttctttacataaagaattccacttaagggtttaagtgagacaggctagtgtggccaaagaatcataggttcctcctatctgctgctcagcgctaaggctatttgaaaggaggagaagcaaaaccccaaatctccattttggcactttgcaagaaattggtccaaatgttcaatcactccagttttcagatctacatgatatttgacttactttaaacctatagtcctgcaaataagaaatttatctctctggtacatggttgtagaattcaaacattagttgtttatggacttttatggaccactgaggcattttctgtcttgaaagcaaatgtactcttccagagaaactcctgttctttttttaaagttttatttttaactgacaaattaataattgtatatataggtacgacgtgatgtttcaatgtctatattcattgtggaatgatcaacccaggataattaacatactcatcacctcaaattctttgtagcaagaacatttacaatttattcttttacatgaatgaattttaaaatatataattttgaaataggcaattcattattaactctagtcaccatgctgtgtaatagatcagaatctacttctcctgtctgaaactttgtagtcttcaaccaacatctcctcattccccattgacctttcctttctcagcctctgataaccaccactctactctctatttctgtgagtttgactttttagatttctacatacaggtgagatcatacgggatttgtctctctgtgcctggcttatttcacttagcataatgtcctttagctccatccacattgttccaagtagcagaatttcctgctttttaaaggctgaatattattccattgtgtgtgtgtatatatatatcacatttaaaaaattttattcatccattaatggaaaaccttcattcttgaaaaaatagcttataaagctatttatgtccctgatacctccaaagatcagaatgagtaataatctcacaaggatgggaaatacttcctctcttccaccttttgcatgtccatcctttgaacatgactcctggtgtgttagtctagtctgttctcatgctgctaataaagacatacctgagactggctaatttataaaggaaagaggtttaatggacttcacagctccacatgactgggggggcctcacaatcatggtggaagacagaagaagagcaaaggcacatcttacatggtggcaggcaagggagcatgttcaggggaactcccctttataaaaccatccgatctcatgaaacttattcactaccacaagaacagcatgggaaaaacccacccccatgattcaattacttcccaccgggttccctcccatgacacgtggggattatcgcaattcaaggtgagatttgggcaggacacagagccaaaccatatcacccgtcttacccaattctgttgaaataaacagacatttcctgagtacctgctatccattcaagttttttctatgagctaggctctggtccaggagtatagtaaccctacgggtgatttcagaccaataataagtaacactattaagaacacatcacagaagagtaacatctctgactcgctgatatccatttcaaaccacataacaatagcatgaagtagatgtcactgactcaaattaacagaagagaaaactagggtgcagtgtttgtgattaccttggactctcaccataatagactgagctcatgttttctgactcaaaacacaaaacttttcccttgatatagttgcctctagaagaagtcccttgtctccctcaaatagcaatcaagtagaagggaaaatagtgtaagtcaatatatattaagtactttcagtgtgattccaagaaactattgagttgcgatgctaaagggagcattttatttttcagccttgggatcagaaaaacattacataaagaagtgtttgggttggaccttaaaaaaaggtataccatttcagcaggtataaatggaatgaaatgcaaatagagttgggtaaggagcagtataagccaaaacataaagttatgaacttaatacccttgttcagagaattgaaaacatttaatagtcagtatgtggaggcatttatagggacaaatggtaatggaagatgatactacaaaattacactggagtccagaggtggaggatcttgaattttaattttttttaagtctagacttttgatagtgagataaatttgaaccaacagagtgaaacatgaaaactatatttttatcctggaagtactttctagagttcattaacaggaggaggtaagggtagacagggagtctgggtagggaattttaggattcatccacataagcaaccagggaagtaggaatgaaaactggagtaacattttagagatggctttgcaggacttggtgcctggaggtgtgacggggagcaggaaggatttgttacaggaaagaggtcccgacttagaccccaagagagggttcttggatctcacgcaagaaagaattcagggtgagttcacagggtacagtgaaagcaagtttcttaagaaagtaaaggaataaaagattggctacttcatagacagagcatccccaagggctgctagttgctcatttgtatggttcttgatgatatgctaaacaaggggtggattactcatgcctcccctttttagaccttatagggtaactactcttgtcccttgatgatatgctaaacaggccatggcatttgtgaactgttatgtcgctaatgagagtgtagcagtgaggatgaccagaggtcactctcatcgccatcttggttttgatagattttggctagcttctttactgcaacccgctttatcagcagggtctttatgacctgcatcttgtgctgacctcctatctcatcctgtgactcagaataccttaactatctgggaatgcagcccagtaggtctcagcctcattttacccagctcctattcaagatggagttgctctggttcaagcacctctgacagatttaaagatgaccctgagagtttgggcttgttcctagagagtaaggacaccatagacagaggccaggaaggcagcagagggaggagttaatcaattcagtctgggatatgctgactgctcatgtttccaagatatttaatcaaaaatattgtcccttatgtgttagtctatgttctattactataaaataaacttctgagactaaataatttatagagaaaagaggtttatttggctcacagtctgtaggctgtacaagcagtgccagcatctgcttggcttctggtaaggcctcaagaagctttcactcatggtgaatggcaaacagggagcaggcatgtcacatggtgagagagggagagagggagcaagggagacaggaggaggaggcgccacccttttttttattatttaattttttgagagggtggcacgatcatggctcactggagcctcaacctcccatgctcgagcaatcctgctgccttagcttcctgagtggctgggactacgggcctgcaccaccacacctaatgtttaatttttttttaattttttgttgagatgggatttcattattttccccaggctggtctcaaacttctgagttcaagtaatcctccctccttcatccccaaaagttctgtaattacaggcgtgggccactgtgtctggcccaggctctttttttttttttttttttttttgagacagagtctcgctctgtcacctaggctagagtgcagtggtgtgatctcagctcactgcaacctccgcctcccaggttcaagcgattctcctgcctcagccacccgagtatctgggattatagatgcatgccaccacacctggctaatttttgtgtttttagtagaggcagggtttcaccatcttggccaggtgggtcttgaactcctgacctcatgatccacccgccttggcctcccgatcttgtgatccacccgccttgacctcccaaagtgctgggattacaggcatgagccacctcacccggtccagctcagactcttttaaacaaccagatctcatgtgaactcattactatggggagggcaccaagccattcatgagggatccacccctctgagccaaacacctcccaccagccccacctccaacattagggattatatttcaatatgagatttggaggggacacacatccaagctgtggtgggcattgtaatcacggtggagctttcctcatcaggctgatacccaagtcccacccctgggtattgctagaatgtcacctggtgactaatgagtgccaaaggaggagaccaatcccgtggcgcccttgcatcctctctgcttgtggttgctctctctgtattgttctctctgttatgattggctctaacttccattaagagaaaacttgacctgcagtgactgaagacaggatacattttcttaaacaagaattccgaagtttagagaacataaaactgcttaatttggctcctataataggagccaaatttttattttataataaataattataataataattatatattgtaataattataattaattatatattgtaattataattaattatatattataataattataattaattatatataataaattattttattctaatttattttataattgtcaagtttaatatttgacaatatctgagtcagcttcccagttcttttcttggctttccccccaacttgccaccttatgggcacaagctgattgctgcagctccacatgtcccgtgcaaacccaaggaagaagggaaagcagtcagaccagccaagtctttttcgttttatcaagaatagaacaagcatttctagagcctctagaggatttccttgtttagctctttgtccagagctaccacatggccacttttagttgcaaaggaggcttggttaggccggtcacattgccagctctcgcaaggaggaagaggggaatggatattgacaatgtctgcaatagtcatcttccctgctacgctgaaagcactttaaaggcaaggaccaagctccgtcaggccatacttatgtccgtgctatgccacacttctcacctggcactttgctggacatatgaagacctgagatgagaagggtttgaggagacacttcctgcccactgtgctaagcactttcttgtgtcttttgggttctctgagcagctgtaggagtatagaagcctccagatatacgttaaactctttttcagcacctctcaaaacagaaaaaaaaagcaagaaaaagactacaagctgggaggaaatctatgctgctgtaaaaatagaatagggctggagtgcattcttcagtaatgaatgcatgaaaagcagcctcttcaattataaatgtggcttctcttgtttgttgcccagtaattctgttttattgatttctgtttacttccaatcacctcaaatgagactgtgttgcttagagatcttgatccctaaaagtttgtcattaaagctactctgctgtatttagttattttttgctcaaagcatttgaatcaatatgtatacaaacgaaacactttttcctttgctccctagaagactacaagaaaaaagaatctagaaaaactaaataaagatgcttagatttttttaaaaaaagtcccagcaaatgacatattgatttctttcaaagaggcagagtgtaaattaaaaatatttttctgacacagtttttaaagatgccactgactcagcagagtttgtgcttattgactttctcttcctagagggccagggtggaaaggccgcccacttttcctaagatcagctggctttcaaaatcctttgagggaagttagccttaaagccaatgcgagcaaaggttcttgattccctgtgatcaggtctgagttccggttttgtcatctaccacatcacttctgtgtataaaaaggtgttgtaatttttttttccagaaaattatatggtcatcattctttttcaaagtggttgcattaaaacccagaattctcagaggtggaaataaacaaaagctgcgcccttattagagaatactctctggaatgttattaaatgggtctgggcagatagagaggggagttagagtgggagcatgtgcattaaaagagccacaccaatacaggaatactagtgctgtttcctcctggtacctttgagagaataaagctagtttagacccacagtcggccgggcgcggtggctcaagcctgtaatcccagcactttgggaggccgaggcgggcggatcacgaggtcaggagatcgagaccatcctggctaacccggtgaaacaccatctctactaaaaatacaaaaaaaaatcagccgggcgccccagctattcgggagcctgaggcaggagaatggcgtgaacccgggaggcggagcttgcagtgagccgagatcaagccactgctctccagcctgggcgacagagcgagactccgtctcaaaaaaacaaaaacaaaaacaaaaacaaagacccacagtcatgaggctaggagggaagcacgagggacctggtttcaggaacataatctatttgtcataatttgagtttctgaaaccatgtcacactcctttggcctgttcaaaatcatttttcagaactgttctcagggttagctatataatttgtggaaaccaatgcaaaataaaactaagggcccccttgcccaaaaatccagaaaaaaaagtgttaaaagtgctagaatagaatttcttttctctttcttcaatagtctatttgttatgttttttatttgctattgaatgacatttaagtaaataaaaatgtaaattagcatgaatattaccattcgtccttatattgtgtgcaatgccagttttaaatccagatataagagcattcagctcaaatgcagaatcattgaaataacacaatttgtatgtcatagcccatatatgcatgtgtcttttgttcttattggaagagtggaaatgccatccaaaagtaacttactgctttttgtttcacttcttgatgcatgcacattctaccaacgctttttaacttcagcctaccgatgcatcaggtagaaccaaaaacaagaggtctcttgccctgtgcaagccaagcctttctgattagcaatcctagagagaacaggtggctcacgcctgtaatcccagcactttgggaggatgaggcaggtgaattacgaggtcaggagtttgagaccagcctagccaacatggtgaaaccccgtctctacaaaaaatacaaaaaattagcagggcgtggtggcaggcacctgtaatcccagctacttgggaggctgaggcagaagaattgcttgaacctgggaggcggaggttgcagtgagccaagatggtaccgctgcactccagcctgggcgacagagtgagactctgtctcaaaaacaaaaacaaacaaacaaacaaaaaaacaaaaaaaaaacaagaagaggtctccgggttgccctatctttccctttcatgtcatcgtctttactgtaaatggttggttgatacagagacttaagaaaggatgtgataggttctcctgaatgccattgccttctctctgtcttctaagcaacttctggttcaaagggagagcatgagctcctggggatgtcagtgttcctactcagcctgtagatataacatccttacctattatacagaggacacgatatagaatccggagagaggaaaagcaaaggaggccagctttggcctgagaacttaccctagtcactcttgcctagaagacagtaccaacctcccaaggagaaacattgggggataaattcaaataaagctgtttgattcagattactcctatatgtaagtgaatccacaggatcctgtgccattggggcatcaggaacactatatgaggatgagcagcaaggaatggaagtggacacacacattgcatgtatctcctctgcttgctttcatgccgcactgttccactgaacttcacttacaaaacacaagtgcaaagataaatgattaggaatttcaagatggtaagagcagagcatacaacctaacaaagggtctttgtgagcaaaaaaccctgtggatgacctcatggatctcatgcctgtgattacacctgctacatttccaacacccattttgacagcaaatgagtgttgctgtttatgaactggaacggggaaaattattagcctcactgtctatcagaaatgagaaacaattcatctcatctctttccacatagaagttctgttgtgtttgcttttgtaaattattttgaatcaatatctaagatgggtttatctatttactactaattgcagcctgggaataaggatgtgacttctggggttgagtgggcccatctgggtttctgaacttctcaatttaatagcacctgaagacattccctacctagagattttttatataaatcatagagctttatgggaacccatcctcccacatttctctgtgggaggttggtatttccttctaggcatgaatagggataaattctcaatcgaaagctgacctcctctgcatttttcctctactgggacttcataccatgttctcaaattgactctcatttttccttcatagttctgtctcaaacttactggccacagatcacttgtaactccctattttattaagtccagtttcaaataccaaaacttgctttaacttctgctattgctgtaacacctgtctctgacttttctaacattatattacatggctgagtgggatatactttttttttcacagtgtaataaggaaaagatagccttgtatttctagaagttgtattttatattcacttcattgcatttgattgttctggataagttttctgtgccacatactaagttttgggatgtactaacatgcactcttttcttgtgtttacatcttcttgagcttgcatctctttcttagagggaaggcatgagggaggaaaataagaagaaagaaagggaaaaagggagggaaaaaagtagatttggtctttggagcttcagttaaatttcccttataatggttagaccctaaatactcaaaatgagtatttgtggtgaaaacaaaagagctgacagtggaaacacagccaagcctttctaattagcaatcctagagaggacagcaccaataagaaagaagagcagccatcaaagccaggcctttatatgtatgtaatcaacaggcatctgatctagattcttaaagatggtgtggtttgggtgggtgattttatttattttatttttctgtctcctaaataatatgtaatttcttcaggccaagaaataaattgaaaggatttagagggatttgcttatcagtggaacaccacgtagcattacattcctcctgcttttgggaaggtacattgaagtttggttaatcttctgtggttcaatactcctcttccctctgtcagcctgccttgaacaacagattaatcccttttccacccactctcttctccttcctccctcccctctctcttgatctacccttccctttttgagcaaatagaagaaaaatcttaaaagtggggggaaaaaaaaattaaactgctgcactacatttatttatataatcctagaagacctcaagggtagaaataaaggatcccaatcctcggcacaaaatttggccaagcttagcttggtttttctactgttaattaaatcttgagtctgcaaagggatttccttaaagactaattcattagcaaaagttattataagtcacgtcattctttatcctgctctagtatatgcattgtggaaaagaagaaaaagaatatgctggctattgaggatgggtagaggttttagggagtgggtgatacgatttgcttgaattcctatgtagtctgctgtctttagtgacaatgaataattactgttgggtgacgcttatgagcccaacactaattttaagattttatagctaatgatttggcaactaatcagtgttttctggtttgacttggcttaaatctcagtagtctataaagtccatgaggacaaggaccaggtcagcctggtcccaagcacagtgattgactggcacatcataggcaattaataaacacttgtcaaggaaattagtgagtgaatgagtcaatgcaaatgtcagtacaaatgtaaataaaatcatatattcagaatatttttttaattcagttttagagagctctgttccaataacctaattttggtcagacagaatgcaatatctttagctcagggtgattctctttaaagctatctcatttcatggctatatgagcaagtaagttatgcatgtagtcatatcttggcaagtgattatcttcaggagtaggtagagggaagaggggaaagtaatagctggaagaacccatggcataaaccttgtaagacagttttaaaattcacagggtgttgttccaatcgaaatacttaagctcatagacataggatacaagggtcaccttagatagtatcttaacaagactagaattctgtcccttcacctccaacattcaggacctgcttcatgagatgcccccatctttcacacctgagtatgacaagttagagtcatttatgtttcatttgatcataacaatgtcagtggctttcaaaggtaactataaatgggatgtttaatcagaataaaataagagtataggtatgacagtcatacaatcttaccacactgtgaggttgtttctgtattgggcttaaattgagtgagtgagagggatgggggagagagggagataatggcttctaacaagcttgcccaagctctatgttttttctagttttgattacatataaaaatcattggcaagacatagtggctcatgcctgtagtcccagcactttgggagcccaaggtgggtgactcgcttcagcccaggggttagagaccagcctcggcaacatggcaaaaccctgtctctacaaaaaaataaaaataaataaattattcaggtgtggtggcgtgtacctatagtcctagatacctaggaggctgaggcaagaggatcacttaagcccaaggaggtcaaggctgcagtgagccatgattacgcccctgcactccagcctaggtgactgagagagaccctgtctcaaggaaaaaaaaaaaaaatcatccagttgtatgtgtgggtattagcactgatcaaagatgagactgtgatggccacaatttagtaaagaaaatcttaatagatacatttaaaaaaaaggtcaaacttttcaaatctcattaaaggttataggtttacttagagtcaataggtattaggtaattgaaaaactcaggcagcttgtatttaaatagagaatgaacattcataatgaagctagatgggtcctctctcatctgagatattcagagctccaactccatctcagaatgaaggtatagaggggaaagaactaaaacagcaaacatttaaaggaatttaattctttttagcgtggagcagctgcagagatgtatggctgttttctgtggggcttcagaatatttatgggcctttcccttttcctttttcaccggaagaaaggagatcatcattcttgagtgtgttatttataatttcataaagctgttctgtggcaggacttattttatctcatactaaatctcaaataactgtgcttccaaggagatgggtggggaaaattgattatccctcaaaatgattagcctattaccagtgtaagataaagagctgaagggtggaatttgaagttacaaaaggcagttgggcagtaaggaggggacagagtgaaacggtcttgagcagttctgatcacagctcacagcagtagacacttttctcatgcccaataatggattaataacgaagaacagtgtagaaccattgccaagaaagggtaaaacccttctgagtacataattagaagccaatgattatagaagcaataactcactggaggaaaatacgtcagatttgtgaaacttagggaattggaaggtaaatatacccataaatttacttgggtggacagagttctgagctttcttctgtcccagctttattctaaggtaatttcaataaacaatgttaggaggaaaaaaagaacataaatgcaataaaaaatcttccaggaaaggaatacatagggctcctgccagacagatattttattgaaagttattataatacctatctttagttttatgagtcctaacacagaacaaagtaatttcaacacgtggattaaaaatatgaaatacatattttaacatgtagtagtatgaattattgttttaaatataggacttggctaatatataggggcagaggaatatttttctccccttgagaaagcaagttaaggtgcttaatatgcattgtgaaactgcattgcagtcatactcatgcactatgttctataaaccatgtgtagtagcttccaaccaaatgggacagatgacactggtgagatgcagggagtggagaaaggagagaagtctgatagggcaggacatgaaattcatgctcagtatctaagttttcaagaacaacatagctcaagtagtggtcacactgtcattctagtccatcccttccctccagtcatcctctactactagtgggtgtataaataaaccgtgttttagacctctaagcctttgcaaatactatttcacctgaaatgcccttctccttctccagcccacccgtcctcacttccttcccctgtctcaccactgcctgtccctgagggctcatttcccacatgctctctgccttcttgctatttccttccttcacacattaatgcttcctcttgtcagagcattcggtttactacatcaagtttgcctgtttacttgcctgtctcatcagactgtgaattcccagagcagaggaactgtgtcttatctatagctttatcccttataactgttaaagtgcttgacatataggtgtttgaaaaagattcattaaagtaatgaatgaatgaaaaaagcaccttgatgacatataccactgacagtaaatctaacagcccagccactgtgaaaattatttggtgggtggtcatagagtttttaaaaaatgcttccttgaataacttatagagaatattggtatttgacataggggaaccatcatacgtcagcactttaagcatagccattgaaagttatgagagctttagacaatcattgtgaggggaaaaaatgtgaagatgacattgaacgcaacttgataaacattcccaacgtaactatgaatagaagagtttcctaaagcaacactgtttcctggaggagcgtggatggtggacagttaaaaataacaattcactacaagtgtttatacccttggttacagtgaatactaaattaatgtgaattaacagctcagcacaaagcctaaatgtagccagtgtttattaagtggtaaatgttattagtaggcatgagtctagatagtctagatatccatttctttgcaggcatactaactgctctttcttctaagtaattaaaagtaattacagacaatggttgtgattataggaaaatacacagacatgcagcctaaggctaccacattttattaaaaggcagagatccaccaatttgttctacttatagcaattctattctgagtctgagtctatctgcaacatgaaacctgttttacaagccatggaaagcaatcaaagaagtgtgccttttctttcaaggttcaacatcagatcctgcatttgcttacatctgaaaaagaacacagactgaaaaagccaaaacaacaacaacaacaaaaaactgctaaaagaaagccctgggttttctgaaagtatctttgaatccaattgccattaatttaggatatgatcttaagccgctcatatcatccaaaagccttggtttgtaatgtttggattttctagatgttagggacaaaagtagtttcaaaaaagtctaagtgtagcattcctaattctaagcctttttgcaaattaaggcctctggcagaggaagtctttccatactacacagtgttctgtggcaggtgtggccaatgttgcatgccaggttcttgaggaaaacattggttaccaaaacaggcaaagagggactgagatgtttgtaactgctttgggagtttcagttggctgtacctctaagtggtaacgatgaggtctgaaagacacaaaggaaggaactgaattcatataagacccacacagattgtctagattcacagccactgagaacagatcacctttgaatgattgtttaagctctttatgagtacatttttctttatcactcctcatggcaggtgcaaccagaaatagtatgtgtaccataaaatggaagtaatgaattgtcagcaacaaagaacacttctaatgtggggtaaatcgtaacaaatagagcacataggcagataccaaatttatttaaattaggagtggctatcaggcttggaattactttgattgagaggctgatgttgattaattgtgaagttaaactatgatgttgattaatagtgaagtaactaagtgacgtgtgtgcacgcacacacacacatcccaggtcactttctgaatctacgtagaggagttgggattcacagttgtgctatgtctagggccaggcccattcttacgacacactgctggatcatttccccttcaaactcctttgagtctgggcaccattgctaggagctactggtaaaatgtggttctgttgcctgggaagaacactgtattcacatgtactcatatagaagatcaacagaaaacaaatctttgggcaaagtggagcgcagagagggttaaaggtggaaaaagggggtcagaaggtgaaagatgatgtgtggggtctgcaatggggattaggggcccattcatgggatggaattggaggtagagaaggggtgggagagtggggctggggatggtgtcacctaaaccacaggggagagaaacttagtagtatgagaggaagccaaggaagctgagaggaagacagtatcttttcaacctcagagtctactcctttttctgaaaaaaaaaaaaaaaattacatttcttcttttggcccatgcaaatgaagaagtctcctctgagttaaagattcaactaatattatgttaatgtatgttttggtttctactgaagttatgcattgttttttaaacatttgttcaatggcctttaaactttattgccaggctttcagttcttgaaaggagctcattagattttcattaactcaccagctttcactcaatactagggaccaaagtcctaccgggccattctgcaaggcccttacagtcaaatcattaataatttccagttgaacacacttcagcagtgtattctcagcctctttattaccaccatcctaaggagttttttcagataagttttccccctaattgcccttttcccacaacatttcaattccaaagatatactacatattcatttatgtaactgtggccttttggagggtcacaaaccattgtaatatttaagattgtccctcagcccaaaccaaactttcctgcctttggtgggagacattgcccctataaagaatgcatgcttaaaaactactaaacaatgattgtggtccttccaaaatagtgttttcctcttataattgccgtatttatttcaacagttaactcttttcccacttaccagctcctttccctaagtaactagaagtagagctattatagggccccctctcagcaggaaacaccaagggaatatgcttaccatgtctctaacacaaataacagccccccaggatgtaactaccagtttcagttgctggaactgaaatgaacaattcagtagtgtgtgttttttttaagtatgtttaaaaattcttttttcggtgtggagaaggagagcatcaggataaacagctgatacacgcggggcttaatacctaggtgatgggctgataggcgcagcaaaccaccatcgcacccatttacctatgtaacaaacctgcacgttttgcacatgtatcctggaactttaataaaattaaaaaaataaaaattctttttttctgctagccttgaggagcaaggtttgaattatacccctttcagatgtagaataaagatcaatattgttgtgtagggcacttctctgccattgttaattaaatcaatgaattatctaatgtggtttttccagttctttgctgtgtccagtaattccatacctaggatgtctatttaaaaaaaggatgttttctggaactcctaagtagaaaggctgtcatatatattcatttattagggttgtcataacaaaatatcccagaccaggtggcttagacaatagaaatttatttcctcgaaattctggaggctagaagcctgaaatcaaggtgtcagcagaattagtgtcttctgagaactctccccttggcttgcagatgactatctgccagcgtctttatatggccttcctcccactgggtatgtctgcgtcctactgtcctctttttagagggacacaagtcatattggattagggctcatcctaatgcttcattttaacttcattacctctttaaggctttgtatcaaatacagtcacattctgaggggctggggagtaggacttcaacatatgaattttgaggggacataattctgtccataatgtaagaccaggtataaagaagcctattgcaagccacaaacacagaatttgactaagatgtatttattcaaattcccactatgtgttttactagctgtatgtctttcagcagctcacttaacctaactgcaattctaattagtcatgtaatagtcatccctgtcccaaaagacggttgtgagaatcacgtctaattaataactgtaactaaaaagtgtgtgtgtatatatatatatgtatatatatatatgtgtgtgtatatatatatgtatatatatatacatatatatgtatgtatgtatgtgtatatatatatgtatgtatgtatgtatatgtatgtctaggacagcatctggcttgtagtaattgctcaatagaaggggagtggtttattacctcttcctcttgaatttggatccagactttagtacatttgggaattggaagatcaacaagtcagtaaatattggtcacatgaagaaggggaaataaatgagcattattgaactataatatattgagtcttcttatgcacatagtaggccaaaagttttgttttttgcataagatctgtagattcattcattcaatatttattgtgcatgcaatatgtaccaaatacagaaagcagtcatctcacctactgtatggagggctcttctcacagctgatactcagtctcctatatttcttgtaatagattccctgggactggggagtttctgcgagactcagaatttaaaaggtgcctcaagtcgaactactattattgcagtcagaactgtttttgctctcttcaggaacagccttacctgtgttcagggactattgtgtggtatcatgctactggtctacattaccaattcagctattgcagcaattacatgaaggaattcttgctaatgataaaagccattatgcagttcctaaagagaatgcattccacagcattcattaattatgccagcctgtagatgcacaactaccacggcatacacttgagaccacacaccataaggattgaaactctctcaaagccacaatgtatgtctgtgttgctttgcactcttacattgcccatcctttacaacagcccttctcctgtccttctgattcctaaaactcaaaaccagaatgaagtaaggctacaaaatgtcatttatggggatgggtgaggcttaagtctcctggaaccatcttgggtcactcagctctacggaagacccccctaagacggtctagacccagagtcattctcagtcacacagtagttaagaattcttcatcctacggtatgccctctctagaaaaataatcgtaatgatgggagatgggacacagtgataaatctttgatgtctttgttcattagtttccttatctctctctcttctctctcttcccctaccccattattttctctttgacataaacagccaacatcagatgatcttgtttcatctgctgaatgttcaagtgatgatgaagactttgttgaatgtgagccgagtacaggtaggtcaggtcagtcttattttgcttgctttcttttttcttttgcaaaaaacaatacatacatatatgtgattatacatgtgttttatatatagattatagtgtgttaatgtgtgtatatttttatatctatatatgtataagtatacatatataaatattatatcaatgaaagcatcaaatcccatggaaagagcaataagatcctacaaaaattaagtcagtctcttgatagctaacaaaaaatcatggtatatgacttaacattgggcaagcagatgcccagacttaccactggagcagcaaatgtgtaggagccagtggcagctatgaaattcacagagggtgggaacatgaggaaatatatgttggaatgacatcaagaaaggatgaacccatggaggagcttaaagattggtaagtggagccataaagattggtaaatgacttaaaactcatgaattattctgagctaagagaaccaaaaatatatgtatatatatattttccatgggatttcaacagcagttaacatggtattatctttgtactaattttgttaactgtgtgtctagaaaacttgtgcaacaatatagtaaacacaaaattagtgctgtaccatgccgtgtcaacagctgtgatgcttcaaaatgtatctactgtgctgaagttgagaagactttagcaatcagaagcttcaatgtgttccccatttggacccagatacattttgatgttttatggtctttctttatagtgagctacatatgacctaatgtccagcaggcaattgcagtccctgattatttcctatcaacttttcccagttgtctgttttgagacttactataagttaaacgtttatatgtatataatagagaacagatatcatcgaatttctgtgtatgtttaatagaattaatagctggagttgggccaggatcttatttctgtgaagactaaaataaatagaattttctagttattttttgcattgctttcagatttttttccttttaagaaaaggaaagccattaaaaattctcttttgctaattctagaaaatttaagcttcatgaaaaaataatctaataaaaataaaaaccttccatttctgacccctaaatgatttacaagatttcaaatctgttgaagcctgactgctttggtttcttgcaagtggaattggatccaggaagttctgtgggttcatacccttagtatgacacagggacacatcattaatatgatagggcttccattctggagtgtaatctgttccattgggagctcagctgtgtggagggaaagtaaatgtgatctggtcagggctttctttttcatatttttaggtaataatctgtatgtgctatgtgaggttttaaccctaaaagggcagatacatccgaactataccagaacttgggtgccatgttttcattaatttattcattcattcattcaataaatatttttgagcactcaggcaggatacaatatatctctagatttgagtccttcctattctgttttttttttttaagaaattagctgtcagagaatagaatagttttgctatctaactcctcgcgtaattcaattcaacagatatttttgagagtcaactgtatatgttaagcatgtgctagatattaagggttcatatattaataggtcacaatcctcaatacgtacattaaattagcttgttttgtggcaaaccctttaagaaatctaggctttaattttatatatatatatatatatatatatttttttttttttttttttttttttttttttttgagatagggtctcactctgtcacctaggctggagtgcagtggcgtgtttatagctcgctgcagccttaaactcccgggctcaagtggtcctcctgcctgagcttcccaagtagctagaactacatgcaccactatgccagctaatttgttttattttgtgtacaaatgcggttctcaccatgttgctcaggctggtctcgagttccaggcctcaagaaatcctctcgctttgacctcccaaatgtttttcttcctttcttagcagtgatatctctatatgcagcaatgtttatcaaatctgtagattttaaggcttatcaaaattgaggcttggtcattctgaaatattatcaccatctttcctcaactactcaccctgcctcagaaagtcatctccacagcaacattcataataaggcagtgggcttttccagatctcagcttcagattctctagctctgtagctccccagtttatgggtatatattgctatttgttatgagacttgaatagcgtaaacctgaatggccccaaactaaatccatttgttttctagaggccacgcaggtattttctctgattcagaagcagaggacagaaattcaacaccaacatttcttgaataacatggggtgggtggggagatacagtttttagaacaatctgttgtgttctgtaagggagcatgagaggagataaagtgagtgacagaacccctacctttaaagagtgaacatgtagctctaggaggctgatattgatttcctccacctgtgattattcaactcatcacatttgaagaatgagcattgcatttttctaattttatttactccataaagtattcctggtgagtgatttggatatacagggaaatacgtcagtggtatatttaatacaagaagtaggtagatattcctagtaatgcagagagagaagaggtttgcccagaggacctgatttccactaatggggattacctgcttagagctatcaagccctctttttcattacataagaaatatctcctcagaagttcaagaccagcctggccaagagggtgaaaccccgtctctactaataatacaaaaaattagccaggcgtggtggcaggcgcctgtagtcccagctactcgggaggctgaggtagagaagtgcttgaacccgggaggcagaggttgcagggagccaagatcatgccactgctctccagcttgggcaacagagtgagactctctctcaattaaaaaaaaaaaaaaaatatatatatatatatatatgtatgtatgtatgtatgtatctcaggcttcacattttccaaaaacaatacagattaaaatcagaaatcagtttcttgggcaagatttgcactgcctaaagagaagggacctactgcccatgcagcaacagataatggtgacatttacacatctttgacataaattgccaatcttgcaattctacattaccactaagattaaaattctggttttgaacaccctaattcactgcctccatttctaaaacatttttccaggccttttgcttgatggaaatacactaaatttggctaacttccttggccttgttctatcatacttactactttatcttctttcactttgccagcgagtttattattttctagctgtctccgtttatgaggcatttaacttctacaggttatttcctgattaatttacatccatttgaagctctcacttttcataaatttgggtagtttagtgtgtgctataattcaatttttattttcatatgagcatcaaattttaaatgaaataatttattttttcttcaaatcacattggatttttaaactgctggttttgagttagttataagcaatcgcctttcactctcagaacttacttttgtgcttaagggtcaccacggtttggtatagcttaatcttattatatttaggaacaaggtaaatatttttggagtttggtcaataggagtctagaaaccttgcaaatccaatggaagtcaagttttcacggtatatttttgctggtaaatatgtagagaaatttaaagaaatcccaaatcatgagagcaaggcataaagtaaaagctcaattaggatttgtcgactaaattagtttgaaacagaactttatatctctaacttcatttcccctttaacagctaaaattaaacctattgactcatttaaaatttatgatttcatataatagggctgccctgacaaaatctatatttttaacaaatttgttttagaatttttatttctttattttgagactgggtaacaagactggctaacttttgtatttttggtagagacagggtttcgccatgttggccaggctggtctcaaactcctgggctcaagtgatccatccacttcagtctcccaaagtgctgggattacaagcataagccactgtgcctggccaaaacctacatttttttttaacaaagttattctctgctttttcctatccctacctttttctgggaactagattattttataagtcacagatacaatcacattttctgaatatttgcttcaagaacccagaattgaacctttaaacaataaagttataataaaaccatctgcatcaaatgaagatattcagaagtgtatctgaatagctatctagaggcgagggtctggattttaactcgatttgtaaatgttaattgtgttcttcacaaaacaaatcagtatctaatactttagattcgttctttgcatataaactgtttcattcccaactgcacttctattaatcttaaattgtgcagtaaattcatatttcattgtcctttttctctttgaatccaagaagaaaaacggatgagctggagagcattcaaataacccctaggaaaaggataccctcatgagattatggaagccaaatagcaattaagatcattagtaaattcacatttgtaatctaaaatgtgggaatgaattctgaaattcagagaaaataatacaattcacttcccatttcttctctttcccttacccctgctgctatccctagaattcccatctttggaaatagagtaatagtgaaaacaaatgtattcttggatgagcttttgtataattagatatgatcaacttcctggattttacatttttatagtttcaagattctaaaagtcttgggggcaggaggccacagagcagagcgaaaaaaaaaagtaatacttttatacctaataagtgggcatggcaatacttaaccacattgattcatccagtcgttatccaggggtatatttttcagtttgtcaagtagctagtttttctgccttcacttttcttaaatgtcctttgatcaaatctcaagggacagcacttccaccagagggcagacagtaaaaggaagtgaagatgaaacacatccatccatcaataagactgtgctaagcagctttcataatggttgggaaggagatgtttaaactaatggcagtaatatgagatgacaaaataattgctattcccagagtggttctcaggtatatttttactcctcaaatctacaatattcacatttgcatttcggtgttactgctacttagttcctctttgttagccctactataatatacaacccaagctgagtgaaatttaaatttggcataacaccaagatcacatctagtattttccaggtggaactggattcttaatctttatcagtctgagatgcctcgggaaagtatcatctgaaaatctggcactgagttactaaaagctcaccaaatcattttactttttatttgctggaacatggtagaaaatgcagctgaaatgttaatagataataataattttccagtgaaggatcaagagaagtttataccagaatttatagataacaagtaaatgtgctgattgttggccttaaatatgatgtttgaaatcttatagagatacgttttgtcatttgtgtctttgtcaagtttgaagttagcaacctgtatgtttttattacaaataagtcaattttatttaactatttattcactttagatttttctatatgaaaactcattagcaaatagaatcatgttaaaatttcattagtcaatggctattcagaatatagtacaaaaataaatgtccaagtaaaatctcataggaatgttggagtatgacagatctataaattcaatggtctgtaaatgctataaattctgataaaaggctcagatccacttaaacactttgaccaaagagataatggaaataatctaagataagcattttagctttggaaagagaactgtatatcgatagaaaattacttaatttaattcattattattggctgtggacatcagtcattttaaaatttgagttacaatacatgtctaatgctcacaaaagcaaatagttgttcacatacttaggtctaggctaaatcatatccatttttcaaccgccttcattgatctataaatgaatatagtatgttcatgggagtataatgttccagattaatgatacagtttttgtctttgttaacccaccaagttatttcactttcttttcttttttcttttttcttttttttttttttttttgagatggagtgtcactctgtcgcccaggctggagtgcaatggcatgatctcggctcactgcaagctccgcctcgtgggttcacgccattgtcctgcctcagtctcctgagtagctgggactacagacgcccgccaccacgcccggctaatttttttctatttttagtagagacgggttttcaccatgttagccaggatggtctcaatctcctgacctcgtgatccacccacctcagcctcccacagtgctgggattacagccgtgagccaccgcgcccggccagttatgtcacttttttataacagccccaacccaacccaagttattttttaaaccattgcagtaactatgtgcttttaaaatccttaatggtgaaatgctttgaaaattagggtaagaacagaaatataagaataggaaagatctactaattagctcttgcactttaggctgaggaatagtgtgcataatatatgtggcccatagatcgactattgtggatttcataacaaatatatttaataataaaaaaatgaaaaaaattctatccaactccattacccaagattttttagtaggttggagagcgaggcaggggaatccataaaatcaatgtatgagtgtatatacttctatctgaaagtttgataaatctcttctatatgtaacacttttgagtaactattacatgtaggcactagaataggtgctgggaaaacaaaagtattttgcttcagaaatatcgcttccagaagttcagtttattaggaaaggcagatataataagaggaataaaaggaagggaagaaacaatgaggacaatgaatggaaatgcccacgatattatcagcaccctaaggatgttggagcactccaattcagtgaacagcataccttatcagggatatgcaagaaaaaaaaaatcacacaagatgatgccaagcagtgacagattcaactaaccccaaggagcattcttctgtattttagtttggtgacacagaattctcatttattacgattgaagaattagtacagttcagtaaagtaaaaaagcaacactcttttggaattagtacagctcagtaaagaaaaaaagcaacactcttttggggacttcacatatacagtatggtcaaaggccacaccgtttttaggtaatagggtaaaggatggacatgttgaagggagaatttcaatctgaactcatgagaacttcctgattccaaatgccaatgcaagtggtacataaggagtgagcttaatgacatcattaagcaagtcccccaaaaataaataaagagggattgggttttaaaagagaagtttttatgggatttattctttttattctacatttttcttccataagccccaagtatatgtactgtgtgtatatatatatatatgatatgcacatatgcaaataatatactgcctgtcactccatatatatgtagacacagtataagtgatattagactaatgtaaccagagattaacagcccctaccatcagtcatgtgtttacacagaaattcacaccatcattcttaaccagcatcagccaacatagacatgcatgatactgttttaacttggcaaacaaagcatgttgatttttctttaagatttctttatcataattataatgctgactccataattcagttatccttgggaggggtggaaagaaaaaattatacagatatatctatccgtatatgcacattcctgtgtatatatataaatagatatataccttgtatatatttgaagaacattttgttgtttcacctcatcttgtgccgcatgaatttttggtggttcaatttattttgttttcatatttactattttgatcattatggctatttttaactcattgctatacttttatgagtaactataatcattattttcaaatactgagagatatatagatatacaaatcaaacaaggcaaaaaaatcttttcttgccatcctaatctcaaattcctcccctttcagcatatccctccagtatttatctcaaaacaaaacaaaccccaacgaaatccaagaaagttgtgtacaaaagaatgaatactgtgttttcctcttcctccttctatgcatatttttccttttaatttccgtttctttccttttgatttacccccatatctgcatggaccacttgcctttactttcccctttatgacaatgtaattaattgaaaagataagagtcagaaaaaaataaaagaaaaacacatagaaatgacagagaaacacacccctctccacaaatttcagatggcataaaaagaattttattgcagatatagaatatttgttgtatcttttatttctgtctggacaagcccaggatcattgtgtggcatgccgtgacaagttttgtagcgcatcaactaaccatggcctccatcacaagtgcatgacaccatcttgtgtttcatccaagtgacacatctaggctaacccagcaagtccagtgtatgagttgtgggaattacattcttttgtagttataatttcatgggtccttgtttttattattatttccattggatcatgacagccctaagagctgctctcgcagcatctctgtatggttttgttcttgtgttttcttttcttggcacagcagtcaagcatgtgtctcttgtttggcacatctgtcttgccatcttgtcttgtccactgtcgtggtgttgttctgtgattctgttctctgtaagatgtgatttgaaatcctctgcctttatttctcactctcctattgtctctacttttaaccttacccctagggaacttcacaaagaagcaaaacaaactttcagtcacattataaggctgatcactggtttgcatctggaagtcataagttgtactttttacctgacttaaggaggaaaaacttacagtgggaaactactgataattatactcaaacagcaaactgatcaacgacaataagaaacccttgttgattatttttggtatgattaaatgggcttactgttaaagggacttcatgtaagatcttatttccaaagagtttttttcataaattatcagtcttctagtcagaaacttttcttcaggagcagatcaacggaagatgtttttcgggaattgttagtgagggagcatcatttctgctgtgtagaacagtgcctgttcctgaattggggaggaactttatggaaatctgcaaatgttttattacaaaatgcatttatgtttatgtattaaaatataaatgtgttcagcaaggcatctgaggatgggaaaaaaaaactttttaactcactggttccacctcatgcatattttgaggtaagattatcttttgatctttctgagtcaactgatatacattttacttttttattttttaattcatggaagcattagagagccaacacttcaactttgacctaaattcattcttttcccattccagagaacacgacatacataatagctttagttctgagaatagagtctgaatttgagacaaacgtagaaggaagtgcccagttaattatccaaatgttggactctacctgtgattatccaggcgatttgatgctttacttggaaggatttgattagttggatacgaacagcatgaaaatgacactttgtaacaactttccctctttaagggttgagcacgagaatatcaaataggtataaaaatgagtaataggtgatatattaatagattaaagattattcaataggcctaaagatttcagatgaaaaatctgtatttgtaatctgaaaaagagaaagcatatccagacctgtggttttctgatgagatctttcagtcaggccagggtagctattggtttttcttaagggtaaggggaaaaaggccaaggatgaggaactggatggctctgtggactaagaacaactttctgatgaaagaaggaagggaaacaagaaaggcgaagaaagaggaggagggaaatgtaaaagaaaggaaggaggaaaggaagagatattgattatgagccaggtaaagctgcttgctgataaatattttaaaaccagcacacacacagagctctaatttgcagttttccagtttctgtatggtgtaaaatattcccaccatggctgatttctagctaccaatatgacagccctaaactcagaattgggaagtgtccttgctcgtacacaattatatggctttttcatcatacgtacactatagacgtcaagaacctcatagataatagtaaaatttagtaaaataattaggaagtaccgagttttaagtttttaattacctgtttttaatatacttgtaactttatatatatattaacttttgaaaatggccatgttttaacaaccagcttacaaatttcctagaaattttgcaatcagttgtcataaactggctcaagcacaccactagcccaggtactatactgggtacatgaaaacatagtattttatttaaatctcattttaagttattgtgagataaaaactagcttggtcatcttacagttgagaaaattgggattttaagtttgcttgttcaaggtcacatacctgcacataaatggtagaggtaatattcaagtccaaatctgtttgaaaatagacattttctttatattacagtgtgccagtcattctttcaacacttctcaaagtactaagttatcgaattttgacacgctcctttgtggagcttagcatgactcgggtttccctattgcctcaaggaggtccttggctttaactgtcttagataaaatggagtttaaatgtattatggttgtgtcaatggcaaaatgaagacagtgaagcaaaattagaactcctgattactctgtttgtaaatgccaccaaagttatgaccatgtcttcatgagaatgtccactttgactaattttgtttcctccaaatattcctcttttactaacattgacaatgaacaggatatttcttaggttttcatattctgtcccttgagctttggaaagactatcccagatacattttctgagcacatagaatctatagcatgatcccattacatagttaggttttataacttttaaactctaatgaattttatttagttacagtatgtaatgcatgttaattaaccaactgcacagtgaaatatgtcaatgtcctttgcttccacattttctaatagagtaagctagtatattaacatttaaaacagcatgagaaccatagtactgcagaaagcaactgcagtttttaaaaagatgattttattgtaagatacttaatcattgctctgtaaaagagtttgagaggcctgggaattaaaaaggaaagtgttgcagctttttagtccttctaatttgacaagatagataatttgattgggtttctgatagtgcagtattttgctttaatttggtgtgaagtttagttgcccccataattattattatttttttttggtcactctgtcacccatgctggaatttagtggcatgatctcagctcactacaacctccacctcccggattcaagcaattctcctgcctcagcctcctgagtatctgggactacaggcgtgtgccaccatacccagctaatttttgtatttttagtagagacggggttttaccatgttggccaggctggtcttgaactcctggcctcaagtgatctgcctgccttggcctcccgaagttctgggattacaggtatgagccaccgttccgggcctccctatatagtaaactttcgatggcagcatacacaacattgaataaagtcctttgaagtgacttctaggctttctcctataggtttgccactgctacaactttgtttcatcattcagtgaatattagcacttcctttagtgaaatatagtcttaagtacttcacattgttaactactttaatcctcacagcaatcatgtgagagtctattcttattatctccattttaaagataagtaaatggaggcacagaggagctaagcaaattatcaaggtcacacagcaaggaagtagaagaaatgggatctgaacccaagccaactgcccccagcgtggacacccatcactatgctatcctgtctcttacgtagcgcttattttccattaacctaaatatacgaaatagctgccggcctccttgataataaaagaaagtctgtgtattgaatgtattacatggttgggaagtagttgataaatgggttagttattatgtatcaaaaaggctttaacaatcttggttgatgggggttataaaattgttccattatgatttattcaaataaccgtggttaaaacaagttaccctggtttcccataaggaggaatgactccaatattggagagaaataccaacacttatgtgaggtgagtctcccttgatgtcacctatgcaataatatgtgcacttgggtttttttttttttttttttttttttttgagacggagtctcgctgtcacccaggctggagtgcagtggcgcgatctcggctcactgcaagctccgcctcccgggttcacgccattctcctgcctcagcctcccgagtagctgggactacaggtgcccgccaccacgcctggctaattttttgtgtttttagtagagacggggtttcaccgtggtagccaggatggtcatgatctcctgacctcgtgatccgcccgcctcggcctcccaaagtgctgggattacaggcgtgagccaccgcgcccggccgcacttggggtttctagctcattattcatgatcaattctgttcaaaacatatgcccagacaacagccacctttaactgatgttaggaatctaaggatagaggctcttagcgagagcttgggttaagatactgcattttctttatttcagaaataaatatgttccttagaacacagtgatttaggtgttacagctaaaagaaagcaaaaaacaacaacaacaacaaaacgaacttgtatttcttatcttagaccctttctgacacccacatgctcttgacatctcttaaagttgtaactatttgtttatcctccctttttcctcacttccttgcattatgcatccaaaactattttaaaagccaaaacacacacacactttttgtgggtctttgagtttcctatgcaagaaaagaatcttaaaatgagttataaagaactaaaaatcacaattaaaaaggaaacataattttaaaactgtgtttgcttgtattataatccttattccaaggcaagtatggcctgcacaaacatctgaggattccattacaaattatatcagtctcaacccatcccgaatccagatcataaactcataaactggaaaatgtgtatagttgaaaatgtttgcataccctctgtcctagagcagtgcttccatcttagctttgaagcacagagacctcctcttactaaaagatcatgaaaactggcaatactgtattgcccagtgttaaaatttgtcagattaattacccagagccaaagttagcaaactttttttctgtaagggctggggtgtaagtattttacactttgagcgtcttacagtccctgccctatctcctcaatcagctcttataatgacacatagcagccatggaaacaaataaatgagcagggctgtgttttcatgaaagttgatttccaaaagcagagatggagctggatttggctcagaggtcatagtttaccccaatctagagaagtcccataggttaaaaatgtgtagtctttttttttgtttttaatagataagaccttcttgcccattttatagtcgttcccaacatttgttgagttctccactaagtacatgagaccacataggatacaacaggacattaaaagcttttttttttttttttttttgagacggagtctttttctgtcacccaagctggagggcagtggcacaatctcggctcactacaacctccgcctcccaggttcaggcaattctcctgcctcaaccgcctgagtagctgggactaaaggcgtgagccaccacgcccagctaatttttgtgtttttagtagagacggggtttcaccatgttggccagactggtctcgaactcctgacctcgtgatttgcccccctcggcctcccaaagtgctgggattacaggcatcagccaccgcacccggccctaaaagttcatctttaaggacatttcccacctttgttttagatatgccactatctcagacatgaaacacaataacaaactaaaccagggtcatctccacccagcttgtacactacatatttgggtaggagcttaacgtcttgcccttcgctttgccagtgtgtcttctgagctccccacctctgctaggtgtgggctgcattcacccccaattttagacctctttggcagtagcttccttgatctcccgcccacatactgtgtcatatcccagtaattcttccccaaaccttggctatgggttattgagctgacaaatgtctaaatgactgagatacgatttcacaacctgctgagagcctcttctttccctgtactctttgatttgtagctttgtaagttttgtgaggaaagtgggaaaaacattcttggtgacacaggcagtgaatgaggaggacacaatggagtgggcaccatatctaggactcctgcctgcattgcgagcaaaagcatgtatttatatcttagccctctgaatgttagaggtagcagattatacagtatggtgcaggaaggagcatcctatgtcctgaggtgaataacgtgttctaccacctggcagcagattagaccagatcaggctatgagaatacaggttcacagccagatttagtactaccagccagatttagtactactgcaaaaatggcttttccttaagaagtttttgtttctaacttttattttaggtttatgggtacatgtgaaggtttgttacctatgtaaacatatcatgcggttttgttgtacatatcatttgatcatctaggtattaagcccagtatcaaaaaattatcttttctgctccctccatcctctcaccctccctgctcaagtagactccattgtctgtcgtttccttgtgttcctaagtcatcatttagctccaacttgttgagaacatgcagtataagttaatgcttactctctttaacatctttcacattagaaatctatggagaagaaatatgaaagactcatatataaacatggggcaaaccatgaagctaaatcttaatgtatcccaaaccccagagggagcataaggttaactttgggtggccagggtgcttagtgataacattatgagctttctacattagcagggccccctggtgtggttttgtgcctggagatgtaaggttctgaactacaaaggaagcaaacaaaatgaagagatgatgcaaggaggcaaaaaagatggaggcattaggaaaggctttgagggcaggaggcacggggtcatcttctaaaataacctattggaatgcatgttttaataagctttgaagatcaaagagattaacaagaacaagaggaaaacaagggtaaattaggcactattgatggcctgacaaggacttttttctccctttctgcttacaataacctctcattttaccatgtggctagttggtttgtttacttgtttgtttacacttactcattactagctttccctataaagcaagggaaaacactctgtccccaggggccagctgcataacatgaatagatgaaatagaccagaccagatgcaatctgcagtcatgggaactctgaactgaagagaacatgccctcatttaaaggcatccaaatgaaacattttaaaaacactaaaataaagagaccccatgaaggtcaaacaaggcataatgagacacacagtgttttttattcttttgtttcttaaattcctttaaatatagccctttcataaatttggcaggatgtgctctcagtaaaatttctggtttagtaaactcttggtgacattatcaaattaaacagcaatcccttccaaattcccctaaagctaagacctttttttttttttttttgcatgtctttttttctctgataatcccagagtttatataacctcaaactataagcttgatgaattttagagttcattgtaatgcttttggtttaggtgacaaaactgatgcctacaaagataaactgatttgctgaaggtcatggacctagtctttattggagttgtaattcaatcccaggtgtcctaaatctttaatccatgccattttattgatattatatattaagattttttttattgtatatccaaagatttctattttaaactgagataacatccaacagagaattcagaagtagtatgaaattgattatcttccctctactggacattgttgccatacaagacgatatcattgacccacttagggctcaaatatacaactctgtattattttagtcacaaagggaactaagagattatagacaagttgtgaagcagttagtggggactggaagtctcctgtggcacagactcaaatatatgctctagtgatgtgttctcagtcatgttatctgcccacacagaggacagattaagcaacctagagtactggttcccaagctcgaatttaaaactagtaccagtctatgccaaagctttcagtgacccatagtgaaatgagaaaagcaaggacaatatggtgagtctgcacaaagtcaaacttacagaactgccctatatttggatactgtatcatgtttttttggatggctaaaatcaatgtcttttacaaaagcagcattttgttactatgtatagcattcttaatcagcaaaataaaggttggcaatggtatgtcagtccttccctacagtttttctttgaagtttttttctcaggcattgaaaacaaacatccgaaaaagcaaaaaaacaagagttttaaagttttaaagtgttctctatgttgccacattagattgagtagatttcaaagactgaaggcctttttacatgtaaagttttattgtgaactaataatgatgatgttaagacccatctattttattgaggtcccaggaagttactagtttaagcatccgtcacttagataacaagcattaaggtaatttttaatttcagttaaaaaaatagattaaaggcacaaaatagatttccaaacaaacaaacaaacaaacaaacaaaaaaaccaaaaaagccaccctaggataaatataactagaaggccaagatcagtttagaagtctacttaaagaaagacagaaacttctaaggactgtgtggaaagataattcatgcctataaaaaagtctctgtgctaactctagatttttttcactgtaagccttgtaacaaaggagagagagctattttggaaagctgaattagcctacatttgagctaacatgatccatctttgtgtcaagagaaagtcaaatattatagtccccagccaaaataaggcatgtgatctacatcaaaggcaattcctgaatgtgtatctacgtcctcatcccctctcctcttttttgtctcttgggtaatctataccaataacctcctgattcatgaaatttattatctaaatattgaaaatattacactaaatttagcctaataaaaattcatgccaaatttactgagtatttattggaaatcagagacttaaggtcctgaatcaggtgtaagaattgtattatcaataacagacttaacagtgattatctctaggtggtgaccgatattttgataatcatactccaaaacatctatgtagaaattgggcatggtggcgcatgcctatagttccagctacttgggatgctgaggtgggaggattgcttgagcctgggaggtcaagggtgcagtgagccatgatcacaccactgcactccagcctgggcaacagagcaagaccctgtctcaaaaaatgaaacagaacaacaacaaaaatcgatgcagagcatgtattacatttgtaatcagagagaagggatatctgttatttcttaaaatatagaagagtatactaggagaccagcaagggaaatgttttaatatttagatacggaagcttcgccagacccgtaattttttaaaaatagtgaatcctttttcctgggttgaattatgatgtatggccctgcaaggaaagctgctggaggaattcaaagatgatgatgatgatgatatgcagggctctatatagcttaacacattagttccataaggtcagttctgttcatcaagtgacaaattgtccatggatacaccaggtggtaatgcagcagcagtgggcacaagctatcctgtaaatgacccattaccagaaagtttaaaatttctgcttggaacccaggaacacagatggaacacgaagtggctttcaccagagtcttgggaatatgcttgatcctttaaccccagcttcaggtgttgtgtacatacttaatgcctgaacagttctcatctgtacatctgctggttagatgaaaagatgcagttgcagacaagtaatttaaaactttacattcatgtctctctacctccctcttcctcttctgtctctccctcgataggatgtccagaaaattaaatcagctgcagattaattgagactctcttccatgtagggaacatctgtcactgcagctacaaagattatattaatgaattaaaacatttgattacctttaatccaagagaatgcagcagtctctttagtcatttagtttatcagggttttttgatggtttttttttccacgtgcatcttacgactatagtccacccctgaagctgtgagatctttcagcagatgttgttttccatatctttaccctttccgttgtggaagggggaaaaagccctcagaaaagcaattttggaggaggcagaaaaggtttccatcatgaacatacttttagaaacagctggtaaaacaaatggtccaagtgcaatgcctggagcatatctattcaaacaaggttgtttaaagataaaagcacccacttctaaatatcagcattagtagtgatttcctcacgtatatttaagagatggaagagcttgtgaagactttttgatttctattttgttttctgagacttctttaactcttttggttttgttagtatttgaatttatcagaagctgctcaaattgttaaaactgtatcatcatatgtaaaatatataaatttacatataacggatgcataaagatttgctttcttattctaagaatgttcttatttgataacatctatgcatagtccagaagattgacatgaaaaactgataatgtacttaggtattaccaatcctataacccaatttgtgaaaaggtcaggcactcctactaaagaacaaacgtttgtatttgtagcatttaaaaatctgattttattttgtatttgctacatttggagtcaaccttatcccttcccttctaatgacttcatttgtttaccaggctgttttgttctgcatcctctgccaaatgccattacgtaacttcctttgtcagaccaattggtgaaataattctttgtgtgcttttttttttttttttttttacggccgtccaattttcaaattatatgtggattttctgagtcaggcattgcacaaatgctgatttgttagcttgaactcgataaatgtgtgttcaccctatcagttgtcattcatgctgacttcttcctctactctcttcactctgattctgttttcatttaagaaaatttcagaagtagtgaagctaggagagttaatgagtagccacgttgaccctagtaggatcttacccattggagaaaagccctgttttaaaacgatgcacaaagaataagcttcaatgtcttcctctcctcaaccccagcatggagcacaatgcttatgtgatacacggaagtgagaaatttaagaagtgcttcactttaacttttctcaataagtaaataaaactgtcttttctagagtccaacacatcccaaagtgtgtgactttgctattttaccttaaactgactactctctgaatagattttcatgttatatagtctgagacttttctttccatcctgctggtgctggaagacatgatcataactactcacaacccagatcttaaaatatatatattgttacacttttatatacttgtattaaagcatcagttagtaagtttcatggttgtttcttctgatgtaaaagtaactgtagttatagatcctccagcacatgtcacactgaaaacctaatcacaaagtcaaaatatgtgcataaatattagcttgattatgtgtcacatgtaccccaaattacacatatatataccttcctcaaagattttttttttgtggggggacagtctcactctgtaatccaggctagagtgcagtggtgcgatctcggctcactgcaacctctgcctcctgggttcaagcaattttcctgcctcaggctcctgagtagctgagattacaggcacctgctaccatgcccagctagtttttatatttttagtagaggggtttcgccatagtggccaggctggtctcaaactcctggcctcaggtgatctgcctgccttgacctcccaaagtgctgagattacaggcatgagccgctgtgcccaacctgagattttttttttaaaccttggattttcaaataactttatagttggagaaaagttgcaagaatagtatatggaattcgttatgtccttactcaggttcaccagttgttaacatttgccacatttgctttaccattctctatatgtgtgagtgtacatgcacacatgagccatttgagagtatgcatacaaaacatatttatgtagatatgtatttcccctgaaccatttgaaactcagttgtagtcatcattccttttttaaataattcagtgtgtatttcctaacaaggactttctcttacaaaatcagagtacagtgatcaaaatcagtaaatgtaatcttgacacaaaatctcacctagagtacatattcacattgcaccagcgtctgcataatgggctttgggattatttttttcccagtctgtgatccaatccaagatcacacattgcatttagttgtcaagctcaccaacttttgaagcatcttcctgatacgttattttatttccccatttgtttactggtcacagaccagtaagagcaagtaaacttcttaaagtcctgccaggtgtgttggtgtagaagcgggaagatagagcctgtgcttcagcacaggaggaagatttcaatttttagaattaaaattatggcaaggaaggacctgtgtttcatctagtattcattccttagagagcacggatataatagtctgacaatgctttttattagtgttttcacttagctgcagattgagcatttactgtgtgctaagcactgaggatgcaagagtaagcaagaacagagatggcccttgtgggcctagtgggggacactgtcatgtaattaagtgacctccaaataaatgtgtgatgacaaacgttgatgaaggctatgaagcaaaggcacttggtgccatgagcataccatggtaggacaggtaacaaggcaggggtgggtgctaggaatgtagagaaggatgaggaaaccttctctgaaaaaaatgatatttgagcagaagagtgtgaaataagtgacagctaagaggaagaaaaaatgcattagagcttgcaaaaaattctgaacattagaaaaagtcagccatttctgggagagagttatctgggagcagcaactgtctcacaggattttgtccaaagtataaaataaggaagtgtgttaggctattcttgcattgctataaagaaatacccgagactgggtaatttataaagaaaagacgtttaattcgctcagagttctgcaggctatataagaagcatggtgctagcatctggggagcctcggggaaactacaatcatggcaaaaggtgaagggggaacaggtatgtcatatggccagagcaggaacaagcaggggtggagatgccacaaacttttttttttttttttttttgagatggattctcactcttgtcgcccaggctggagtgcaaagtcgtgatctcggctcactgcaacttccacctcctgggttccagcaattctcctgcctcagcctccccagtagctgggattacaggctcatgccaccacacccaggctaatttttctatttttagtagagacgaggtttcaccatgttggacaggctggtctcaaactcctgacctcaagtgatttgcccgccttggtcaattaaagtgttgggattacaggcgtgagccacagcacctggccgccacaaacttttatatgaccggatctcactgtcatgaggacagcaccaagccacaagagatccaccttcatgacccaaacacctcccaccaggccccacctccagctttggggattacagttcaacaagagattcaggcagagacaaatattccaaactatatcaggaattaagtaggctttgctgtccttttgcagctttgagtcaacccatatgagagtgaattctccgatcctgtactgctcctgggaggaaagggagtgggctttgtgaaaaatggagatttagtgagtaaagtgatgagttcactggaggaaggttggctagaaaaaaagtgacatggctgggcatggtggctcacgcctgtaatcccagcactttgggaggctgaggtgggcggatcacctgaggtcagaagttcaagactagcctggcaaacatggtgaaaccccatctctgctaaaaattcaaaaattagccaggcatggtggcaggcacctgtaatcccagctactcgggaggctgagccaggagaattgcttgaacccgggaggtggaggttacagtgagccgagatcacgctctgcactccagcctgggcaacagaggaagactccatctcaaaaaaaaaaaaaaaaaaaaaagtaaaattgtctttttttttttttttgcgtaccaaatcctatcaatgaaagagacaggaatagatttgactggaatagtcatgggagccatttccaggctctcatagtcttagagatgacacttggtagttcagtgtcttattgtgcttcttcaagcacatacagcctgattgagagagactcaagacagcatacaaattctaggcatttttacatctgcctagctgtagtgaattagtcatacaataattatttaaagaaagaaatgtttcctccatgttgtgctggagatacaatggtggagaggaagtggagatcaactattgatcgatttataatttacacaattccacactttggagaaaacacattccttcttcctcaccatcaccctcaccattataattattatcaattaacttgttcaatatgtaattttgaagttgccaatcatttaccagtgtgattcatcatgttaaaaggaaatggcttttacattattaatattctgcaataaaagtttgggtttgtgtgcttacagttagaataaaagaaaaatgctttgtactaagactatgttaataataatgataataataaagaaataacactttctccagaaaggaaatttcaggaaatctgtttcagaatacctgtctctaccacaagagctttctaagtcatgttttgattgctaacagcattccagtactgggttggaacatatgtattccttctatcaactgaggaacagcaggttttctgttattgcccatgcatggtcactctctgcttataaaaattcatcacttctgctgattgcattgtgtaggattcctactgattaccatttagatttgttaagtgacatagcacattttatggagtcaggagccagtaaccatcaaggtcaatagcagcaacctgaatcagttataaatgaattgtttaattacccacgcatgatcaatgtgtgcactgccataaaagattagttctagtccctgaatgtgtgtgtgtgcctgtgtgtagttctaagggattacagacttctctgaagtcttcttcattgaaagagattgcaagtgagtatcttttcagtggaatagaactgagttatggtaacaacatcatctatacatccagtctaccgtggccactgaatccaatgacttttttttttattaatatgaaggtgcctgcctatccaaagcactgcttactgtatttcattacaatgtattgcttcactcaacacactctgaatagagaagatatgctctacagcttcaaattcaggcacttcctccaagcagagcttgtttatctgtctgcaacacacttggagcatttgaaagactagtgatgaaatccattcatgctgtgaaaatgtgttgagcatcatggccgcttcctttacaatggcctggcatggaaggttggagaaggccattgttaccatataaatgactgtctatttgcctctggcatgacttgtccagacaagttgcatcattttaaaatgaatgaagttctagggagcatttttaactatagtaccttagttgtaactttgagagtttttaataagcttgcaaggaataaatttggaatctagagtagtttgttctatttctggaaaaaaaggaatgctttgtacatatgtaggatcctttacctggccacagagtttggtttgagaagtggacttgactctggatagtgaacaaaatgctttttcaatttttaaaatggaggcacctttttttctgagagcatagtcagtaactccccaaatgtgtgtctcttgtgtgatagaggaaccaagtaagagaatagcttggtgtgtgcctggttttcttccacaagtacccaattagtaaagggggcttttgctttttacaaagcatgaaaattaggggttgcctataggcctgagagccctgccagacagttgcctaatgccaccagccaggattatggaaaagaagccttggcatactattcaatggcaccgattcacccaaattgcaactgaggaaaacgtgttcatttttcaaatagagtttgagtaaccatagacacaggcaaagtaatctctccatttggtcacaatggactaaactaccttgttctattgtctaccttctctctcactgactccatcaaggcagacttgttcggtaaactattcaggtgactttgtgaacttttatttggtgcaaggctctgttaatagctgtaagtcagctgtttttggtcctccctctcattctcttcacactgattgatgaaatgggaaacaggttgaagaagctcacttttttagatgacaagtattaagttgacagataaacctttaggaggttccagttcatttcaggaacgtgttgacatgaggtctttaaagatcgacagtcctattagagatagagaccaccaggaaatcataaggaaaagaaaaatgaaggaaatatctagattcagtaggaaattgggggtgatgagagaattttaagaaaaacgcttgctttatcaccagctgtgtcattttgttcaaagggacaggaaacataatactctctctgaagcttaacagaactgcagacctattgccacagttttctcttttgcataatcttgtttagtcacttaagagctagtgagtgacagatttcacatgagaattggtcacgtacaagaatgttaatgcagaactaggtcagattatggcatttcacacatgcaagatgggaacacgcttcctctggttagacaaaggcttgacgattgcccatgcatctggtcctgctttaaaggaagctcatgtaatcatgagaactcacaatgtatccatagatttcttagatatcaagtttctatgagccttggcattgtgtatggttttattgttattttgccaaacgagggttttctagcttcacttagtatgcctggagaaagctattttggttcggcccagctccatcactctaagaaatgatgaggatgagcgctctcagtttgtaccgactactcatgagagactaagaactgatcatctggctgctggcaacattccactgcaacagctaatacagtgttttggaaagatgccgacaacaaccagattgcattaagcactttaccgtttaagatcagttttgcagttcagaacttgaagtcagcagcagatctaccttttagtttgcagtttactttgctccgagtttttcatgtcttctgtgagccccccacgtttatctcagggtggattctaacacacatatgcttatgtgaaaatttcataatactttagtatttaacaggcacttttatataagtcaattgatttcaggacaccccctcgccgccctgataccaaaatctgcagacgctcaaatctcttacataaaatggtgcagtgtgtacatataacttacacacatacttctatataatttaaataatttctagagtacttataatacccaatccaacatagttgttatactgtattgtttttgtgtttttaattgtaatattttcatttacctgcagttgttgaatgagtcgagggcaggtagatatggaaagctgactgttactacttcccttttacttatattacaatattatctatgttagtgatgttcatagttcaagagacacactaaaggaattacagtatggagtgtctcctaagttgcattgtggaactaaacactagagacaagagtcgagccctggctcaatagagccagtaataactcagtgtctttatgaccctgagccggtgccttaaattctctgcagcgtagtttctttaaacggtggttctaaactaaggggacttttgtccccaggggacatattgtcaattgtctggagatgtttttgattgccacaactgggaagatgctaacggcatctagtgggtagaggtcaggggtgttgccaaatagcctacagtgctcagacagcccccaccacagagaattatcccacccaaaatggcaatagtgtagaggttgaaaaatgtcactttaaaatgtaaataatgtctatcccattatcacaggattcctatggggctcaaccccacattttgtttaaaaaaagtaaaaaaaacataaattgcccttctatgtctgatgttactactatggggcattgcacatatggacaccaaacttttcccttaaaaaggaaaatggatttattcttttagattaaaagttataaataaagctatcagattaaaatatattaaatatatccactgaatcttggtttgtaattttatggttttaaatgaatgctctaaatataaagagaaacaatgaaaagttattaagtaggagaaacctactattcagtgactaatatagataaaggaaattggaatccatgcaactaatagacttttctattagggtacagccacagcacgtctttcctaatagaagcaagcctgaaatgataagttgtttggatcacattaattaacattcagctctattagatttgtacctgaggttgggttcattttactggtgctgatgaatatcaaactacacaatatctacgcacattatattagaataaaacatgttttacattgaaggcaaattttagattcgactcttaataatggtcttttatattaactcagataactagagatagtaaaagaatgaattaaaattccagtgagccaaactacaacattgataatagtaatgagaattaattctgtgttgattttatggtgcctttgcctcgtaggtatatataactctggagtttatgaggcatgtttatagatcttaacttcttaattttgtaatgctgtcctcttaaaatttttgcttgagacggacaaaacctcctgaatttcttcaatttacatgggcatttttactaggaaagagcatgcagccttcatcagattctcaatagggtttattaacaaaaaatgttgagaaatcaccttaaaaggcaggcagctcttaaatgcttgttctcactgaagtccttctaaaatgatattgcatggactctatcagtctcttagcagctcatctgtagaggtaccaactgatcaaaaattcaaagttcttaattgacatactcaggttttttaaaatttaaagatccagattggtagctcagccatatagctaaattgaataattatgcaaatgctgcacaatatttaattggaccttttggaatgaaaataacccaggtgtgcacaattctttgcaatctggagcaaccattctaatatatatctgcaagtgacaacatcttgtatgtaaacaggcagaggaaaagagttctggctgccctcccaggaaaatatacatgaaagaacgtttgtgttacagcatttgtgttacagcacatacatatttctgagttgtttgttattaaagtcccattgtatgaaaacaactatatagacagactggcaatccagagagttggtagttacataaacaggtcccacggctaccaataatattaacacggtattcttagcccttaagaaacaaaacacagaaatttctaatactgggagtttaaagtgccacaatggaaaagcaaactcaattacaaatgctggattccacctggagcctattcttttcattttcttacttctgtttctgccaccttcccttcttccgataacagattttcaagtactgctcttagaattgctaaatgtgttcagagaatgtgtgataagatctgattctcctggaaggccaggttattttaatctttccatttctcacaccaaccatttaactaggtattatttgtttctggacgtcacagctaaagacacaacattttacatgaaaatgtcagtgttgaaaatattatttatctatctatcaaaatgtagccacgcatctgttcttgtttgattctagtaaaccataaccctaaacatgacacaaaaggggctagtgaaatatttgccgagagcggtactctaagttaacagtaaataattgaaaataagtaagtcaaaaccaaaaccaggaaagtttgcattcattcccaatcatactttaacagaacttgcagctgccacagattcagacatcttcatcttcctgtggagcatttgtcttttcatagcagaggacaatctctgtgactttcttatatcactgagaccatcttgtacagtttatttcaaaagcaagagtgttctttttcgtttcatgccaccagtgacaatacgaaaccagatctaactgaaacttcactcaacacattcccgacccgccaccccaaccctaatagcctctcataaccaccgttctactctacttctgtgagttcaacttttgcagtctccaaaaagaagtcaggtcatgtgatatttgtctgtgcatggtccatttcacttagcataatagggggactaagttcaagagatctattgcacaacatggtgaccatagcaaataataacatcttgtattttgaaaatcactaagggagtagattttaagtgttcttagcagaaaagaaaatacaatgaggtaatgccggtataatttagcttgattcagccatttcacaacttgtatacatttcaaaacattatgttgcacatgataaatatgtacaatttttatttgccaatttgaaaaacagagaagtccctcttcagatcctgtcctatgcagctgtcactcacttggctttgtaagcctgcagacagtgtcatttaaaatattttcctctgtaccataacgcttttccttttaatgatatataagaataatatttctctctaaatagttatttctttaactttgaaataattcagcatctcatgattttgatttccatttctccatatatacattttttggggctctgttctgggatttagggctaacctttgtcatggagacatctgtttttggcagtctttgtttccagggagtgaaaatgtgtgtagaaagaattgaatagctacatcttaggtgacacaattgaggaactggatgaaagatatttgtggaaagcaacataattattcaaactggaatatggccattgccctgggtttcatatttatcttcataagcaaagtggtttgggattctgtgcaagtataaggatttaggatttaaacactaaaccacatccctgcacggagcacatgggctttgttgttgataatcatgatagtcgcacaggaaacttgacagtgacagcaggggaacagcacagtatcctacttggccactggtaggaggatgcaatttaaatcctggcatgcgtagaatagcctcacttatctgtggattgttattgtaatctacatagtaagtttcaatcagaactcagttttgtgcagttgatttccaattcccgactctgcatcattagggtacaatgttttctgtaagatttctttgtaatattatagagagaagagcagaacaaatgcagttattcctctcaaagttcagctgaatgctactaatagttcaagaatgtggattgtaatggttctgtgcattgaaagaacacaatggcaaatgacaaagatgacactaagtgtgagccacagctattgttttgatagcccactctgcttttctagttaactttcttacaaccatcagttccatatttaagactagaggatcagttctgatgatgctcattcaaactcttgccaactgacatttaatgcactttaaagttgttaaaaccaagagcaggaaatgttacacttgtagtatcaagcctggctcatgagaaagttccatccactattctggaaaaaaaatagaactagcctgcaggacacaaagctacctgtggtgatccgaactatgcttctcaaaaatctttcttttgtttggccacctttataataggagttctccaacagagaaagagctgcttacagcttcagagtacagatggataattgttgctgtgccatctctgaacatcttagattgagggtcccagagaacctcatgtatgtgaatgttagcacagtacaaaagatgggacagagctttccagagcagtaacagacagctgtgcccagcactttcttctaaaagttggagatgctggatggaaaatttgtcattgtttacatagcacccacacacacacaaaaaatcctgactcactagcttctgtgttgtcatttttttgtccatggttctattgctgcctaattttcatacgggaccctcacagtggttagtctgcacagtaaggagtcaactgtgacatcctcatccttgaatgctagactccccactttctcagctcaatattccatgtgtccaaagtaatactgttagtatcctacattattccaggatcttgtcatgccacttcaagaaacaaattatcaccgctttctaagacttaccaagctaggggtgttgtaaagtatgtatgcaattgacttttgacttttgattcttatgttgaaaggcaacatagaaaataagcttccattaatgtaatgatatagtgttaggaagacagtatctacagtccattcaaaatattctgaaaattatagtattgattttggaacagttttgattccattggccatagcgcttaccttaagtcatttttttttaaaaaaaccgtcttatccatttcatatgttttacaggcactaaaatggggcacagagactaagtcacttagttgagttaaccaataagtaaaattgccttcatattctgcttcctaatgttgtatcttctctagcaagttcaagagagcttactttctggaagctttgcttgttagtaggatgtataacctgtgggaaaagacccagcagcatccacttttacttatctccttgccttctctgaaaacacactgaacagaaatatccccatctctttctccatcgtgggtttttcctttgggccacaaatagtgaacgccactgctttacaaagttattcttttcaccactaatagttctttgatgtcattttttgtacaagtgtcaaagtttttctctagaggcttccacacagttaagttcttgcttttggattctttctaaaccaaataaataaatcttcgagactgcaggttaatcaaatgccttcaaacatgaaggctgtttaggagctaagctgcacagacattttccaacatttaaactcttcatgcagcatcttcctatctcaatttgtacccgttagccagttccacagggcatattgggaaataccttttattttcaatatttatatttgtcttatagatatttgtcctttcaagtaggacaaagtggtaatgacctgcctctatcaaaaaattctacctagtaatccaagataagcagtgtgttcctagtgagttgcttacataaaagccaatatattttgtactgaatagtatacagtgttaaaaactcagctttttgagggacccaagcaagcctaacctacatgattttacaaagacaatacttaaaagtcataaagtactaagtctcaactttcagacttaagactcataaacgttttaattttttatcccttaaaaatgttattttttggctaacagcattgaaataagcgttactatagattaatactatgaaacaggaacaaaactgttgagcagacattctcccagggaaggactgtgtgtgaacacattaaacttacgcataaaagtggagactgtaagtgggttccagggtttccccacgctgactttttaaattaaatgtggcagtattgctaaaaataaaatttagtgtttctcaaattttttttagatagatacctcatatggtactcacaagtagtgtgaaaacttaagtagtatatccatctaaagcagcacaagcaatatgtcagcaccttttcactattaccacagagaaatagtgttggagaccatattgaaaatgactgtagtctggctgaggagatattaagtgaccagatggcctctggcacttctgttttcaaagctgccttatagtgcctttctcactttgtgataccaagctgctgccatgctagtgtccaccctcgaacaccatgccactcagacatggtgggattcgtgtttctgaaggggcacagtaggaagctcattcttgggccttctggcctgcctgagactgtgctagcaatacagtctcattgtgcacaaaagaagccatttttcttaacacctttgagccattaatgaaacctaccagttagaggtggtcaaaagacaaaattacaacaaatttagcttaaagatgtattggttttacttgcaattgtagaattgggcaacaccttgttctataaaatagtatgttctgatgagctgggcaaggtgttgtctgactttatggacagaaaaggactgaagaaagcagaaacaaaatgagaagtagacaggttgtttcaacatttccttctttctaggctttaagcagagggtactttcttatgctggatcaggtaaagggccccttctgcttggttgctatgaatctcctgtttaaaaagaaaacaaaaacaccacacaaaaaaacctgacccattatggtttggtctggttggctgaggcctagggccggagtctagtctaaaacaatggcctcccctaaacttgaacagggttacattgtagaataacataacaggaaatgaaaagagaaatgtgatgctcttcaacaattggtttatggggccttttaaaaagtgtgtatagagtcaatgatgaattaagatgcagtgtgaaagaaaatgacacaggacagatattcagagatcatttgttcagttttaaaatcagattattagtattgctgttgagtcatttcagttccttgtgtattctggttattaatcccttgttaaatgaatagtagaaaatattttctcccactttttggttgtctcttcactttgtagattgtttcctttagtgtgcagaaggtttttaacttgatgtaatcatgtgtctatttttgcttttgttgcttatgcctttaaggtcttatccccccaaaaatctttgcccataccaatgtcttatagcatttccccaatgttctcttctagtagttgcagaaagcacttgtaatttaacagctcaggaagggaatcaaatcattcagaccaactgaagctttcaaaatgttactgcttgaatgggcagaatatccaaaaacatttattgtgtgatcctaacatctacatattagaaactgatagaaaacttctgatgtatcagtaagatgataattacccttgtaacatttctggaagcatgtatgtatgtatgtatgtatgtatttaaacgaatgcttgtatatctagcatctctttcaattgactcaatacccaaggaattttatctccattttacaaataagagagattatgacttatttcaggtcacagaagttggatcacagctggaactttagtccagttgggtctagaaattcaattttctttttactttcatgactaaggaccactctataactctgaggtaaaaagagcaaacataatgaagttatttagagtagtgtttctaaatctaattttgcatgagtcccttggggaacttttaaaacatgtagataaccaggcacttcctgttatcctttttccactgcccctagcagacagacttagtatgtctagcttaggtaacctgggattgtgcaaaaaagtaaatcttcagagtccctctgaatatcaattctcattatgcaattatgactcctaaggcttaaaagtatgaaataaatctgtagagatcttaggatctcctgtggaagttgtttttgtgcctaaagattagcttgtttgtaagttcccatactcagtgagaactgaatattttaaaaaactggtgaagggtggcactgtattttaacgtaaaacatgcaggactagatacagtcacggccattcaattttttaagttgtatatctttgggtgagttacttagcttatttcagcccagatttactgctatgtaaggtgtaattataattattgagtaaaataaactaaagcatttaacacgatgtctggcagagactaagtttttaatactcttaaaaacatcttctggaggtaggcttctagttaattagtgttttaattatgtaattataatttttgtttcctttctctgtcctcatatttgctagaaaaacactatgtcaaccatttgatcatactcatttgtttctaagcatatatcttaactaatctagagacccatattcattgagcttttggaatgactggaaaatttctcaaagcttcctcccttatctacggtttagtttacaaaaattaaataagcttatgatgtgtgtctcatccacccaagtacatctgcagggctcctctattgtaaatcagctgcctaaggctcaagttagacacagtcaaagccgtgtatatttagggtacataatcttgatgtcaagtgctggagtcttgggcaaacttttcatctttttatgtaaaactgatttccattaagtatgaaaacaccttggtggtattgattttatgaaccctgtacattccctgcaatgaagacagattttagggtaaaagaggatgtttgcaagaaatggtgagttttattgtaagagaacttaccggccctatagagaggagaaaacaggttggaatgtccagctgctaccacccaacgggatcccagcacaaagaaaacagtcaaaattatgttcatcatgacagagcaaatgagcttttggggaaaacagaagcaaaataaacctttttgaataatttattattctataaacacaatcataaagcgtaatggtatcagttcaggagaaaggtcccactgctcctgtgttctacgtcagtggctgcagggccacagcaggcagagataaccaagcatgctttcactgccctgatcaccattcccccattaataatttgcttggccctttccttcctactgcctgaagaaaatcaatgtttggcagctctaggttgaattactgtttattttatctttagcctacacaactgcaaaaggaaagcctgagttttccagtgcatattccaatacctgtttatggaagtgagaacgagtcagatagtgatgtattttttcagagagtttcttaagccagctgtggataagaaggtccaatttgcattggaactgctaactaggactcagggaaatcccatctggtttagagaagagtaaatgaaaataaaacagaattgtgaatgcaatgcttcaataattagtttgcaaaacatgtatccactgccttgtgtgggcaaagcaccatattaggaactatagaggactgcaagaaaaacagaaaaacagagtgggctccttttgcaaggtattcgtggctattccaggcatcctttcttctttcagcagtgatctcctgagttattactatgtgcctggcgctgttctgtggactgcggacaaagacaaagtctctgctctcttggagcttatattccagtgaagtgggggaggactaaatgtaaatacatgggcaaaagtcagctaataaatactgtgcagagaatcatgaggagttgatgttcagttagtgagcaggctggttcgttactagggaagatgtgaagggcctctgagaagtaaaattgtagcagagacctaaataacgagaaagacctagccaagcactgagcaaggcaagggatgttcctggaagggaagccagagagtatggccagagcccgagatatcctgggtctggtgagtcatagatgagactggagtactggagtaggcagctggcaggtcacagtggactttcccagtgagtcagggattttgatttggggaaacctttggggattttaaagaggaaagtgacttgatctgatttttattggatactttaagaaataaattttgttttgtatacttaaggaatacaacatgattctatgagatatatatatatagtaaaatagtcaccatagagaaacaaattaacatatctatcatctcacatagttatacattttccccttatgtcaagagtagccataatctgatttagcaaaaatcatgaatacaatacactattactaactacagtcctctgcacattagatctttagacttgttcatcctaaacacctgttacttggtattctctcacctacatgtcatttcctctcccacctctagtaaccactgttttattctctatctctgtgggtattagacattgtttttttagattccacatataaatgagatcatgtaatatctttctttctatgcctggcttatttctcttagcataaaaccctgcaagttatgtatattgtagcaaatggcaggatctccttatttaaggctgaataatattccacttaatattttataatgtgtccatcccttgacagatacttcgattgctttctatcttggctaatgtgaatataggtcgggtttggttccaaaccatttcaacaaagtgaatattacaacaaagcaagtcacatgaatttcttggtttcccagtgcatataaaagtatgtttataccatactgtgctttgttatatgtgaaacagcactatatcttttaaaaaaatactttgataaaaaatactttactgctaacaaaaatgctagtgatcaacagtattcagcgaatgtttttgctggtagagggtcccgtcttgatgttgatggctgctgacagatcaggatgtgggtgctgaaggttgggatggctgtggtaacttcctaagacaaaaatgatgtttgctgcactgactgatttttcttatcacaaaagatttctctgtagcatgcaatgctgtttcatagcattttaatcagagtacaacctctttcaaaattggagtcagtcctctcaaactgtgcctctatcaattaagtttatgtgatattaatatttaaatattttgtcatttcagcagtgttcacagcatcttcaccaggagattacttcttatgaagtcattttactaatccataagaagcaactccttaaccattaaagttttttaagaaaaattaattttaatagttttggggttataggtggtttttggttgcatggataagttctgtagtggtgattctgagattttagtgcacccatcacctgagcagtgtacattgtacccaatatatagtcttttatcccttgccccctcccaaccttcaagtccccaaagaccattatatcattcttgtacctttgtgtcctcatagcttatctcccacctataagagagagcatacaatatttacttttccattcctgagttacttcacttagtataaatggcctcgcactccatccaagttgctgcaaaagacattattttgttcccttttatggctgaatagtattccatggtggatatatataccactattaaagttttatcataacattacagcaattcagtcacatcttcaggtcttacttctaattatcttgctatttccaccatatcttcagttacttcctccactggtcttaaacccctcaaaactctccatgaggttttgcattaaacttcctcccacctcctgctaatgttgatattttgacttttctcatgaatcacaaatgttcttaatggtatctagaatggcggatccttctaacaattttttcaatttatttttcccagatccattagaagaatcactatctatggcagctattgccttacaaaacgtgtttcttaagtaagatgttaaagtcaaaattgctttttgatccatgcacagcagaatggatgttgtgttagcaggcacgaaaacaatgttagtctccttgtatatctccatcagagctcttggatgaccaggtgcactgtcaatgaacagtactattttgaaaggaatcttttattccaagcactaggtctcaacaatggacttaaaatatttagtaaaccatgctgtaaacaactgtcatctaggctttgctagtccacttaaagactacaggcatagtacatttagcataattcttaagaaccctaggaattttgaagtggcaaataagtattgactttaagtcaccagctacattagcccttaactagagaatctgcctgttctttgaagctttgaagccaagcactgactcctcttctctagctgtggaagtcctagatggcatctttttccaatataagaccattttgtctacattaaaaacctgttgtttagtgtagccactttgatcagttatcttagctagattttctggataacctgctgcagcttctacattagaactcgctgcttcactttgtgcttttatattatgaagatggcttttttttttcttaaacctcatgaaccaacccctggtagcttccaactttacttctgtagcttcctcacctgcctcagccttcatagaattgaagagttagggcctttctctgcattagggtttggttaacaggaatgttgtggctagtttgatctatctagaccactaaaatattttccatatcagcaataaggctgttttactttcttatcattcgggtatttactggaacaacaattttaatctctttcaagaacttttcctttgcattcacaactcagccaactgtttggcccaaaaggcctagtttttggcctatttcagctttcaacatgccttcctcactaagctcaatcatttctagctttaaagtgagaggtgggtgactctttctttcacttgaacacttagaggccactgcagtgttattaatttgtctaatttctatattgctgtgtctcaggaaatagggagatgggggtggggggctggagagagacaaggatagacagagagagagagagaccgacccagagagacagagagagagagagacagagagagagacggagacggggagagagacggagacggggagagagacggagacggggagagagacggagacggggagagagacggagacggggagagagacggagacggggagagagagggagacggggagagagagggagacggggagagagagggagacggggagagagagggagacggggagagagagggagacggggagagagagggagacggggagagagagggagacggggagagagagggagacggggagagagagagatggagagagagagagatggagagaaagacagagagagagacggagacagagagagatggagacagacagagacagacagggagagagatggaggaagggcaggttggtgaagaagaacacagacaatattaagttcactatcttatgagtgtggttcatggcaccccaaaatagttataatagtaacatcaaagatcacagatcaccataacagatacagtaagaaaaaaagtagaaatgtgagaattaccaaaatgtaacacagagttgcaaagtgagcacaggcaggtagaaaaatggtgccaacagagttcctggatgccgagttgccagaaacgttcaatttattaaaaatgtatctgtgaagcacagtaaagcaaagcacaataaaacaagatatacctgtatttgtttttaaatataaaaataatttgctttaatgctgaacaaaaatgtcccatgtaaaaaattcatgtgctatctgttcccaaactcagtttccacacctaattacagtaaatagaaaggagagaaaaaccaaactttcaagatggaaaggagaacccaggacagcctcaaacccaacacttagaatggtatttctgcatgcccaatctacagcaaactttcagacttaagaaggaagagagaatggataaaacgttacagaagacagtattacattttaaaaattggtaagatagtagaatgtttagatctggaaggactttaaattaatcttttttccttacattcagataagctttaatgtgtactaaattctatcccaaaatctctattctttgtgaccctactgtaccctacgcagatttttgttgactcaatactccactgcacttaatttgttttttagtctcagctagacctgaaacaactttaggaaagggatagtgtcttcttgcttacttttatttttcctaccaactagaatactaataatcattcaaatgtttattgaatgaattaatggataagcaaatgaattaatataattagttgcttatattttaccccccacactagcctatagctttaaagttgtggtgactacaatgtctagtcacttaacctcacagggcagatttgctcaactaataagattttgaatgagaaagtgcttaaaaattctaaaagtgcttctctaatatttgttactattgtgttcaaagactgttagctaccaaatgaaggtttcatagtcaacagaggaggctgaatcccagacaattacaactgaggcccgggctactccaagtgtgatctttggagtatctgactcagcaaacaaacaagaatcacctcaacccaaaaccctaacccaaatagccatcattactacttccttccaatctccatctccacaccctccaataatgatgaattcttaaagcttgaatacatgttttaattgtaaatttgggttatttctgcatgtaattttacagttattttatttcacccttgtgagttggagttaagctctgaaaaggtcttattttgatgtctttccataagattgtattccttttttggcaagagaacagatctggagttgagctcctgccctctaccaaactgtgaaatttgagacaagtcacttgtcccccatgccaacccctggggcctcacttttcttattcaaaaagatcaaagattttgtcctaactcatgaaatcatgagcattacatgtaaaattaccttagaaactataaaatattcatttcaaatgcatcaagatgttattagctatattttatgagctcagcactccttgatggtcctgaagagaccaaaggggctgaggccaaagggagaattctccttaaatctcttggaaacaatctgacagaccttagaattgtgtagtaagatgaggacataaaggaacagagggtcaaggtagtatcttagctcctttctcccaacgtgttgatactggttaagatacacaaaagggaaaacccacctaagaaactgccaggaattcttttttttttttttcattttgttttaatgctaacttaataatcatgtcttagtgtaactaagcttttcttcatcaagaacattataagctcattgatgcacaggctaaatctttatgcttatttggtgctttttaatctgtctagcacagaatagggcacaacacaggtcttcagtgtgcctttgctgaattgaaatacaaaaaaatagcacatctttcaatacttgaagctcatttttataaagtatatgtgtgtagtagggaattctaaaaactattttttgctggtactagtttatttaatcaagaggaaatatcttcataaagtcaaacaaccagaaaggacagtgcaaatggccctcaaagcttgagcttagcaactgctcccctgttcttagtcttgccactgtgtggaatttaggacttctatatgcagatagtttgttacttgcaaaccattagaccaagcttgtcctacccacagcacacagggcgcatgcagcccaggacagctttgagtgtggcccaacacaaatttgtaaactttcttaaaacattgagtttttgcaatgttttttggtctcataagctattgttagtgttagtgtttttttatgtgtggcccaagacaattcttcttccactgtggcccagggaagccaaaagattgaacacctctgcattagacccttttaatactattataggtaatatattttacaacataaaaaaatcatctgtgtaccagtcagaaatgaaggttttgtatgaaacattttcattcttcagtatcaacagcccaagattctcctgactttatttctccagccctggcccctcacctcaccatctcttagctggccccagatatggcccaggtgttttaatcttctgggtgatctgatccagcctcttgactttaaatggcatctatatgatgataattttcagtttaagcctcccttcagaattccagtttctcaaatccatctggctattcaacctttccactttgatatttaagagacactttgggttcagaagagctaaaacagaactttggattccccaaacttgcatgtcctccaaattttctcatctcttaaatttgattcaggtgtacaaactccacatttgtcatcattcttgggcccctgtcccaactctcttccccacacccagtcaagaagtcctgttgactctgcctcgataacaaattgctcacacatttcctttgctccagctacccatgctgtagtgtaagtcaccatcatttcttgcttgaattctgcaacggcttcccaattgatctccccaattctacttttgcttcccaaaagtccattctccataccgaagccaaagtaatctttaagaagtatacatctaaacaaaacacttcttcacagcaaagaaatcaatacaatgaaaaggtagcccacaggttgaggaaaacatatttgcaaaccatatatctagtaaggggctaacttccaaaatttataaacaactcatacagctcaataacaagaaaacttataacccgattttaaaaatagacaaagtaacccgaatagacattcctctaaaggagacaaaagtggccaacatgtatgtgaaaagatgcttagcataactaatcaccagggacatgccaataaaaatcaccatgagatatcacctcatacatggtagggtaggtattatcaaaaagacaagggacaacatgtgtcgatgagagtgtggagaaaagggaaccgttgtacactgtgggtgggaatttggattggtccagccattacagaaaacagtatggaagttcctaaattaaaaatggaattgccatataacccagcaatgccttttctgagtatatacccaagggaaaggaaattaccatcttgtagaggtatctgcactccatgttcattgcagcattactgtaccgcattatgaaatgggttccttcaccccttttctgagcaccctccatgtctacagaagaagttatgaggaacaaaggtatatgcagggctcgttttgtaatgctgacaacagcaatcctcacatccagacttccatgtccatgtacagggttctctactttcgttctaagtcaaactgtgattcagaaatgagccatccattctcccagaattcctccattcaccccacagacacaaaaatcaaatctatgaaaatgtttttgtatatttcataggagaaacagatgtggaggcttaactcatgtatccaatgccaaaagtcttcaaaatcttcattaggtatttgttatgccaacttctttctcagccctcccggtttgtaactttttaaatctttacccagtgttgcacgaagactgttgagatggttccctctgccttcctctctctagtattctccctgggaagtttaaaatatataatgttatgtaaagtaactcactggggccttcctcttgggcctcacctctatacactgaagacaatgctttctagcaaggaggacccatgcttccagagaggagggtttgcaactggagtaacttgagtatgtctttgggattcttgagctcaacccaaagcagttcagaaacatttctttgaaacaagttcccaagatgaattctaacaactgtaatatcgcatttggcattttaaaaattttgattttacatttagacagagctattaggacatggtgggataaaaatggtagtatcgaaatatactgtttcaaatcaaattattgtattatttgttctcaatgacagacataacccaaacacattcttagtacccagaataaaggcacagccatgaaatcaggcagttattaataaaaacctagtgtagatagctaatgaaagatgaaaatgaagctgtgacatgattatgaactgctattagcaagcaatgtcattttgtatcttagagaccaaacaaggtttgtgtatgtgaactaatggttgacttatatggtaaagatatacatgcattatattcaggctatgttggcttcatttgaaactacagcttccatgggtttaaaaaatacacatatgatttgcaaagtgacaaccctaaattttcgtatattcaattgttcaaaccagtgatttctagaatgtaagtggtgtcctacttgtaagagttttaaaacaggcaattttggaataggtaaattactcagtagaagccttagagaacccaaattgctgatgtatctttttcgaaatgcctctcattatccaggagaatgtgtgtattggaagtatcttattctttaagtctcacacttagaccggttatgtttcctacttttaaaaattgtagaactttattctacagatgtcatttgatgccttttgagaccgaccatatatgcatttatacaatcttaattcaatgttaaaagtataattagtccaaaaaaatcaactaaatggcaacaagggtttttctttttctatattattaatttttttttcctccatctaaaactttccagctgctctttgtgaagttcccagaataatgattaacattattaaaccagagactaaaaatcttggtacggactgacccatggggacacattgctataattattttaaagtaaaataataaaaggggcgtcccatagcgggcaaaagttggactcatcctcaaaatttactctatttgtcaaagtcccctaaaagagttcttaggagtggttggaattggttgtcagaaccaggtgctctcaagtgtcttgcctttgtggttcgcctacctgggtttcccagtccttggttgaacattaatgttctcaacgagatataatactgaatataactcttgtgatctcttccagtggaggctgaggccatttctaaaaattccttccctctgtttcttctacagtatcttcctctccgtgtgcatacatgtgagaggcatagttttccccaacgtacttcagataaaccttattggcatagttttcctcaaagcacttccaataaactttattcctttcatgattgtcctgtagtttacagacactgatattgtactctttggagtggagaggggttttgccattcttacaaaaaaaaaattggctattcctccatttatcaggctcattttattaacattctactgtcatcattgtgctctgtcactttgactaagcccaagaaccctcccacagagcaatgttaattataacccctctatgcccgtaaaatatgccatctaaaggctttgaataaatttgggataaatttcctgaagcagaactcatgaacccatatgtattttgattccaattcctgtcaatacaggttctagttcaactcccaacacacacacacacacacacacacacacacacacacacacacacacctctcacatgctttccttctaattggcaagaagccttcagatgtccttcacccctactggaaaggcatgaaacaaaacccagtaccttcctcctacccctaaactggttttgtcttgctgcccctaatcctagcttgctgttctgtttttctattttcccctaaatgcaacttactttaagcatgtgttaactggattaacattcctacaattgaaggatagtatatgataacccatttgtcagtctagctactttcttctcttttaaatgtctacttacgacgtacatccagactgcacgccctttttattttttcaaagcaaagccaaaaaataaagaaaacgtaaaattagtttttaaagaaaatgcacaatctgtttttaattttggctatcacgaaaaggggaattaaccagccaaaaaagcaaagcaaaaaaaacgtgtcccctgactgctctgtctgtgcctttcaagcctgtgcgtctggttgttcatctctgaaagtgtgtgaaatacttttttctttaaactttttgtttttttctcccttcttgtttgggaattaagtgctttttatattatatatatctatatatatatatcaatgtgtttcttttaattgctagatctttatcttagatttgattttatctaaaattatgagaaaaaaagttatgaattgttttctgcagtttttccccactccctctttaaatgtggaacaacttcagctgcagaatcctcacatccacatctttcaaattagcctggtctcattgccaattgcgtgcaacatgggtggcataaggaagatggatgatgtcgtttggaaaatgccatttctctatagagaagtaattagcaacccagtgcgtgggccccctgcttagtagtgcgtctcaatcacctctgtagatttctgaacctcccccactctagatggggctgtgtggctgccgatgaagttgttcaacttgaatgcataaatctagtcttcttgtttttgctttaaactttttgatcatgactactagtattttatgtattttggctatttttagtaggaaaaagtttaactgtttttattatttgaaaatctttaatgaaactgtaataatttttggagtaattgcatgttgaagaagttgcagcttagggtgtgtgagattgtcagtgttagagttctgttctttatttccatagatgggcatgtgtaggctcatttgtttttgtatattgcccatcccttccttacagccagaagctctaatgcagctagatcactccgtgccgcccttacatggacatggcgactcacttacacatttactcctatcatcttcatctcctgtgtagttcactcatagatatgaccctccccttcctgcatctttccttcccattctccccctttctttagcattgttaaaatttatgtgctgtcatccatctccctaaattaaagaaagcctaaaatttgtcaaaaagacaaaaaaatatatatatctgaaaacttataaatgcagaaattcattcaaaacccgttagagtcatagaattttttgaaaggcaaattataaaagtaaacaggtttttttgtttggtttttcaatcatagcaatcggaattattttaaattcaaaaattgatgccctcccaaaccccccaaagtaaaaatttgttaaagtgcagattttttttttctttttatgttatgtggtgtggatgtatgtgttgttgcctccctgtatcatcctctgttgtaaattattatatttgaaaaattagacattttgctcaaaagtttttaagaaatgacaacaaaaaaagcaagttacaagaatgtggcaattctatttgtccaagagcattcttacacaactttcttttgtaaatttttctttcatgccaaaaaacatgcgggcaatttgttgatgtaagttgactataaattaatatggtatgcttttttagtttaaattattttgcctatatggaaatgatttctttttttcccagaacagcttctatttttaatttgcttttactttttctttccattcttattatattgtgaatgcctcaatgttatttgctctccttctcccagcttactttggctacgaagttgattttattttctactatataattttgaagactatattttttatttcatttgtgtcgatttgctgaattttcactgttatgttttgtgctgaattgcttctaataatcaatgtgaattctactctcagtagaagggggttaatacattgttcttaccacccaaagaaagcctggcctctttgcctgaactttttcaccaccgtgtttaaagccttgaaagtattggtaggctctatttggtatcttaaaattgtttccagccagtgggaggcctgtaccctagaagaaaatgagttgagttagctccaagtagtaccagtggtatttgcatctttttaaaattccttaaaaagcatttaggaaattagttcttttccttcagcaaaggggaaataaggtactctcaagtgactatggtagagtttggttatccaggatcatactctcacttttgcttcaggctacaaaatcaattatactgaaaatgcagatatcaagaatcccaggtgtttcgagtattgttctatgatactgacgccttccagtgtatggaactaacaactggcaaaaacacagacacacacagaaggcacacacacattctctctctccctctttcctttgtctcttctccttttccctttttcatttctctcaaggatttaatcaggtaagctttcagggatcttaagattctaccaagaaaacatgatgattttcatatctaaagttatacttagaaaatatttcaggtgggtaccatcatcgtgtaactacagggtaagactattccttcaccttaagattatttgaaccaatgctgccttatgtacttcaacatacataagattggtaagaagcactatataattttttcatcaagaagttacttgttttgctttacagatatttgtgttatttgaactgttatagaaatatcaaactgaatggtggataagagtgtttccaagccagcagcttaatatttgggctctctctacctcagtttatgcgattttgtgttgtttgacatgctggataatattttaggtctaaaacttagaacttcctaaatgggatgttgttttatcttgatgcattaaaatattttctttctatgaaaaagatatccaaaggtaaatttaataaaatgttatttttaaaaaatacaagctatttgaattataaattatttcttatattctattatttaaaatagcctcaatatataattatacttctactttagcatgaagccactaaataaaaaagggttagaagaaagtgattatgtaagtgtttatagctcagatacattagtagaaataataacattagtaactagcatttctgaatagtagtaggtactgtgttaaccatctaacatataaaaaatacttgatatgcattattttaatatttgcattgatggtttgaggtagggtattttattattctcattttccagagtttaagaaatttgaccaaattcctagcactagtaggaactcctagagagttccgatgttaagagtctgagttacttcagaagcaaagctcttaataagcaaatgaaacactccacttgacatttcctgttttgtaatacataatgatatcaaggggctgtggctcatcttattgttgaaaaatataatctgtagcctttccaaatcaaacctatttcagacaaaccctttgctggggtggaagggtggtggggaagcgagggagaatgccctacctagaaattctcatcctgttaaaatacaagttaagcctctttgagacacttgagtttttctactgtcttctccccaggtacttgccctgtttgtccatgactattttttcccgaaggttgatagagagcaatttcatggttacaagctttatgatatttatgtgttacaaatacacacttctatgtcaccaaagagctaaatatctttgaaaaattaattcttggggggaaaagaattatttccccttatcatgtgaattttcaggaagaaatttggaataatgcaaataagagatgaagtaaaatacccaaatatataaaaagaattcaaggaattcaagcatggtgtcctgtcccagagtctcactgttcagcatcactgttttggtattttcgtgaactctcaaaacccaaatatctccagagaggcaagtgttgaaacttcatgcttgtttttttgttctttttttttttttttccaaagataacccactgcattcactatcacccacaacattctcacagttcagaagaattctattaaattttttatacactgtcttttttgatggcagtgagccccttttgctggatatcagccctagaggcatgaattatatatctacaaatacactcataaagcaaaaaagccgggaagccttcagggctaaaatagaccttttatatctctaatgatctctctagtttaaagaaaagcacaatcctgccaaaaaggggtatgtatgcctgattttaaaatgctaactttaaagaatatagatagcttttatcccaaactaaagaaaaattctggggatagcataggaaattaggattttgatggattacaggttttgtattactctgctcataaccctttatgactttgggttatttgcttccatgaatacttttgtaggcatgggacacatagttgatcactgacttcatgatctctgggaagtgaagaaaatattatcagctacttgaacatttctcagggtagtcacttttgattaaaataaacaagaagctttgaatagcttcccaccaaactacttttttgtttgtttgtttgctttttgagacagagtctcgctctgtcgcccaggctggagtgcagtggcgtgatctcggctcactgcaagctctgcctcccaggttcacgccattctcctgcctcagcctccccagtagctgggactacaggtgccagccactatgcctggctaatttttttgtatttttagtagagatggggtttcaccgtgttagccaggatggtttcgatctcctgacctcatgatccgcctgcctcggcctcccaaagtgctgggattacaggcgtgagccaccgtgcctggccaaactaagttatttctattaatgatcttatagtaggagaaatacatcactttctcctctcaaatgatgtgtgcctttgatcccccaggacactattatcatctgcaatcttaaacatggaatttaatattaaaattaattacaccaacatatacacttgtcccaggcatttttcatgtttacagttatctaaaatgttctacctattttcattagaattgctatttgtcataaggacccccgtgtactgcagttgacttcattttaaactaaaggcaatcttcccacttcttgagaagccaggaaagaggggttaggaaagcttctaccactttgttgtctaaaaatcagcataatttgggctcagattttcccaacagagggtatcatttatcatttttatcgctgctaccgagattaataacaaaatggcaaagaaaactagagatcagtagttctgaaagattttgttttctaaactctgagatggcatacccatcattttagttttaaaataagctcttatcatttcactttgggactcaccaggcttttagaagctctttataaattaacaagcttcagaaccctcttactgtagagttataaaaaatgtggttactcttttttttttttttttaaatctaagatacttgcattagtgtgttaaatgagagggagatagcaaagtaaagtaattcaactgcagagtgaacagtttgtagattttgaaacaacaagtacactgtggaaactttagctggtattgaaaggagaaaaaacaaaccgaaaaaacaaaaaggcaaatttaagactccggttgggtgtcacagatggtacactaaaattgcaaatgaatgccactctgtaatcatgaagatggtgatcttaatcccacttaaagggacactagcctcttacccaacagtttgcctttatattcaaactatttgtaccagggctttgcctcctaagatatcagttattccttgtcctttaacctagtttcctctttgcttactctacatggggtagatttgtcattgccataaggaacaaatgactcggtgtttgtgccagaaaagaacacacatgttaaacctgtgttacagataagttaaaaaaaaaaatcctgccttgtcctctgaaggtaagtaaaactgtgcctgagaaatccttacggaagctttagacagagtccatgggccttcacttcctctctctcatcactgctctcctattactcaaaccttgccctctttcatatatcaccttaaatctaccacttgggaccccctagcagaagaataataaaaaagtttgctcagagttagttttaggactggcttacctttagggaactgcactccaaatcccatttgtaaaaactagcaaaagtgtgtaaattatgcattaaataagttgtaaggcatatgaattatatatgttcacaatgtaaaaaaaagaaaaaaaaaaaaaacaggtgtctgctggtctagtacagtaagtgtgaatctttggcaaatctgcacagatcattttgctcaatagtttcaaactctgagcaccagaatagaggcttaggtttagagcacatactacaagatcatcttgagaatctcaaaaaggtatttttttaaatttcatagtaaaattatcacataggccagagatgacactgcaacattctgttgtcccttcccttctaaatggtacacattatatgctttctcggttccctcagaaactcagtttctttctgcagaacacaattgttattggctaaacagggagagaataaaggcttctgacatgggcaccaacagtttctcagtgcttgaaggtaggtattagctttcttctcaggaagcccttctcttagcacacctgaaacctggacaatttggatgcatgggaaaggtttcaggatgcaaggtgtggaaaggttgcatcttgaagcatttcctatgcattcaaaaggagagttttaatttgtgaatcaatcttcataggaaaaaccctggaagactgtgtaggctccaaggcttattcacttggagtcccctagaactctggtactgaatcacctccttgtctggctttgttactgatgaggtgggtacctcagctacagtcttatctgttaacagctactcaaacactgattatactatcacagcaaagttattaccaagtgtaagagacacacgtacgtggtaccagttgacagctcaatgggtcagctcagaaagaggccttcaacaataacgtcacattagtacctcaaccttctaaataactggggcagggaaacattcgcagcatccctgcgagtggattttttttaagtgatagtgggaatacatttttctggaatatattcaataaagagacatggactatgacttcttaagattcttcctttgcttggaaaacaacattataaagacactgaagagagatcagttatcctgctgacatagatgcatagcaatcttggccttacagtagggtaagcaaccactactgcagaatatttgtggtacccatgatctgcaaggccctgttatttaatgaactattctgagctttctttcccaacttagtctgtatgattctaagtgcaataacgagggtctatgggtaaacagatatgtttttgccacactagttagcaatcaccaatttaaaaaactcactttgctaagtcaacatttctgagtctaacagtttcaagtcatggatatctaggctgagtattttgaaaatctagcttccagctcagcatatattgcatacagcatgaaagcaatgcatacaaatattagactaatgcaaggcaagctgtcatttaatagtcagggggatttctggaaaagcatggtcaaaatggatttgttagatgaatatttttaactttttaaaaatccctattgctcagcttatagtaaacaaggactgtgattaataagtgtgaaataaaaggaagtaacttaagaaaacacaaaagacacaatcttttatgtttcttgatcttggtctcaataagatggtgaatcggtcattctcatcctcctgggagcaaatgagcagaatcccaagaaggcaataaagaaatcttaaacgcatgttaataaattcttaagttaagcacacaatgtgtgcgtgtacccacacatgccaattttgatagccagccagtatttataacagtatcattgactgaatgtcatcagcccataagcagatcctggaaagaacatatatagttgaattttatctaaataattacttgagagtatctttaaaaaatctaagcccctgatctagggatttcaggtttgggtggcaagaggcatacagaaggctccaaatctgcctagaatgattagactccatccagaaaagatccagatctttttattataatttctgaggcataatctgtgaatgacgttggttgagtgagagttgtttacaaatatactaattgtttttctttttcttttccatcccaggaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcagatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttcccaa

SEQ ID NO: 794 - DNA, 585108 bp, Homo sapiens; identical to SEQ ID NO: 793

SEQ ID NO: 795 - DNA, 223007 bp, Homo sapiens
cagtgcatgaagtatgctcagtgtgccagcaagggctgataatcagcagaaggacagggtgcttcgttagtcagaagagccagggcttcccggctgccaggctacagaactcgcctcgccactcctgagacatggacaacgccggtgggtaaatcaagcatgaattcttcatagctgctggcttcctttgcagcccgcatcctttactgcggaaggtttgcctatttgttgctctcgttttgcacttaaatgttcaagactgagacgcgtgtaatatgtgaaccccgatgcattgtccacaagacaattagtgtttactttgaagtttaggaactgggaatgcagattgtattccaaattcaccttttgtgaagactactgctatttaggctgaagcaagtgtggtgtttgattcttttgtgctcagagcgatgggtggaaaatgcatacagttagtgaaaaaactattactaagggatggcacaaggtagatggaattaagttaatgagctgagcaaaaattctgtgtaaatattacaatatgcacagtgtaacagcataagagctctttggtctgatgctttcatcttcacgttaggatgcaatgtcgaaaatgtttcgatagcctctgatattttaatttcagaatagagacattagtggtcaattgtgaacctttaaaaatgtacttatttttagtatctttacttgataactagacaaacagatgattgaagtatgttaatgtcaattaaataattagcataaaattatcaggtggaacttttttctttttactttgctgtattgaacttttagaggagatatactgtgagatcatgccccatttcagtgttgtcggcactcaagcagaattctcccagctgtgttatggattatctgtctcctgaagctcattagttcagttacgcagctggtatcagcttgaaggtgatgcttcccatgccttgagacacggtcagctcttctaagaggttacatcatttaaaacacattctacactacaagaccacccattgatggtgaaacatatttgtttatgaaattgagctagttcagtcctcggcacaggtagcataggctagcagagattttaaagtcagcgtgtattaggttcttttatgaaatagcttaccaggaacaaaactctgtgactaacattatttggtcattgccattgaagatattgaaataaagtggaacagtataatatcagggatgaaaatgttagggtggtggaagaaatgaaacaagtgtaaggatgtgtgtgtagtagtagcaggagtgaagctggatgcatgtatatggattatacccccattctggtcattaaaaaaaatgtactatagggcttgtcataaaagcaggtaggtatggtattccatgacaaggcacaatttgaagatcaaccaaaagcttctctaattacagtggtagagtgagtaaaaattaaataaataaacttagaatctctaatttagcctcatttaaaacttctgccacccacaatttattatactgacattctggcagaacgatcactttaattcaagtaaatgcctttttaaactgactcatatatttatttaaaggccatttaaaaaaaggaaagaaactcctgtggcagactttatgtaggcttaaaaatgctaagggttatttttcttttttgggtaactagagctttgggggatgttttcacaatctctagttatgttattaaatgcaattaataaaatacctctgctcttgatgagtttaagattatttaaacactgtggagagtggcttgtaaagtagcaatttctatatcatttcaaattttaggtgtaatctcaaatatagccatacatacctttgaatagaataacgggttttaaatcacataatttgaatgcttcagaaatagcatgtttcttataatggcttataattggctgtcagtgatcacttttcatggtaattttttgatgaggtaagcagcctctcttacaggaggaaaatgtaaacatccattatatacagacatttcaatacattatattgactgtaagggaagcatttaagataaaactggtaagtggcaaaaaaaaaaatctgaaaaatctgaaataacttggagcactacagtttctccaatttaatttaaagaagataatgatgttgagtatttgcctaaatttttctaatcagaaatgaattgaggccctggatttcagagctagtagtttagagcggggcactcgtactgacaactggatcattagtttcaaggagccagaccttcttctagcaaggctttctgtgtgggagtttggataattgacaggcagaagcacagcaatgggtccacacaggttgaatgtccctcatttattcaagtcacatagaacgctgcatcaggatatttgtgcatggtttctgctgttaacaagtaaagtaagatgagctgcttgggactccggcccttttggtgggtgtgtgtacatttcagctatcatggcattgtgaatctgtcctttctctccttagcagcaaagagctgacattcctactatctcagagaaggagacatcccttccccataattgctggcttctgtattcctttaaaagcttttcctggaataacaataaaatatttatcaaactgtgtgtgtggaatatgtcagggcaattttagcaatatctaacattttcttctttttttttcaaatggctatttcttcttagaagttatataacaagtcaaatagatggtgctttagaatggcacacctgtgactacaagcatcatcagcattctgccagtgccactatcctccttacctccatcaagtggttctcgtgaatgaactgtgataagacattcagaggcaaagttgattggtgtgtgttttttatctgaaacacaatttttgaaatgtaatcccatattctacagtgcagagtactgttaaaaaaaaaaagttctgcagaatttattgtgttgggttttccctacttgatatcaagatatttcagttaccatgtgtgggttgaaagagccacactcatttggaggggaggtggcagctgctgagagcccctgcgccttcaccgtgcattctagctcagtggttcaaagccttttgacaattgatgtacattcattgagtttgagaaggtcacagtctgccagctccctgcaaaagagactcgagagttatttggagccagactgaggaagggtttggagtggagtagtcgagagcatcagataattttagctgaacgttggctctgctacctgtcatcccagtgactgtgaacaagtaatagaaactctatgcatttaattttctcattggtaaggggtgacaataatggtacccatctcataggattgctatgaggagaaaataagataactcctgtaaagcttttggtacaatggctggcatatggcagcatacaatgcatgttggcgttttagagagtcatcaaaagattgaagcaggttgctttatgaacaaataaatatatgctccagcagcgtggctctgaaagtggtgtggatgacagtgtgggaaagtgagcaattctgagcaaagagactagtcaagtggctgtctcagaagtagaactggaaatttatgtgggtggtgcaatgggcatggggttgggggatgcattggatatgcatcagcagagcacgacgagtggatatggaggcagggagaactgcagcagtcaaaggagaccctggaggtttcccgttagagaatttaagacagtagtcctgcactactgaacacaagatgagttttcagagaaagacagtgagttccattttgacattgttgggtttgaaataccttgtgtgttgcccactagccatagtagttggttcactgatgactatttaatccacttaaaggattaaaaaggattcctgcctcctctccctccagtctgtgggagattctatgggatggtacagagaaaggaaactttcaaatgcttcatctttttttatagatggaaataagaccaggcaaagagaaacatgctcctaagcattgcaataattagggtaaaggccaggctgtcacataagaaaatgtaagcacgaagacatttcatttcaagctggttcaaaaccttagcagcccaggttgtcatgccaaagttcctgaacagctaaagatggtgactcaggagaagggttacctaatggggcagagatccaataagaatgcatatgttttgaaagaggatgctttctagaatatttgactatgtttgcaaactctattttttgcaattaaaattttgtttcctctaatcctccactttcatgatctcttggtcttactatctataattttgttaaccatgatactttttagaaatttattaatgttatatatacacacacacacacgtacataatatgtacacatgcatttgcatgtgtattgttaatatatgtacgtatgtgtggattctttatttaggggattgtcagccttgatgtaggggaatgtaatgttgctagctcttctaaaaaacttgataaaaaattagaacagattttcttttaaattaaaaaagaaactcattcttatcctctgaaatgcctttatgttgtaaagattattatttaacattttattaactaccaagcaaatgacagtattttcctttgaatttattgtgaaacccattgtgctattttagcattttaggtttcacaaaataaatattcttagaagcatccaggattcatgtaaatatatttttgtttttcttttttttgagacggagtcttgctctgtcgcccgggagtgcggtggcgcaatctcggctcactgcaagctccgcctcccaggttcacgccattccctggcctcagcctcccgagtagctgggactacaggcgcctgcccccatgcccggctaatttttacattttcagtagagacggggtttcaccgtgttagccaggatggtctcagtctcccgacctcgtgatccacccgcctcggcctcccgaagtgctgggattacaggcgtgagccaccgcgcccggcccatgtaaagatatttttctaagcaaaaagttaaaatttgataaataatctgttttttggagcatctgttttcaaaatgctagtattaccaaaataactgttttaaaataaaaatgccaaaaggaaaaatcagttcatatataaacataaaagtactgtgaaagtgggactaaattttcttcctagttttactctaatagtgtagtgactgtgacctcctgcgagtaaactgacagtcatggcccaagagtgtgcagaagcaggacaaagtctttgtttttgaaatgaagttttgacttttgtttcaggatcactggaatttgttctgagcgtttctttctttgcaaacgctcatctttccaaaggcagaatgaattgtgatttttctgtatcaccaagatgaaatagaaatccttgtcaaatggcttctgtcgagaacaactgttagaaaagatataaagcacaagcaaaaatgcattttggtgatagaggaatcagtaatcaacattttctaaattatacgccattccatattaattccacaggttattaaataaactccccaacccacctccacacacaaagaatttagcattcaggcaattttaagaattgttgagtttaacagcattcaacaggtttcttagcatgttaagaaacatgctgaggccgggcgtggtggctcacatctgtgatctcagcacttggggaggccaaggcaggcagatcacaaggtcaggagttcgagaccagcctgaccaacataatgaaacccccatctctactaaaaatacaaaaattagccaggtgtgctggcacatacctgtagttccagctacttggatgcctgaggtgggagaattgcttgaacccgggaggcagaggttgcagtgagccgagaccacgccattgcactccagcctgggtgacagagtgagactccgtctcaaaaaagaaagatgctgatagaattggcatataatttcctgtgggtgctaatatttgttgtgaattcctaagatggaatacagaatgcagcatttcccaatcatattaacctcaggttctccaggggataccaagttacaaggtagataactccaatttggaatgcactgttaagatcccttcattcacagtttcactttccatttttaccttattcttcctctccggagttcttctcaacttcctgtttccaaatataggaagccatttttggtaactagcaaagttaccaaaaagttacttttggtaagtaacttttaacatagatatttaatttctaaacaatcaagcattcatacttccataagtatgtacatttcatgtacatgaaattccattgcacatgtacatgaatatgtacatttcatgatacttaacttccataagtgtcagtgcttgattgtttagaaattaaatatctgtgtcatctatgtccaggatttctcttctctttccttgcctctaacctttcactgctcataaacatcaccatcagatgaagtaaagaaagaaagggagctaggccttgaacctgctttggaaaggagtggaattcaatgacatctatgagattgggggtcatgcacagattttatcaatccaaatgtaacaattcacatgaaatgttaaaaatagatgatgtaagatgttatatgtaaaaagtcaacttcaaagttctatttttgtaaatcaggtaccaagaacatatataacaaaggcaaatcatatttagctaaatgtcaaatgtcttaaaaggaaggaaccttacttttttgagtgtccattatgtcctaggcatcaagttaggtattttacacatgttacatcattaatacttgcagtcactctgtaagtaaatattatctcccccaagttacatataagtagctgaggctaagagctcacccaataaataagccagtaatttataaacttgaatctagccttttgtaacaatagcaaaattcaactcatcatttttcatgttgttttactgctttaagagtggggattcttggtctttgtgttttccatagcattgagcaccgtgcttgggctgtagtaagtgtatagtaaatgtttgctgaattaagtcaacaaacatttaatgatgtttaattaagttggagcaatttttttaaaaagcaaattaatttgtaaatatcaatgtcatatgatcttattatacatctgaataccctcttggatagaagttagtatatggataagacaaaatatagttgtgaagtgtttctttcataaacattcataaatttatgacaatttataaaatagaatgctttttgatagagcccacctatgaaatctgttaccattgtaaaaaaaattattcaaaattttcatttgaaagatgtgataatattagagtcattaacaaaaattatggaaagagcctttcccatatgtttttaatgatatttaaatgaaatgcagacacacctttctggaatatgaaagaattttactttttctctcttcttcttccagagagatcatgattagagggaagaccacagagtacctgtgcctttgtctcatctgaccacacctgtgcctgaatagtcctttttctttcactagtaatgctaacacgttacattccacatgactctttccaaactctgtactactctgtgaaccagtacaagatttgacaaacacacagtgaaacaataatctcatttaaattttgatatctatgtcaagagaagccatagtttcaaagtttcagtttcaggtttcagagctatggtttcaaagtttcagggtttcctaccacttggtataaagtatctgcctaattgtttttataggtagctcttttattatttttatagataattcccaacatccagctatctccccaaaattattttgaatttttttcacataaaccaattttttccaaatatttaatcttctaattaggaatagtgattgaaattgtgcctcaggactggactttagaatcataatttcctttcttagacctgaatcattcagtcctggcacagcatttatacctttacaggtgtcaagttcaaatccttatatttattgttattagtaatgattatatttgacttattaacctgtatcttctgttattttccatgtatcctctacatctaccagtctgttccacgtctgttctgtatccacaaaagcatttgtaccttcattcttgctgttcttcccacctagaacgccttctcctccttgccattcagtcgttaattcatccatacatcctggtgatgtttcctggtcacccactctgtgccacgcaatgtcctagttagtgtggatatgagagaatgaaacggagcttctgtcagcatgctccttccttctagtagagaaagcaaaattagtaatgaatagacaaaatgcttggggttgtgatcagtgctgctaagttaatcaactggtatttggataaggaatgaggttggggtggaggctacgccagactcggtagtcagagaaagcttcctaaggaggtggcatgcaggctgaggcctaaggaatgaaaaggaatcagccacgtgagagccagggtaaaaatgtgtcaagctgagtggccggcaaacacacacgcccccagacaggacgttgactgggatgtctgagcaacaaggccagtgtgtctggggcctgatgagaggtaggggcctcagaccaatcagggagggccttgaggcttggcctctgtcctaccagctttcaggagcctttgaagggttttacgagactgggaagaatggactggaaagaagtaagagtggaagctcctaagaatgaaatccacttagaaggctcttgatggaggtggtggcagtggggaaggggagaggaaacttacttcaatcccagccctgtgtcaaggcccagcacatatcccatcttacaacgtcttcccaactggtctccaagccctgaattttctcatgacgctgatggaattcaacacccagttttgtacttactggaagttcatctgagattactctccagttgagtcttcccttcccaaccagatttaaaagtcttgagggcagatgccacatcatagacatcttttatgtcttccaaagagttagagtggtcattctcaactctagctactcattagaatcccctggaaatcttttaaatacccatctctgtgccccaccctagacaaattcagtccgggactttggagtggggtcaggacattggtgtttgtttaaaagctccccactatattctaatgagccatgagggtgacaaccactgttagagtcctctctctttctctcttttctttcccctttctctccctccttcctccctccagtctagcaggccagtctagctgagattttgtgcttgggaattatctgcttccaggtgagatgtgaggctgtgagattaatgagacctccaaggaaatggctgaaagaaaagagcagaggtgaaatactgcttccaggcaatgtatcaggataggaacaacggaaactgaagccagactttctataatccacccttgtggagtctgtagactggatcaaagaaggtggttacggagagacttagtcacctacttcctaatcaggaaggttggtttcttttccaacatcttagaagcaaattaaatactaaaagtgaagattcaccacagtggcaaaaactatttctaaagagactacatgtgaaatttaactaaaaagagatgttaaacatctcttgtcaaattctgtataatagaagaggtacattattagacccccaaatagcactgctatgatttaatcatcactaactgtatctgtaccaagaggctgggtcagagccacgattagacatcgatgctatatttgctgtatccatgtgacttaccacaggcgccctgctttttagtgatagagaaataggtcctgttccaccttgtacttcctgctccaaacacacacacacacacacacacacacacacgcacactccagaatgagtttcagatcattttaaattgatagtgaccttaaatattaaagcctagggatgctttgataacttgcttttctggcgttttggttaataaatggtgttttttacaacatggttaatatatgctttctaatagaaacagcgcaatttagtaaaaccatcttttacaatgtttgacttaactacctcacatggtcatgagcgtcacttgagaaggtgtcagtgtcagagggttttaaactccaaatgtttatacaagtgaagcatctagtattgggaggatccaccagggactggcaggggaggctggggggggataggggttgaatgtttccctaactgcccctcctgctccagcccccaccatttctccccagaccctctcacttgcatgtcccctattgccatattgcaaagcctcctccttgtcttagcctcagctcaagtgtccccgtttgctccaaaccatcctcaactcctctggatagaatgagtgttctcactcctctcctctcctccccgaaaactctcttctacccctgttggaacacgtagcagatataccatcatgctgcttcacgtgctcctcaagaacagggccacgtctccttcttgagccttatactaagtactgtacctggcagaggaggtgtgttccataagcaggcaaatgaatacactagctgaaatcaagcctgagctgtgtcttttattgtgtgctactacttatatagaaactctgaattaattcttactggaattgaatgctgtggccatatgcaatttaatatgagcagcagttcttcaactgaggagcccattagaatcacttgtgcaattaaaatcttcctgcctgtctgtctgtccatccatccatccatctacctgcatgcttacctacctgtgatctatttttctgtctacctatcattgatcaagagccctaccagccccactccagacctagttaattcagaatctcccatgggaagaaaggggtacttttaagaaatgcttcacagatgattcctctacgccctggtgagacccattatcggtctaagaaacatataatgaagccactcagacaaaataggtttctactgtttcgtgtgctattaagatacttgcttattgccagtgtgaaagcacattattattagaatgctaaagatcttgtgccttgcacaaaaatgctctgaaataccctactgaagggtacacagtgttgacctgtacacaaagaagcatctttctttgagactgttgcatgggaatggtggtacattctgttttctcttcctccacttactgtggaaagggactcggtagcttttgtatcattaactgagacttgcttaaaactgtacacccaacttgtctttaatttaccacctgctgcatgcctctgcacttcacatcctgggtcttattttcttagtaagggaaatttggcaaccctccatttttaaagcagcttgacttggggcatttttaataaggggataaaaggaaatatagccagtcccaaactttgacagcggtcagtatggtataaagagtgaaaatatcttaggtcccctgtgtgagattctatagtcttcacagcgccgatcatgcttgcttgtggtacttacagaacatgtcactcggtcgggggtggggggtcagttcatttgttcaaacagtaagcatttcacaacattcattaaccttagggtcacttttttaagttaaggaagttcaaagacatttgtttaaataactgtatgactgtgacgatagttgaaaaaagccagatagttgaaaattaaagccaactttgtttttaaaatccagacttcgtggaaaaccaggagctctgtagcatacatttagaataaagctccagctttaacttctaaatatcctggcttatgtcagtctttttgtcacagccctaatgctccataaacaaaggtgtctcttatactaacagatgtgggctttgtctttagctgtctcagggaaggttttcatggaacctcgaaactacaaaaactcccaaagtacccttgagcacctgggttactgtaaaacaaaatcatgtcccagaaaattatgttttcaatgcagggctagtaagaaatgaagttttttttttttggaaaaaaaaaatgctgtacatacttcaccaaattcctctcatcttcaaaaatgcttacaaatatagcttgtttctcacagttctccggtgaattatgtaaatacttcaaatcatcagttctgcttttatagatatgaaactaaggcagagaagtttatttatttattttttcagacagcagcctcatgcacagcttaactgcacataaaaaatgttgccctgacatataaaatccatgtctgcttgagtatatgcttggccatcggccaacccacaaggcataggccatgccaaatgtgatttccattggcttttatgcagggggaaagccaggcacagtttaccctttgggacgcatgcaatattgtttttagggaaatgtggttgtatttgccctggcctcaaaggctgtctcactggaggacaggctttggtcacagttttggtcacaaaacacaactgtccccatcagctatgttgaagctctctgtactaggatatgcaaccaggtgatcagggactggaaatcagctggaaattccaatagaggctcattaattagtggagcccacatatgcagggcatatacttatatggcaggtgggcagcagatgggggacagtgcaaacctccaggaaaagaacaagagcaggatcattaaagaagccttagcattttcacacagagactgagcttggaaatccagtttcagagaagggattggaggattgggtagggaatgtggacagattatagggagagaccaaggtagacacctggcttatgaaacgggtctacagaaaacatcaggaggcccccacaggtttcattctggcttcttcaatttggtgtgaattgacaacaaagaaaactcaggagggcgcgaatgagttcctgtggatcccgagccctctcaggcctcctcggtgcagaagggcaaatccttcccatagttcctgcctctctctctagagtagcacaggacttgggaagccagcagctacaaggaagctcacctgtcaagcaccaacgctttattttaattggtattttgcatgagaatcattaaattgcaactctttcttatatttaatcacatttactggctttctcaaattgaacataccccaacccttgaatagtgtgggattgtgcaaaggaatggaattagagttgtaaaagaagaatgcagttcctggctgagcctgttctacctgctggtatggggccttgggcatatccatgagcctcactttcctcatctgtagtttagggttgattgtacttggcttgagtagtaagtattatgtaacatagattcattttgcacctacgtggactttaaatctttgcgaacagtagctcatttcttcctctcagctacctcccaaggtgatcacttggccccaggtccccctgctctggctccctgagttcctgccttgctcacctctcacattttgctgttgtgcacttgcttctggcagctcccatctccctccttctaatctgctgttttcttctttttgtgtgtgtggtctgggaaaccaaataatcaagagtgttatccttttgttcaaaatgatagtacacagaccccactgaggccttgggcagtgtatgattcacttgtgtgggctggagtttgtgaattttttacatttattcgggccgagttgcagttcggttgatttcctggttcttgacataatggaggtggacagctaggttatatcttttaatgtttcctcatcatccaatttagaaatctccagagatcctgcccaaacctcaggataaaattcaagcccaaaacgtcacacaaggcccctgtgtcaccagcactgtcaccacctctggtcatgtagtcctaggtcccagctccccagactcttcctctcatcccaagtactgtgtgttcctgctgctttgcttggcaatgtgctgttctcctcgcgtacatctggtctccccactggccaggaaactgctcaagggcaatgttaccttaccgttggtttccttagtcctaccccagatgtggcacacagtaagtatttaatgcatgctggctgactcacttcttctgccattgttaccaagctacagaatgttctatagagcacaatgatgtatatagaccatctcattacatagattttaaaaatatttaaggagaaaaggacagtttagagaaatgtagccaaatgcaaacgatgcaaaatgcagcttaatgaggttagtaaaaatccttatcaacccagaaaagtccttgtgaaccttgatttttttgtgtgtgtgtttgacattaaaccaaatttagaatttaaaaatatatattttgtagggattccttgcaggagaagatagaacatgtaataattacagtaacaagtgtattgaatttgattatctcatgaaggaagatgtaccatatactttaaaaaaatgttctcaaggaagatttgattatatcaaaggcataagacctgtgaaatttggccctaagttgaggagtacaaagaagccagccttcacctaaagaaggctcagtctagtgacattgtttatccatttgctttgaacttttcagattaccttccctaacactgatgtcaaatatgccggtgaagagtttgaataaaatgttttcaggaaatgtgagagtggaaaaaagcaatttttaaaaatagcatatttttagacatgatttagtatatgtattttaaactaaattaataaattaaatattgttataagaaaaaagccaaattaccttccctagaaaaagaaattattttcaaactcctaaaatgtattagtatatttaaattgtcccttgctcttaatatatggagagagaaaaaaatgtcatcataatacccaaatgaaggcccaggtgagcagatcacttgaagtcaggagttcaagaccagcctggccaacatggtgaaaccctgtctctactaaatatacaaaaattagccgggcatggtggtgcatgcctgtagtcccagctacgtgggaggctgaggcaggagaatcacttgagctcggaaggagaaggttgcagtgagccaagatcatgccactgcactccagcatgggcaacagagtgagactctgactcgaaataataataatagtaataataataataataccaaatgagagagaaataattctgaactcttgttgaaaatcagttcatgggagtacagcatacaaagttggttttatttttataaaaacattttgtgtgtgcatagagcaatgctcaatccctgaagaataacagaaagaataaaaggggaatttttatattttactctagacttttctatttttggttttgtttgtacagtcattgtgtcctgctttaaaagccaataaattatgttttaatcagttaactggatagcagcacatattatattgtcttaccatgtatgatgcacaatattctgggtacactcagagcacccccataataagttgctaatgacatgggtccctaccccagagtaacttggggtgagtgatatgaagaccctgcctccccacccactccccaccctgccccagtgtaagctattattgaacttgtttctttgttaattagaactagctctgaaatcttgttaattttttttgttgttttttttgtttgtttgtttgtttttagacagtattgctcttttgcccaggctggagtgcagtggcccaatctcggctcattacaacctctgccccctgggttgaagcaattctcctgcctcagcttcccgagtagctgggattacaggtgcctgccaccacacctgactaatttttgtatttttaggcgagacagggtttccccctgttggccaggctggtctcgaactcctgacctcaggtgatccacccaccttggcctcctaaagtgctaggattacaggcgtgagccaccgtgcctggccaaaatcttgttaattcttatgaccaagacgcagtcatagttactaattcatattcacacaatatcaccacaacatggacatttcaactagattttcttccaccttcctaaattgaggacagacttgaggccaaaatcagcaatttgggattatatcaccactcttttttaatgttgtgggaagcagtttattttcatggtatgcggcttttttcacatggctaaattccagcctgtgtctgcttggatggggacatgtgttcaatctgcccttgaggagctccaggcctaaagctggaaccccacggttgccctggatcagctgaggtggttactagagaggctgagtgtgtaaaggcttggccaggatggtaaagctgcgtttgtcattgtgcctacaagctgagtacagtgtcagatatcagagatggagaccacagcaaagagctgataaagtatagtcaaggaggccgggaacggtgcctcacacctgtaatcccagtactttgggaggccgaggcgggcggatcatttgaggtcaggagtacaagaccagcctggtcaacatggtgaaaacccgtatctactgaaaatagaaaaattagctgagcgtggtggtgcatgcctgtaatcctagctacaggggaggctgaggcaggagaattgcttgaacccgggagatggaggttgcagtaagccaagattgcaccactacactccaacatggagtgtagagacagaatgagacttcatctcaaaaaaaaaaagtatagtcaaggaatatggtgttatgaatatttgctgagggcatcatgtgactatcgtttaaaatacagtcatgtatacgtacaatagaattagatagtttctgtgccagaattcttatttattgtgagatatatcaaatttttacttggtgattcagaatttaaactatatcactacctgtacagtttattcaaaaaataaatatttaagttataaatttattagttatttataacttaatctttataagcaaatattatttataacttaagccacataccgtgaaaataaactactcacaacatcaaaaaggataataaatattattgataacttatcgaataggtaattgctgcatattgatttccatttccccttgtgcggtgtgtctccaatagatgtaatatcaccagtgactgtgggaactttgcaatttgctaaaaataactgatgaagcttattagttcttattttctttgtttatcataattttagaatataatttagttgaaagacatatttagcaaatatgaattgagtgcctactgggtcaggcactcttccgggtgcagtgaatggggcagtgatgagacacatggagtccctgctcccatggagcttacattctattgaagccaacagacagtgaccagatcaacaagtaaatgtatgataaaatgccaggaagtggtaagaaccatgaagaaaggtaaagcagagtggtggggcagggacaactgaagagctcttttaggtaaggtgagtttctttccagtgactggccatctaaatgtgactgggttacaaaatttgggagatttgcaagcatagctttgtaaaaccttctttgatcagtttggtgcagtttcaggtgaacgctattttttatttcaatttgcttaaatgcttttaagttttgtgctgtttcaagcttcaggaagtggcccagttcaaagaaagatgctaagaattttaccttgttttgtgtgacaacagaatgaaggcacataattacaccgactatcccttacccctgccaaacctttagtggcccaaattggtttaaaatttagcacaaaaccggccgggcacggttgctcacgcccgtaatcccagcactttgggaggccgagatgggtggatcacgaggtcaggagattaagaccatcctggctaacacggtgaaaccccgtctctactgaaaataaaaaaaattagccgggcgcggtggtgggcgcctttagtcccaggtactccggaggctgaggcaggagaatggcgtgaacccggaaggcggagcttgcagtgagccgagattgcgccactgcagtccatcctgggcagcagagcgagactccgtctcaaaaaaaaaaaaaaattagcacaaaactgcattgttatcagaagatgttcccatgtcttaagaaaaaccttgcagtattaaggtggcagcttgattacacaaataataaatcatgtcttccttaataacaaagacctgttgtttatccttatagagaccaaattaacacgtttatttcgggaaaacgttgctcttaagagcttctgcctgcctgtgctatgtacaccaggggcatgatgtgaagcgtgtcaattaaagaaagacagggaagggttttagcaaagacattagaatttaaacaaccaaggagattttctttcagctatcacattgagcaggtatatattcaatttaatatattgatattactcaaaacaagtttggaattcctcttttagaattgtctttggagctactttacaagacaaactaaaacgttaggttgattattagtgctttcctttgccaacttggcgcttcctgctcagtgtatgtcaatagattagaactatttcttacccttgagacgccaacactgttgtgaggagaccgatgagacatagaactggaagtgcttaggtatctatgaaccaaacaagttagaaggtccaggagggaagtgccacttggtgatgtaggggaggctccaagggtgatgatatttgggctgggatgtttgaagaacaggttcaagtttgctaggcagagggaaatgtgagtctctaactttgtagctaaacattattattttcaaaactaagatagctttactcagttcgataacttgccttattcatcagacttagaccagaatgatcttgactaatttaaaaaaatttgtggaacacagatattttataccatttaatttcataaatatttattgagttcctaattatgggtaatatactcagctactacgtcaggtagccttgcggaattcaagagtctttccccatcttttaatttttgtattaaggtgagattcgcatgacataaaattaactattttgaagtgtccaattcagtggcattcagtacattcacaatgttgtacaaccaccacttcctttttttttttttgagaagaagtctcgctctgtcacccaggctggaatgcagtggcacgatctcggctcactgcaacctccgcctcccaggttcaagcgattctcctgcctcagcctctctagtagctgggactacaggctcgtaccgccacgcccagctaattttttgtatttttagtagagatggagtttcactatgttagccaggttggtctcgatctcctgaccttgtgatccgcccacctcggcctcccaaagtacaaccaccacttctatctggttccaaagccttttcatctacctcaagaaaaccctatacccattgtgcagtcatgactattgtccccctcccccagactcttgcaaacaccagtctgctttctatctctattgatttacctatttgggatatttcttataaatggaatcataaaatatgttaccttttgtgtctggcttttcaaattgaacctaatgttttcaaggttcatccaggttgtagcaggttatcaatacttcattcctttgtatggctgaataatattccattctatggatgtaccacgttttgtttctctattcatttgctaaagtacattgggttttccccaccatttagctatcatgaatagtgctgctatgaatgtttgtgtacatgcatttgtctgcattagtttcctattgttgctgtaacaaattgccacaaactttgtgactgaaggcagcatatatttattacctgacagttctggaagtcagaagtctagcagtctagtgtcagcagggctgcattccttctggaggcactgggggagaatctgtttccttgcctttaccgacttgttagaggctgctggcattccctagcctgtggtcccttctcctaggttctaagccatcagagtagcatcttctcatctcagacctctgctcctgtctttgcaccttctccctctgactctggcccttcgcctccctcttataaggacccttgtgattacattaggcccatccagataatccagggtaatagcctcatctcagaatccttaatttaatcatgtctgcaaagttccttttgccatataaggtaccatttataggctctagggattaggaggtagatatctcagggcagggaggggctgaaggtgggggaagagggagatcattgtttaccctacccatggtctttctcacttgagcaaagtctgatttctttagcagtgctggtcacaatcctcactaggctaatattttcattattcagtttactttctggccaatgggaaagaagatgaatgtttaaatgcaggagatatatatatatatatatatatatatatatatatatatatatatatatatatatactgcaaatccttgagggcagagatggccttattcaactcttgatctccagtacctaatagagttcaagtcacatgttcagtaagtacagaagataatggtggtgagttatatcctgaaatgagggagggtatcattttatagttttcttaaagatgtccatagaaataataagattctgtaactccaaatacaaatacagatctattatatgaaaatcatattggtcatatgccctctccctaagcatcttctggagggggaaagagatagacatctaaccacgtctgctgagggggacagaattttaccatctgagaaagagcagaacatatttttggcactcagtctaaatttttcctttcagtggtatttttaaaaccacgtgaagtttcagcatttgaattattatcaagctccacattggacaaggaattagctaaatattaaattaggtaatttgggctttattccaaactaaccagtacctcacggtgatggagaaatacagtttggcatcctaatggtacctctacaaaatgtccttgagtattgcgatggaagctcatacaaattagtgagaactgtgggtgtgagtaggttgaagattttactagccactttatggagtatgagtatgctccaccgtgtaggtggcccttagcttgaaatattgtgtcacggtacataagtactgtggagttgtttacatgttgagtgtgctgccaagaggaggaaaaaattccaaggagatgcgtattgagagggagcccaaaacagagcagtgcgctcttccatgatgagaatgtcaagccctgagataatgaaattcaaatgaaaggagcggtcagggtgctgctcagcttcgtttggagtgttctgtgtcgtgtgttattcattgctgggaacaacctgtaaaatgtgccatctgcaacatgtggcatcatagccttcgtgagtgagcagatgatgtgatccaagctgccctctgaaaagcaatcaacagtattacagctcttctgttttcatcttcttgtggttcacagttctattaaggtaatctctgtgacaagaagaagatgaaaatcttggatacatgaccaaaataactttaatagtgggatttgagtcattcttaatattataagtcattatatttcataattataattcataatattaagataaatgtttataaatattatttgaatgaagatcaaaaaattaaaagactttatttactatcatttaaaatattttcttgttttgtatgaatgcaaacattgaggaaacaaagtatgtctagaaagctatagtaaggcatattccttctggctacctttagaggaaatttaagaaataatgttaatataccaaatgtttgacttgatgacatgtttaaattaaatacaattgtagaatctctataactacctaccagttttatccaaattgtattattaatctgaaacctccatgccttaattatagctcaaaaacaaattaaaagtgttgtgataactgttattgactcagtaaacaactatcattaatccttcatagggtcgttgcaggattaaatgagttaacctttcaaagccccattcctgacacattatttataaaatgaataaaaatcatggtaatgaattcactcatccaacacgcttggcaaggcaaagtaaattcctttgtttaattgaaactgaacagagcaggtctacatcatacgtaattcacatgttatggtacaatgccatttatactggaaaattgaaactaataagtgaaaataagtagtgatggaactaagccagaaatacactggtatggatcagcctttggagcagggaaagaactgagatggttcacattggagagaactcttgaactccaagtctttctcacaaaaagtcattcctaggtcttcttaataaccagtgcttcatgcaagtcatgtatttaatggctgctcgaagtgacacaaactgtagcaacaagttatgccacaaatcctttcttctctcccttcttcaataccagccttccttgttggaaggtacaaagcaaggaattaaatacttaacacaaacactgaatgcccacagcagcattttataagaggagttttatgtagtatctaacatgccatatgttacatcatttcaagaagatttaaccttctagtagaaagcattcttttttatttttatttattcatttgttttttagagacagggtctcactctgttgcccaggctggagtgcagtggtataatcatagctcactgcagcctcaacctcctgggctcaagcgatcctcctgcctcagcctccctagtagctaggaccacaggtgcagaccaccacccctggctaatttaaaaaaaattttttttagagatagggtctcactgtgctgcccagtctggtcttaaactcatggcctcagacaatcctccttcctcggcctcctaaagtgttgggattagacgcctgagccactgagcctggccaggcaagctttttttagcctgcttcctggctccatctgcagagcttgtgtgcttccgtgcctatggtacacccagttactttgtattaaattgaatggaagactttctcacactaatagggaaaagacaaggccataaattcagctgaattcttaaccgataatgtccagcttcattttcaaaccccacaaacgaggtctcattgacaaagttcagtctgcagtctggtcctgggaaccctgtgcacattctaggagtgagacaattttagaaatgttgagcttctcgtaaagtggacacactctagaaaacatcattaagagacaagcagagtagaaagagacaaaaatgatggaaaccctaagattctgtctttatttggcagtcccttttttgatcaaatttgttccatttctagggctatgactatatctgttatagtaccatgccatttatgctggaaaattgaaactaatacatgaaagtaagtagtgatggggctaagccagaaatgcactgttatggatcagcccttggaacagggaaaagaacaaagatggttcacctcccaacctggccccctgcccctccctggccctgactctaagcagatggtcaatttgcattgttccagaagtagagaagcaggagtacatcaactacaaggagagcctcaagctgccttttttgttttccctatctcgagcactgcctcaaactcacctagggaaggctgctgctttgaggtccacatgatattgttctttagactgcttctatttggggaagaataagaatatttttaatattctatcttgtattttacctaagtatgtatgttattttaaagaaactatttagatacccccgccaccaatttattaaaataggctagaatttgcaaataaaggcaaataaatgtgtttgactttttaaaagttaatgaactttgttttttagaggagttttaggtttacagcaacataaagagcaaagtacaatgaattctcacaggtgtcaggggatgtctccccccgactatggacatccaccactagaatggtggatgatttgttagaatcaatgaaactacattgactcatcattatcacctaaagcccaacattagggttcactcttggtgttgtacattttatggattttgacaacgtataatgacatacattcactgatacagtgttatatacagcagtagttatatacagtagtttttctgatctaaaaaatcctctgtgccccacctattcatcccttttcccccctaaatcctggcaaccactgacctttttactgtctccatagttttgcctttttcagaacatcatatagttggaatcatatggtatataaccttttcagattggctcctttcacttagtagtatgcacttaaggttcctccatgtcttttcacgtcttgatagctcatttctttttagcacagaataatattccactgtctggacataccacattttatttatccattcacccactgaaggacatcttggttactttcaagttttgtcaattatgaatgaagctgctataaacatctgtgtgcagggctttttgctgacataatctttcagccgatttggttaaataccaaggcgtgcaattgctgaatcatagggtgagagtatatttagttttataagaaactgctaaactgtcttccaaagtggctgtaccattttgcattcccatcagcaaagaatgagagttcctgttgctccacgtctctaccaggatttggtgttgtcaatgttctggattttgaccattctcaaagatgagtagtggcatcttgttgcttcaatttgcaattccctatcggcatatgatgctgaacatcttttcatatgctcacttgccttttccacctgtatatcttctttggtgaggtcttcctttttagtgaggacctctttagagagaccttctgttcaggtcttttgtccatttttaaattggattcttcattcccttattgttgtgcttgaagagtttatattttgggtaaccatcatttatcagatatgtcttctgcaagtagtttttcccagtctgtggcttgtcttctcattatcttgacattgtctttcagagagtagaagttgttaattttaatgaagtcaagcatattaattatttatttcatggatcatgcctttggtgtagtatctaaaaagtcattgccatactgaaggtcacctagattttctcctacgttatcttctgggaattctgtagttttgtactttatatttagatccataatcgattttgatattttataaaggtctctgtctagattcattttttcgcatttagatgtccagttaccttttgaagatgaactttgtaagatgaactatagatttaagatgaaagtaaaaacggtcctcgtttagaagccaatattttacttaacaaggcagtatcataaaatgactatgataattatattttatcctacttttacaaaatactagtcagtgcaggtatgcctactgacatcatttttactgtactacggcaggtcttccaacagggaagtaaaataatctcatgtagaaaatggcctagaaaatgttaagctctgagtcccatgttggccttttgcagtgtgataactttcagaacaagatttctttttccttttgcagctaatccaacaataaaaatataattatggaattgcaacctctttgggagaaggtcctaatatatgttctaagttctcttctggaaagttacatcttaagaatgtaccgttcctttcaaaggctataattaaacaatatgttttcctgctgcctgatcttgccagaataggaacacttagtccttttcatttaataagagagcagttttgctaaaaatgaaacttaattttaaaaattttgatatgtgccattgtatatatttgaagatggtatttatatcctcagaggttattgaagaagaggtcatctgattttaaacagaggtcttggtgccagctgtgccttgtgctactgatcagtttgtgttcattgtaccataagtgtttacaacaaaggagtctgatagtgaggatgagccagttagatgatttatctctggtttattccattggagaatgaggcttggattcatgccaagatgataaaagacaatagtatctgtgttataaggtgtcaggctgatgactttgtagttgggcatatgcagatagcttcaggcagatcttgggtaatttgcataccacaaatatttgctcaccgtctatggctagcaaatgaaacaaataccacagcaaatataaaacctggccttgccttcatgggatctcatagccacaaattagtggggcgtcacaaatttaaaaatcagcaccaatattttaaatcattttctcattttttttttagaaaggaaagactaatttagatagcctgaggaactgaagtaatttctacgcacagaacatgtatctactctaagaaaaatgaactttcttagggtcactattatcattaagatggtgcacaaatatattcaaaagcatgacatttatcctctccacattcttgttctctgcagatggcatgtgttactttatctccattagtatatcttttctttttaaaacccaaattagattatacatattgttacatcacaataatttttcacttaacagtatccattggatatctatccatattgatatacatggatattttaaatactattccattatttgcatgtactcaaatgcatttaactagttcatattgacggagcatttaggatgtgtgtgtgtgtgtgtgtgtgtgtgtgtgtgtgttttctgttacaaaaatgccacataaagcacacatttcagaaatcttcagttacttaaataaatgtaggacaaactcttcaaagttggaattgtgggatcaaaagtacgtagctttaaaatcttgatagatactgccgagttttccttctaaatgtttctaactatttatactcccacagtcagtgtatgagagtgcctctgtttcccaccaacctcagcaacaattaatattagcaggcctataaatctttggcaacccaataggtgaaaaatcatttctaattattgttttaatttgttttgtctagtgccagtcgtatgtacttcttttctgtgaccaactcttcattcttagcttttccccattttactttaaggtcgtcttgttgatttataatggctctttatattagggatattatgcctttatcatgaatgacacaaatgcaggccttttttatttgtatgtaaataagaaagcttttcatctttataagctttttatttaaggcttctagattttgtatcccatttagaaaagctctccccttcctaatttattttttcaaaactggaccaggtgtggtggctcatgcctgtaattccagcactttgagaggccgaggtgggcagatcacttgaggccaggagttcgaggccagcctggccaacatggcaaaaccttgtctctactaaaagtaaaaaactaaaaaattagccaggcatggtggtacacacctgtagtcccagctagtcaggaggctgaggcaggagaatctttgaacccaagaggcagaggttgcagtgagctgagattgtgccactgcactccagcctgggtgacagagtcagacctgtctcagaaaaaaaaaaaaaaattaaaccatgctttcctctgctgcctttatggtttctttttgttatatgcatgaaaggttatatatattttattatatatgaaatgtatttttacataaggggtgaggttgggatccccatttattttctttgccaatgcgcttctacacatcattcattaattttctgattcatttgaagtatcacctttgttacatattattttccatacacgttgagacctatttctgaatgctttatatcagtgtttttcaaagagtagccaataaatcacttaaggttgtctgcagtctatcaggcagtctataggcagttggattccaagaaaaatgttattaaactatttgattcacaaatttaaaatagaagataaattattactttcacagaaattccatgctttcttaattattttcatgcctttaaacattgcccatgcattagctcatcttgggtagcatatatttaacaggatagattttgccatgaacaatgaattttcaggtcatttgtatattattgttttcattatgaagtttgcttcttatttctgttgggctatgatacatacccaactcaccaaacaagatgaatggcttcaaagtcattcattaaagcataaatgtcgagtccttttggttgtctcatatcttagtacctttctcatgtagatgaatataattctagctgaaagtggaatagatcttccctctgccatctcctggccatcagcccttgggcacatggccacatggccctaggtgtcaccattagatgctctcaatccagattctcaacacgagggttgccataaaggtacaggcctgaagagatttgccatggtggccttcagtggtagggatggagtgtccaggggttgcatagtttggcagcgtgactaaccgggggtggtgcaaatggtggtgtgctaagcatgtggttcttctgagggatccttgctgtgccttgctcccttgtttttgctctaacctcaattccatgagccactcaatatccttccaaataattttttttctaagttaaccattcttttgtttttctaagttaaccattcttttgttgtttgaaaaaaaaaagaaaggaagaaaaggaaggaaggaaggaaggaaaaaaggatgaaggaaagtaaagagcacaggaaacgtaacaatgatatttagtttttcttggactggtagcttatctattcctagtcctcaatatgttctcagtaagactttgcgaaattgaagtatattcattttctatgttgcataacaaattatcacaaatttagcagcttaacacaacacatattaactatgtcacagcttgtatgggtcaggagttcaggcacaacttagctgggtcttctgcaaggctacactttaggtgttgggcaggacacagtcctcatgtggaggcttgactggggaaaagggactggtcccatgttagcagagtcagttctttgcagctgcagcactcatggcagcttgcttcttcaaagccagcaaggagagcaaggctctaatgcaaatctgctgtagcaatgggagtcttttataacataatacaatcacaggagaaacatcccttcgcctttggcaaacgtgataacatagtcatgggagtgacatcccgtcacctttgctatgttctagttgttagaaacaagacacaggtcccacccatacttaaagggagaggattacacaaaggcttgaacaccaggaggcagtgatcatggggggatcatctaagtgtcagtccaccacaaagctttcatgtcaatttcaaacaaaagcaatagcatttctggtaaaaacaatctaatgattccagagcaaggttacaataatatttttagtgtgtagttgatgaattatttcagtaaatatagacagaaaccacaaatactaaggtcttccttgtagcaaatagagacttaagttatagtattgctgagagcttgattggcagttacaaattcagtgatcgctatggcttaaaaagaagcagaggaatgccaggtgcagtggctcatgcctatcatcccagcactttgggaagccaaggtgggaggatcactttaggccaggagtttgaaaccagcctgggcaacatagcaagaccccgtctatacaaaaataataattaaaagattagctgggcatggtggtgcatgcccatagtcccagctactcaggaggctgagatgggaggattgcttgagcccaggagttcaaggctgcagtgactatgatcataccactgcactccagcctgggccacagagcaagaccttgtctcaaaaaaaaaaaaaagtattacacacacacacatacacacacacacacacacacacacccagctatccaagttttgagctaatttttcattttatattaagcattaaacaccccaaatgtatatttgcttaagaaaaaatgctaaatacatacttttaaaaaagggcagtgaagttagaagatgaatgttagcaggcagattcatcatacttttccttcaaatattttaagaatagtaaatccacagacaatgcttcttgcatatagggaagtacatgtgtcttgtccattgctctttctagcaatatagataaattcctttgttctactctgtcaattttcctgcccaattgcatatttgtccttaataatcagtagtttacaaaatttattctgtctaaaaattgtaatttagagtgttcgtagcttccccaaaactatgaatgacattatctccttaatgatcattttctctttgcccagttgtcaggcaataaaattattcagtgtagcatcaaaagcctcagccaagggctgataaagtcagatgaatctacatacttatgcataattttttaacagtgtccaatattcttctgaattatttttgaatcattacatctttctgctttcatgagccaccaatgacatgcttcataaaatgacaattgctgcaaagtacctgaagtacagtctgtctttccaaaacaaattaatggtaagatatacctatagcaatgtaatgttgtaaaacaaatgtaacagaactttatatagtgatttaatctttaaatcacgttgggagttagtgtttatgccatcaaggctatcattgctcaaaacatttcaaaaattactaagtgaaagcatattcagagccattttataagtgacacaagcaaaataattcttatttttaattcacacttttgttttctgcttatgtagatcacctatttttacttttggcatctagatgacatttggcccattcaaaaagaattaattgtgctggggaaaagtctttaggtttgggagtgagaaagcctgattatagcgggagggattactaactctccctttgatgatggattagcataccccatcatgagtaaggatagcgatggtttgagcaagacagttgacaagcttgatgtaattgatcaagaactctgcacacaacaagtagatattcattcctcttaggcaaatatgaaacatacacaaatattgactatttacacagtcacaaaagaagttttaagaaccactgaagggtgatttgatttgcattacattttctcactgtagtgcaatgaaattagaagtcaacataactactctaaagataatgtgttctggttcctagcctccagaagctggaggaagcaaggaataacaacttgttattaatagagtcatgtgctacataatgatgtttctgccaacagtgggccacatatatgatggtaattctgtgtaactgtaatagagttgaagaattcctataacctagtgatgtcacagttgttgtgctgtcatagtgcaaatgctttactcacaagtttgtgctgatgctggtgtaaacaaacctactgcactgccagttgtatataagtgtagcacatataattatgtacagtgcataatgcttgataatgacaacaaatgtctatgttaccggtttgtggatttactatacttttaatcaccattttagagtgtactgcttctacttactgttttttaaaaggtcactgtaaaacagcctcagtcagttcctccagaaggtattccagaagaagacacaaaagatggatagatgagcaaagttaaccaggtcactcagtcaaatagaatagaataacgttctcaaacaaaagacttacagagagacataaggagagcaacttgctatctagctagatgcgtttatggaagtgcagagatggaggagaagtgagccaggagacgaggctggaaggtgaagcagacctcacagaaccagtcaatgcctacaaaaggtcaatgggttttgtattcctcttgattgagcctcagaacaaacattttccctttctgttttctgtcaactaatttagtgctattaatacattaataaactactacttaatctgaaaaatgctaaaagtattttttcaaatacaagggacattctcaagcaattgtgtagtggactgcatagtggctcctcaaaagatatgtctatgtcctaacttccagaacctgtgaacgtgactttatttgaaaaaaagacctttacaggtgtaattaagttaaggatcttaagatgagatactcctggatgacccaggtgggccctaaatccagtaagtttccttatgagagacagaagaggagaaaatagacacacagaagagaaggcatgtgtcttagtctgttttatgcttctgtaacagaatatctgagacagggtaatttataatgaatgagaatgtatttctcatagttctggaggttggtggtccacgatcaaggtgctggcatctgctgagggcattcttcatgactcagggaggcaggtgtcacatggcagaagggcaaagagagagcaagagggggttcaaacttgccattttatcgcaacattaatcccaccctttgcagtggagacctcatggcttaatcatgatttaaaggtcccacctcttaatactgtgataatggcaatgaagtttcaacatgaagtttttagaggacaaacattcaaaccatagcagcatgtgaagatggaggcagagattggaatggtatagccataagtcaaggaatgcctggagcttccagaagctggaggaggaaaggaaggattctcctccagtgccttgagaacgagcactgccctgccaattcctgacttcttaccttcagatctgtgaaataatacatttctgttgttgatttgtttgtttgtttgtgtgtttgttgttgttgtttttgagacagagtttcgctcttgttacccaggctggagtacaatggcatgatctcggctaaccacaacctccgcctcccaggttcaagcgattctcctgcctcagcctcctgagtagctgggattacaggcatgcaccaccctgcccagctaattttgtattttgaatagagacggggtttctccatgttggtcaggctggtcttgaactcccaacctcaggtgatccactggcctcagcctccgaaagtgctgggattacaggtatgagccaccgcacccagccaaatttctgttgttttaagtcaccaagcttgtggtaatttgtcatgacagccacaagaagcaaatacaagcagctgagatgaaatggagttctatatacattttttctcttgtgacactaaagaatgcctagatatttatgcatctaactaggtaatcgtgtttgtcccactcatgcatggccaacagctacatagaggtgaattatatatagctcctctgcagttaagtacactgtagcgcctctttaataataccagatccttgattcagaatgtcctttccattccacatactatagtcccaaaccctagatgaggtcaggatacactggccttatactgacactgttgtaaaatgcataggaatttaatcaatgtcctattattattatttgtaatttcctcttggtcttggaatgtcctacagtttttgaagatccagcttctgtaccacattgttattagggagaaattatttattgtctgcatcgcaagcaggcttgctttggaagcacttcgcgaacctaaaaaatgtgatctgttgaccagaacaatgaacaactatggtaatataagtaagcaaaattcacaaataaacacctcattgtgtcaaagatttgcaccttcttatcttcagagctcttagaagaactgcagtcagatgtagtggtttgggcatggcttgtttgattgtgttatggattgagccgtgtccctacagccttgcatgttgaagtcctaacccgtagtacctcagaacatgaccttatttggaatagggttgttgcagatgtaattggtttagtttggatgaggtcattagggtaggctctaatccagtatgactggtgttcttataaaaagagggaatttggacacagagatacccacacagggagaacactatgtgaagatgaagacagagattgggtgatgcttctacaaacctaggaatgtcaaagtttgccagcaaaccatcagaaactaggagagggacatggaacagattctccctcacagcccattccaccaatgctcttgtcttgggacttctagtctatggcactgtgagacaatacatttatgttctttaagccacccagtttatggtactttgttacagtaaccctagcatactaatagtttggctattccctattaatttgcttggaagttgttcatgagtactaagatagctcatgaaaatacaaagcaaaagactgtatttaaattatatttcaggtagtttcattgtaaattattttggaattaactatactaaaaagattttatagtgcatatataataatgaattgagtacatcattattttacagagacatcattggtgaggctatttatccaaattattgtttaaatgggtcttttttttgcaaaaaatatttcataaataatctatcccctgactacttgattggcttcagaagtgttttgatatagacatcgtctcaaaccaaatttaacgtcccttctagttggagaatttttagtggttcgatttagaaatattttcttaaaaatccacagatggggtcatactatgcacaagttacttctgaaaattggttagtttatagtccaaaagtaattaatatttgcatttaattcagtttggaattcagtaaattttagtaacattcctttgtgaagtcaagtcactggttataacaatgttttaaccatcagttgtttataatgcattgtttcatctatatataagtcatgggcattgaggaaggaaaatgtaccttcagtgaactttgaaatttagttcctcaaaggagggctattactagaagtgaacagaagtaaaacaaaataataactaagtatacagctcataaatgttcagatctagataattatgtttaatttctgcttttgcttaccatttaagatcaaacctctaggtatcttttaatctagctctttagattgttaaaatgttttatgtgaaatgcacatttagtttataagcagcaatttagtgtcctgtttccatgagacattgatattaaataaaacactagaaagaagtaatctaacttttttctcctttgtacaagcccctctttgcacctcatgtgatgttgcttactggatatcaaaaaagattagaagcagggtgatttcagatcaaagaagaagcatctgcctacccccagggtttttaaatatttaaatatttttctcgttaaaaaagtaactcaacagaactctaaataaaatacaattttaaggaaccaatgtatagtcattttaagctattgccagcaaaccaccagaagcgaggtgaaaggcaagctattatataatcacactttttccattgtattgaaagttaaattcagcttatttgccaaagaatgcttcaaatacactgaaattttacataatagtacaggctaaggcgggtggaacacaaggtcaggagatcgagaccatcctggctaacacggtgaaaccccatctctactaaaaatacaaaagaatgagccgggcatggtggcgggcgcttgtagtcccagctactcaggaggctgaggcaggagaatggggtgaacccgggaggcggagcttgcagtgagccgagatcgcaccactgcactgcagcctaggtgacagagtgggactccatctcaaaaaaaaaaaaaaaaaagtacagttatgaacctgtattattatatcacagttagactcaaatgactcttaatgacatttatttggactcatgtatattttaggctttttttttagcataattcattgactctaagatgtaatacttttcacattttatcagctttaaagtcaggatatgtattataatcaatggtttcttacaaatataattggcaaccatgttttgtttttcttagtggtatgtaaaacaatggtgtatcttaaaatcaatcatggcatcttagggtttgttttttttttttgccttttaagtaatgtttatttttcatttgcttgttttttctgttttttgatatttttaattttatgtctgtaggctattggggaacaggtggtgtttggttacatgagtaagttctttagtggtgatttgtgaaattttggtgcacccatcacctgagcagtatacactgcaccccatttgtagtcttttatccctcacccccttcccacccaccctgagtccccaaagtcaattgtgtcattcttatgcctttgcatcttcataagttagttcccacttatgagtgagaacatacaactatggaaaacagtgtggagattccttaaagaactaaaagtagatctactatttgatccagcaacccactactgggcatctacccagaggaaaagaagtcgttatacaaaaaagatacttgcacacagatgtttataacaacacaattcacaattccagaaatatggagccagcccaaatgcccatcaatcaacgagtggaaaagaaactgtaatatatatatatatgaatatatatgaatatatatagatgatggaatactactcagccatgaaaaggagtgagttaatggcattcgcagtgacctggttgagtttggagactattattctaagtgaagtaactcaggaatgaaatgaaacatcatatgttatttggtttttataacaggagatatagcttgtttatttcaagccacactcagtgttggaaaatgctgtttcttattctgtaggtccagcattcccaagctaaaagaaagttgtgtggcgctaaagtgtttggcaaggttgtattattgataggtgaattgctcataggaagagaaaaatttaagtgactatattaagaatgttctggtatttatagttctctgtcttttccattcttgagaatgtaatgttctttgtgttactctttaaagcaatggagaataaataaattgtttagtaagtcatgttgacattattccttaaaaaattgaaagagactgtatgtcccttcctcatagaatacacaaaactaaattacagctgaattaaagatttacatctaaaagcacttaaaagtaccagaagaaaatattttttaaagtgtgtattcgtatcactagagtgtggaagtcattccataatatgacactaatatcaaaatttataaagaaatgattgaaaggattgattacctcaaaatatataacaatagtctatcagaaaagatgaagcatagatttaaaaaaactggagaagaataattatgcagagataaacgtgtcagaaacaatagaatactttttttaatattttacatcaaaatgtatattctccagtccttaaacaggcattcaatgagcatctcttatgtctgaggtcataggctgggtacaagagaggtataaattaggctcaaatggggcccacaaagagccccaaatctagggttttattttcattgttagagtgtctatgtctatgtcagtaattgggattatttttaaactgaaaaactctatcccactttaaaactcctaaatagaacaagcatttatctaaccttaatatcatagcataactccttaaagtttattgactttaaaataactaaattcagtagctctcaaatatccatagtatgagtgacagacctgtaaaatctaattgactttatttggcagacacaggcaaacacatacatgtattttaacataatatgatgactacttagacataacctgatccttcaaatataactgaaaaaaaggtgctccattttgcatgatttattattgaactagagttccctttcctaggtacatggagcaaatagagaagataattagaattccacttttcttgaaatgtcaagaagggcaggtgtactctgacctcagctttaagtttaaccaaatatatagggggatttgagactgctccacatgtttctcatggaatttcccccaagcactactctctgaagagcctgaaaaagtatgtaagaaaagccttgttctctcttgacatgaagttatgctcagcctgcttattatgctagagcttagtgtctgaatagcagagaacgttttctcatccttagttatgtttgttgttctaacataacagtcttctgatcacgatgattctctataatcaacatttcttaagtgcccagtgaggtaagccttgcttctaaagaattttaaaatgtatttttagcaaggctctaaagattaagtcttcaccttgctgtcagcagttacatttttttctaaggggtaaaaagcacaaaccagaattatgctagatctccattaagatataaaacattttatggtgccgggttgctgttgacctacattgataattggaaatattacaacttattgcaaaggtactaagtattatctattataatatgtgttttgcatccctttctgtgatgtagataatattagtcctattttgcagatgaggaaaccaagactctgaaagctaaaaagcttgctaaagtcacgtggctaatgagtaataacaagattcaaaatcaaaacaacctgaccctgaaaccctcctgttaaccagtgaccttttctcctctcaaaattctgcagtaaatggaaaccatttcacatgtgtttattcattcacacctacagtgtgccagctcccagtgtagtctaggtatactatccatggtgaagaggacagcctaggtcgttgccctcatgggcttgcattccattgagacagatacatttctcagtgcttaatttagttaagtgagatgggggcgggaaagaagagaaaatagagagacagagaatcatggggttttgactttacgcgggagtcagggaaggcctccgtgaggatttgttagctgaaaggaaaccttggttgaagtgagggaggaggaaaccttgcagatatcttgggagaagagcacctgtacagaaagaacagcaagtgcacagccccctgtgctgggaataggcttgtgtctgagaaccacaaaaaaagccagtgtggctggaaagggcaggtaagggagagcataaggggaaatgggcacagagctagccacagccaactcagggaggcgttgtaggccctggtaaggatttaggactttcttttgacttctgtgataagaaaccagtgaagggttgggcttggggaagttgcccctggctgtgtggccgcagtggaaataagggaagcaggtaggatcctgccgtgacccgagagagatgtatggctgcgacagagccacaacagttgggaactggtgggtgatgacatttggggtctgttttgagaattcaggggatttatcatctcgttggtggcaggaacaaaactcatagcagcatagtgcaagaatacagacagcatcctgttaaggaccgcagtgttttctgcaacttcttccatgtgtctactgcaaattgtctgagaagggcagggcctaggaaacatggtggaagttttgagataaaaatattgcagcccatctgcatttccctgggagctcaattagtcatcactttgccttattatttactaagcgttcatcatagttctaaatagattcctcaaaagaattaaattcaaagggcaaaggggtagaaaatggatctgactgtctctgcactgggagtccctgggagggggggacgaggaggaacagaccaaacaaagcatggctgatagaaagggaagcctgcgatgggtgggttgagtcaggtaagacagagaagcttgctaaggtggagtggaaggaaatcctatcattactgtggctgccctctgaggtaggaaggaatgaagagcccgggaggtttaaagtgctctgaagcactgatactgtaaatgtggcatgctagcataggggaaagtgtaattcagacaggcagactactctgtctgcattcctacaactgcttctcctccccaggatgtgcacgtgtgtgtgtctctgtgtgtgtgtgggcatgtgtctctgtgtgtgtctgtgtatgtctatgtgtatatctgtgtgtatacaagtgtgtgtctgtgtatgtgtccatgtgtgtgtctatgcatatgtgtctatgtatgtttgtgtgtgtgtgtgtgtctgtctgggtctatgtgtatgtctatgtctatgtatgtttgtgtgtgtctgtgtgtctatgtgtatgactgtttctatgtatgtctctgtgtgtctctgtgtgtgtctgtgtgtctatgtgcatgactgtgtgtgtctgcatacactcaaaatgcttctgtggaataaagtcaattagattttgcctttccacatggcttctgtatgacctgtgcttgaccaaccatcaaccaaagcccacggcttttcctctgaaagggatgccacatttttgtgtgtgtctgtttgtaaacagtgacattcaagcacaagggttagggatggagtggataaggagggtgtgaaacagcacaaatcagagaaaatttaagaggtacaagaagaaggttttttgccttggctttaaaatgctggtaaacactaactaattctatgaggccagcatcatcctgataccaaaacctggcagagatacaacaaaaaaagaaaacttcatgccaatatccttaatgaaacaccaatgcaaaaatcctcaacaaaatactggcaaaccaaatccagcagcacatcaaaaagcttattcaccatgattcagtaggcttcatcctcaggatgcaaggttggttcaacatatacaaatcaataaatgtgattcatcacataaacagaactaaagacaaaaaaaccacatgattatctcaatagatgcagaaaaggccttcaataaaattcaacatcgcttcatgttagaaactcttaataaactaggtattgaaggaacataactcaaaataataagcaccatatatgacaaacccacagccaatatcatactgaatgggaaaagctggaagcattcacctgaaaaccagcacaagacaaggatgtcctctctcaccactcctattcaacacagtattggaagttctggtcagggcaatcaggcaagagaaagaaataaagggtatccaaacaggaagaggaagtcaaatatctttgtttgcagatgacatgatcccatatctagaaaactccattgtctcagcccaaaaacttcttaagctgataagcaacttcagcaaagtctcaggatacacaatcaatgtacaaaaattattagcattcctttacatcaacaacaggcaagctgagagccaaatcatgaatgaactaccattcacaatggccacaaaaaaataaaatacctaggaatacagctaacaagggaagtgaaggacctcttcaaggagaactacaaaccactgctcagagaaatcagagatgacaccaaaaaatggaagaacattccatgctcatggataggaaggatcaatatcatggaagtggccatactgctcagagggatttatagattcaatgctatttccattaaactgccatcgacaatcttcacagaattagaaaaatctatgttaaaattcatgtggaaccaaaaaagagcccaaatagccgaggcaatcctaagcaaaaagaacaaagctggaggcatcaccctacccaacttcaaacaaaactacagtaacaaaaatagcatggtactggtgcaagaacagacacataaaccaatggaacagaatagagaagccagaactaagaccacacacctataatcatctgatcttcaacaaacctgacaaaaacaaacaatggggaaaggattccctatttaataaatggtgctgggagaacaggctagccatacgcagaaaattgaaactggagtccttccttacatcttatagaaaaatcaactcaagatggattaaagacttaagtgtaaaacccaaaactataaaaatcctagaagaaagtctaggcaataccatttagaacataggcatgggcaaagatttcatgacgaaaacaccaaaatcaattgcaacaaatgcaaaaattggcaaatggaatctaatcaaactaaagagcttctgaacaacaaaaaaaactgtcatcagaatgaacagacaacctacagaatgggagaaaatgtttgcaatctatccatctgacaaaggtctaatatccagcatctattaatacaaggaacttaaacaaatttaccaaaaaaaacaaacaaccccattaaaaagtgggcaaaggacatgaacagacactttttttaaaaaagatatatatgcagccaacaaacatatgaaaaaaaagctcaacatcactgatcattagaaaaatgcaaaccgaaaccacattgagatgccatctcatgccagtcaggatagctattattaaaaagtcaaaaagcaacagatgctggcaatgttgtggagaaaaaggaacactcttacactcttggtgggagtgtgaattagttcaacctttgtggaagacagtgtggtgattgctcaaagacctaggagcagaaataccattcgacccaacaatctcattactgggtgtatacccaaagaaatgtaaaccattctgttataaagatacatgcatgtgtatgttcattgcaacactatccacaaaagcaaagacatggaatcaacctaaatgcccatcaatgatagactggataaagaaaatgtggtatatatacaccgtggaatactatgcagccataaaaaggaatgagataaagtcctttgcagagacatgatggagctggaagccattatcctcagcaaactaatgcaggaacaaaaatcaaacaccgcatgttctcacttataagtgggagctgaatgatgagaacacatggacacatggcagcgaaacaacacacactggggcctgttagggggtgggagggtgcagggagggagagcgtcaggaagaatagctaatagatgctgggcttaatatctaggtgatggggttgatctgtacagcaaaccaccatggcatacacttacctatgtaacaaacctgcatatcctgcacatgtacccacaaatttaaaataaaaaaatatataatatatatataaaagaaaatgtggatacacagagacaccagacataggcactcacacagaaaaggccatgtgaggacatagagaaaaggcagccacctacaaacccagaagaaaggcctcagaagaaaccaaatcaactgatgccttcatcttggatttctagcctccagcctgagaaattaaagttctgttgtttaagcaaaaaaaaaaaaaaaggccggtaaacactggtgattctgctttatactaaaaatgatggcggtgatgggggaaccgtttactaggtacaaccacaagatatttggtcaaaaaggattgaaagccactacttgctttcatttcttgaaatacatttctttaaatacataccatttcttgaaatacatttattaagcacagatgagtgttgttttggtttttgtttagtgattaagtgtacaatccccaataaaatattttgaagtttttccaaagaaaagaaactctgcctggctgcatcagctagacaaaggtacctgcgctgctgtttgtttgtttgtttgtttgtttgtttttccctgtatctgctggaatattttagctgatggacatttgagctggcattacttaaatgagaatctcttcaaagtgatgcacgctgtgtttttccctgtgagacgtgtgaatgccttgtggatatttgtgagtacacttaagtgtttttgttttccactatgctaggtcagttttcagatcttattaaaaagctcagggtttcgggaatccgactgttctgcaaatgcctgctgctgttgttaagtggcctgtaccatccttgagtaggcaagaagagctgagatttcaccagaaacagtgacattcacacccaggggctgaaataaggcggaatgcccacctggagataagtcttggctgtcacacctggaccgcctgctctggtcatgtgtgtgtgtgatctataatagggtcacagctttatgaaattcagtcactttgtagcagccactctaaggaggatgattcatggtccctgtgcaggcactgcacccagcaccttctcaggaacattcacattatttccagctggattgaggctggaagctccctggcaagcaatagaaaagcaccaggtgttcccagcagcgctctctttcacccttgcaagctgcaactggcaagagaattgtacttgatggcacacggtgtgatggttgcctcactgccagagcatttgttctggatgcctctgtccccaggtgtctcagaagtaatcctaatcattgaactttggccctctggaaacaaggccagtcgcaagacacgtcaggaagcaatttgtgcatcgagactcgagctgctttggagtttccctctggattttagtcaagctgtcacaaagttcatgacttggtttttccactcttgtaaaatgaaggctgctctgactcctgcctgcaatctccagcttattgcctttaatacttccctgttgctattgctaaaccccttaccttatacagactgtggagatgggcaaaggaaaaaaatctccaagctttttgatatggtgctttgaagacacagtttactaatggcctgaaagaattcattgcagcttcccacatgcaaagtttattttcggagagtagtttatatatggaataaatggaatagaattgagtccagaaataaactctcacatttttagaaaattggttgtcaacaaggatgccaagacaattcaatggggaaagaaatgtcttatcagcaaacagtgctagggcaactagatatctatgtgaagaagaataaagtgagaactctaccttacatcatattaaaaaattaactcaagattgatcaaagacctagatgtaagagctaaaactataacaggcttagaagaaaacataggtgtaaattttcatgaccttgaattaggcaattatttctttaaaatatgacactaaaagcacgaaaaacaaaagaaacaataataatttggacatcatcaaactaaaaatgttgtggctcaaaggacaccatctataaagtgaaaagactacccagagaatgggaggaaagttttgtaatgttgtatctgaaaagggaagtatctatatagagaacaattacaatgcaataataaaaagacaaatactccaatgttcaaatgggcaaaggatttgaaaagacatttctccaaagaagatattcagatatctaataaacacatgaaaagatgctcagcatcattaaccatcagggaaatacaaatcaaaaccacaagagaccactttatacccatgggaatgtctataatcagaaagacaggtaataacaagtgtttgcaaggatttggagaaattgatggtggaaatttaaaatgatatagtcactttagaaaacactctggcagttcctcaaacaatcaatcatagagttaccatatgaacagcaattctacttctaggtatatacccaaaaaaatgaaaacatatattcaccagaaacttgtttatgaagtgcagagcagcattattcttaacagcctaaaagtggaaacaacccaaatgttcatcaaactgatgaattcgtaaataaaatatactatatccactcaatagaatattatttgccaattaaaaaaaataaaggctggatactgtggctcacacctgtaatcttggcactttgggagactgaggtgggaggatcactcgaggcctggagttcaagaccagcctgagcaacatagcaagactccatctctacaaaaagtaaaaaattagccaagcatggtggtgcacgcctgtagtcctagtgacttgggaggctgaggttggaggactgcttaagcccaggagttcaaggctgcagtgagcaatgatcatgccaccacactcccgcctaggttgcagagcaagaccttgtctctacaaataaacaaaaactaaatgaagtattgatacatgccacaacatggacgactcttaaaaacatcatgctagccgggcactgtggctcacgcctgtaatcccagcactttgggaggccgaggtgggtggatcacctgaggtcaggagttcaagaccagcctggccaacatggagaaaccccatctctactaaaaataaaaaattagccgggtgtgatggcacatgcctgtaatcccagctacttgggaggatgaggtaggagaattgcttgaacctgggaggcggaggttgcggtgagccgagatcgtgccactgcactccagcctgagcaacaagagtgaaactccgtctcaaaaaaaaaaaaaaaaagaaaaagaaaaaaaagaaaacatcatgctaagtgaaagaaaccaggatgaacgttgtatgattctatttatatgaaatgtccagaataggcaaattcctagagaaagaaagtacattagtggttgtctagggttgggggaattgtggggaacaggaagtgatgctaatgggcatagggtttcttactgggttgatgacaataccataaaattgatggtagtgatggtcacacaactctatgaatatactaaaaaccattccactgtatactttaaattggtgaattgtatgctatgtggattatatttcaataaagaagatatttaaaaatcacaaaatatagatgattagagaatatggaatatgtcattaattatagattttttctgcatttttaatactttctttgacttcacttgctttctcagatgtttcttagaaaacatccaaagcaaagatttacaactctgtacggaagccacagattttgtaagaaaaggctaaagagaaaaagattactgcaatgtagtgtttgcatttatgatttactttctattcacgtttcagacttagttatttactttgcacctattaccacatacttgctattatctctccatacacatgaaagttcttcggaatttttagtaaaatgtcctcagtttctgagtcaaacctgtctactgagaatcaaatatagttttcactaaagttgcttcctacgaattgccatgtgagaaaaagaagaaaacagacgggcagcagatacactattttctcctagttgatggcaaaaattagatctctatcaagatcaaaaaagagttctttattccatgaactaagtttcttatcctaaggtgattaccgggggaaatatttaaaagaagcatcagtggagggaagggtaaatcgtgggataaaatacactcattgactttcttctccaagccaaactgcagaggaaataacaggcgcagagacttctagcagggttgtctggtgggacatgccctgggatatggggtcagtccattcctgtccagaccagggacttcctctgaccttggcaactcagttacctcctgtgagcctaagctttcttgtctgcaaactgagagatctctcaagtctttcctggctgtaacagttacaggggcgtccaatcttttggcttccctgggccacattggaagtagaattgtcttgggccacacataaaatacactaacactaatgatagtggatgagatttttttttaattgcaagaacatctcatagtgttttaagaaagtttacgtatttgttttgggctgcattcaaagccatcctgggctgtgtgtgtcccacaggctgcaggttgggcaagtttggtctatgattttataatctgatctagtattctctgagacatcaatgctagatgaggatacaggtagatgaatgaatattgtagttgagtaaatattacacccggtgtgttgattaatgaatagatgtgatcatagaagaagcaatatcaagatttttcaccagcctctggagttatcactgattagcaaagcattttaattaataactcaaacagaaaaagcatgtctgttagttttgcaatccgcaaaaagatgaacacaatagacatgttaattcccaaacttagtttcaaaaaaactatctgccaggtttcaaatgaacataggcttgattggccacacgaaaatttaaatattatgaatgttgaatggccaaccataagttcaacttgaactaagtttgatgtggctactttttattttttacttttcaaaaattgtggtacacactgcatcttctcactcataagtaggagttgaacaatgagaacacatggatgcagggaggggaacaccacacactggggcctgtttgggggtcgggggcaaggggagggagagcattaagacaaataccgaatgcatgcagggcttaaaacctagatgacgggttgataggtgcagcaaatcaccatggcacatgtaaacctatgtaacaaacttgcacattctgcacatgtatcccagaatttaagtaaaaaaaaaaattgtggtacaatgtacatacagtgaacaattcagagttttgtcaatttcatacagccatgcactccacacccctatcaagatgtagaatatttccaacccctgaaaaaagatccttcatgcccttcccagtcagtccccaccgaggcaaacactgatctgatttctccccagtacgtgtttttccaatcctagaacttcatcagtcatagaatatgtactcttttgtgtctggtttcttacactcaggaaaatggttttgaaggtcatccattttcttggttttatgagtagtttctcgcaggttgtattccctgggaagagacagagatgaacacgcagggcattgataaaggagttctcttagaagccacgtcttttgaaaggcagggaaagaagtcagattgagcagattggggaatagagctgtgaggcagctccagccccagcctcagtgcatcccagtgggggtactggcgtgagattgtctgtcagttatctcaaggtggggtgtggggaccttgatgcttgccccgtgttgatcaggcattggatgtgggctccttctacaggaaggtggtatctcgggcaagcctgcagctttcaggcagggaagttctccttataaaaagctgacagctgagggctgtctcccagcagcactcctagcagccaggggaaataatccctttatttctgagggggggtccaggcagcacatcacagtgttttattgctgagtagtattccattaatggacataccacaatttatttacccactcttctgttgagggacgtttggcctgtccagtttggggctattatgaacaaagctgctatgaacattcctaaactggtctttttatggatatatgtttttatttctgctgaataaatgacaagtagaatttctgagtcatagggtaggtgtatgtttaacattacagaaactgccagactaacctgagcttcaacaacaaatgtgattttaaaataaatttgggtacaaatatagaaatacaccttcaaattaacaagggaaattcaggtgaaacttaaatatgaacttaaaacttaacctgaagttgacctccttaatgataaggttctcctgtgcagtatttgaaaacgaattacagcactcagtctctttttcccaacagatttttttcaataaagtacaaccatgcattgcttaaagacagggatacaatctgaggtgtgttgttaagtgattttgtcattgtgtaaacatgatagagtgtattttaacaaacctggatggaatagcctactatacaacctaggctgtatggtatagcttatttctcccaagctacaaatctgtgcagcatgttactgcactgaatactacagacaattataacacaatggtaagcatttgtgtatctaaacatatatctaaacatagaaaaggtatagcaaaactatagtgtaaagattaaaaaacaaacaaacaaaaaatggggttgggcacagtgactctgcctgtaatctcagcacttcgggaggccaaggtggcaggatcacttgaggtcaagagttcgagaccagcctaaccaacatggtgaaacctcatctctactaaaaatacaaaacttagccggtcagggtggcatgcgcctataatctcagctgctctgaggctgaggcaggagaatcgcttgaacccaggaggtggaggctgaagtgagctgagatcatgccactgcactccagcctgggcaacaaagcaagattctgtctcaaaaaaaaaaaaaaagataaaaaatggcacacttctataggacacttaccatgaatggagcttgcaggactggaggttgccctaggtaagtctgtgagtgagtgatgggtgaatgtgaaagccttggatattattctacaccactatagactttataaacactgtacacttagcctacactaaatttatatttaaaatttcttttcctaataataaattaaccttagcttattgtaacttttttactttataaactttaaaaattttttaaacttttttactgttttgtagcaacacgtagcttaagacacaaactcactgtacagctgtataaaaaccctctgctgagggtgtcagggtctcatgaagctgcagtcaaggtgtcagtagggatgtcgtctcatccaaggcttgactgaggaaggatacacctggaagtgcatgtggtcactgggcagcacgccattccttgcagaatgccagactgagggctcagtttcttgctggctgtgagtgggaggttgccctctgttccttgtcctttccatgtggcagctcacaacatggcagcttgcttctttaaagccaggtgaagagccagtgtcccctagcaagacagacgtgccctctcagggggaggggatcacacaaaggtggattacctggggtctaccttcacatctgtccaccatgctcccaatggtaagaagcatttattgtagtacctcagttagtcaaatatttccttcctccaaaagcagaggaaactagaactcccttccagtttgttcatccatacacagtgatttgtcaggtaatgaatgttcctgattagctttagcactggtgtatttcaaccaaatcaatttttaaacaaaagacaaaggccagtaacattaaaagagaagttgaacagaactttaactgggaacactaaaaacttaaatgtatgtatttagtaggtacatattaaatgtcattatggtaatattcagatctggtgttttctcagttactgcattaaaaaacttaagtgctcatttgtaaatggtgttctattgacaatactgcttactactggtaggcctagcagtaaagctgctctccatactttcaataaatcctcaatctccttttcctatttctcctggtacccacagaccttgtattagtccattttcatgctgctgataaagacatacccaagaccgagcaatttacaaaaaaaaaaaaaaggtttattggacttagagttctacatggctaaggaggcctcacaatcatggcagaaggcaaggaggagcaagtcacatcttacatggatggcagcaggcaaagagagagcttgtgcagggaaactcccatttttaaaaccatcagatccatgagacatattcactatcacaagaacagcacaggaaagagactcccccatgattcaattgcctcccaccaggtccctcccacaacatacgggaattggagatgagatttgggtggggacacagccaaaccatatcagacataagcagtgtattgatacggatcaggttcatttattcattcattcatgtataaaacaaatacctactgagcacttacccgtgcactgactgtgctggtgtttcagtagtaaatgaaacatggcctccaaataacattcagtccagacagatgaggaaacgctgcacaataaactccactgaggaatttgctatggaaatacataaattaagggccgagagaacttgatatccaagtggcacgctccttagaaaacaaattataggagaagtacaggccagatattgagagttaatcaagtagaaagaaaataaaacctcaaggaaggatgtgtcccttagatggtaatagaatacagagacaaacagaggcttgagaactgaggctttagaaaaatctaaatagaagatgggaagaaaaataacccacaaattttaagtagctgcagtgttggcaagctgtgaagtaaagtctcactcttcaaatggcaatatcagttttcagatactagctatttctatactgacataaataatggaatacaagtaaaatattcataaaaaattcatagtaaaatttgcatacaatgaaaaactctagatgaagtaagataatatttaaggtgggaacaaagtaaaaattatcacctaaagtcacagacccaggtgagaaatgcatattaatgttgactgttttattaatgcatgtagttaaatataatagtattcagtgttggtttgtagaaacaaatcactgcatgtgttactggttcacaagaaaacactgtaacacatctataaagaagaaattcaataatctaaaatgcagtggaatctggggcttcatgtgggttttagaatatttagagcaaaacaaaatctagagcactttatcctatatagtaaataaataaatatatcaaagtataacaataattttgcaaataaaataaaaaagcttttaggtaaagattgtttcttatcgtatatttggcccttttctaaaattttctttctttttttttttttttctttgaggcagtctcgctctgtcacccaagctggaatgtggcacaatctcggctcactacaacctcctattcccaggttcaaagggaagctactcaacctcccaagtagctgggactacagacatgcaccaccacacctggctaattttttgtatttttggtagagaaggggtttcaccaggttgaccaggctgatgtcgaactcctggcctcatgtgattcgcttgccttagcctccaaaagtgctgggattacaagcatgagccactgcacctgacctaaaattttcccttgtgcattctcaaaattgcaagttctctacctggaaaatttggaggaatgaaaacccctcagcaaaagaccctcattgcattggagggtgatgtgtggatttaaaatggcaatattccaagcacattttgtatatgtacttcttaattgtgtgattacatgatttctccctgaataaatcttgttttgatgaaagattaagtcagagcacctgcaagcttcattgctcctccccctttctcagctcccatctttatcacctgtttggagaatgtgtcaacattccctaattgagaagtaatttgcagttactgaaatccattttatattaaaaagcctcttcaatatgcacaacttaccctagagagctgttttacttggaggcatttcttagatttaagttctaataaaactaagtgtgttttaggaaataactttatagctttttttcccctattttaaaatacaaggaacataaaagtaaagaagagatgaagttaagcctgttaaatataagaaactacttattttgtttgttattcccttaagatgtcgtttggagttttaaagatatcattgtactacaaataaaaaatattacagatatctatttactcttcagaaagtaaaaataagtagtgggtaggagttcttcatctgtttttagttataaaatgctgaactattgaataatgaaagtgttttaaacaacactaaaaatgcatctgtatttttccctgaatgcaaaacagtaatatttaaattcaccttcctactagggatgtttcagttcttatgactaccaggcagttttgtttttcatcttgaattgtgaattgtcttcacctatattacaattagttttttctttttttctttaatttcggcttttatttttgatacagggggtatgtatggaggactgttatatgggtgtatattgcacccagacagtgagcagagtacccaataggtagtttttcaacccacattcttctcctttccccctatagtacacagtgtctattgttctcatgtttatgtccatgtgtgctcaatgtttagctcccacttataagtgagaatatgtgatatttggttttctgttcctgtattaatttgcttaggatatgatctccagctgcatccatgttgctgcaaaggacattatttcattctttttttatggctgtataatattccctggtgtatttgtaccacgttttctctagccaggcccccactaatgagcacctaggttgattccatgtctctgctattgtgaatagcacagtgatgaacgtacgagtgcatgtgtctttttgctatagtgatctatttccctttgagtatatacccagtaatgatatttttgggtcacatggtaactctgttttaagttcttccaattacatttttcattcaaagttgcagagcactctctcaacatgctgagtgaaggcttgccctccccgtggatgaatgaagtactgaatatcccaaagcattgaatcacttctcttgattttaagattctgtttcattggtgcccttgtttttatcattttgttttttactctgttcttttttcttttctttccctttttagctttatcatttaatattgacctaattcatttgtgtgattatctttccctgaatagatcttttctttgtttttttaaataaatgcgattaaagctttaaatatagctctaattaccacattagcttaattctacatgttttatagtgctttcattgttgtttagttctaaatattttatgctacaattggattttcttgtgttacttaggagtatgtttctttcagtttctaaaaatgtgtgggaggggtttttatttctgtttttaactaggttttcttgttgatttttaatttaattacattatggtcagagatcagggattacttaatatgaattacttaaaatttattgagatttctgttatgatctagtgttaaatcaatgtacagttgccattttcttgagtacaagtctctacacgtttgtgtattacatcaagcttgtcaatgggattgtttaaattcatgaccttaaaaatattttgttttcatgatctattagtttttgatggtatgttaaaaatctctccttattattgtggatctgtccgtttatcattgtaattctgttagtttttgctttagatatatatatggttctgatgtcagggatatatgagataataatttgaacatcctgttagattataatttttgtcattacactatataatatgtccctctatactatttgttattttaccttcagttttaatttatctattattaatattgagattataaattttcttttggtaagaattttcttagtaaatatttttcatacttttattttcagcttttgctgtttggggtgtgtcttctaaaaatgacagataaagaaagagatgtactatgtttctgctgctcacaattttttagtctttgtcattagataagaaagcttattcctttcatatttattgagattactaatttggacttacattgccatcttaatttgtgtcatctttttaagcatgctcttcttcaattttctttcattttctcattatttggattagtgaagctttctttaatccccttcttttgtttagtgatttggaagcttatagttatatctttcttactatttgaaacagttactttttctaacaaagtttaaaattatttagtacatatatctttccccgatcaaaatcaggactttaacatacatgttaaaacttcactacttcctcatttgcagagccgatagtttattaaattcaccatcatgtcctcactttctgtgctcactgttgtttcatgcataccacccttacctctaggttcattttctttctttatttttattttattttattattattattttgagacactgtcttgctctgtcacccaggctggagtgcagtggtgcaatctcggttcactgcaacctctgcctccctggttcaagtgattcccctgactcggcctcccaagtagctggcattacaggcacctgccaccacacccggctattttcttgtatttttagtagagatggggtttcaccatgttggccaagctggtctgaactcctgacctcaagtgatctgccagcctcggcctcccaaagtgctgggattacaggcatgagccaccgcacccagcctgggttcattttctttcttgctgaggaatatcctgtagatgttttcagtgattaattacttttagtgaatgattgatttagtgaatgagtgtttacctggatatagaattctaagttgacagttgcttcttcaaaacactaagaaaaaatagtttttcatttacttggatttattatgattccttaaagtgggatttgccttttctgtctcctgctttctaaattttctctacatttctgctgctcagtttcactaggatgtgtttaggtatacattgatttgttctttcccttggcgacacatgggattgtttttattctgtatttggaagtctagcagacatctcaaaactgaacttctaattttctattccaaatccactccactcactgttgtgctagttttaagtaatggcaatttgatcttttcagttgctcagaaaaaaattttgaagtcttccttccatcatcttttgtctcccacaccccacattcaatccatagggaatattggttctgttttcaaaatgaacccagaatccagatgcatttcattacacccactgctaccaacctggtctaagccactatcatttctagtctggattattcctgtagtctctcctggtctctttgcttctaatgttgtctcctctgttctctactcagaagccacagtgatttttaaaacaaaagccagatcatgttattactttgttcgaaactgtcattgcaaccttatcgcactcgtagtaaaagctaaagtattttttattatttttattttattatactttaagttctgggatacatgtgcagaatgtgcaggtttgttacataggtatatacatgccatggtggtttgctgcacccataaacccgtcatctacattaggtatttatcctaatgctatccctcccctaggcccccaaaccaccccccaacaggccccagtgtgtgatgttcccctctctatgtccatgtattctcattgttcaactcccacttatgagtgagaacatgtggtgtttggttttccgttcctgtgtgaatttgctgaggatgatggtttccagcttcatccatgtccctggaaaggacatgaactaatccttttttatggctgcatagtattccatggtgtatatgtgccacatcttctttatccagtctatcattgatgtacatttggcttggttccaagtctttgctattgtgaagagtgctgcaataaacataagtgtgcatgtgtctttatagcagcatgatttctaatcctttgggtatatatccagtaatgggattgctgggtcagttggtatttctggttctagatccttgaagaatcaccacagtgtcttccacaatgtttgaactaatttacatgcccaacaacagtgtaacagcattcccatgtttccacaacctctccagcatcagttgtttcctgactttttaatgatcgccattctaactggcatgagatagtttctcattgtggttttgatttgcatttctttaatgaccagtgatgatgagttttcttccatatgtttgttggccgcataaatgtcttcttttgagaaatgtctgttcatatcctttgcccactttttgatgggatcatttgttttttcttgtaaatttgtttaagatctttgtagattctggatgttagccctttgtcagatggatagattgcaaaagttttctcccattctgtaggttgcctgttcactctgctgagagtttctttcgctgtgcagaaactctttagtttaattagatcccatttgtcaattttggcttttgttgccattgcttttggtgttttagtcatgaagtctttgcccatgcctatgtcctgaatggtattgccgaggttttcttctagggtttttatggtgttaggtcttacatttaagtctttaatccatcttgagttaatttttgtatgaagtgtaaggaaggggcccagtttaagttttctgcatatggctagccagttttcccaacaccatttattaagtagggaatcctttctccattgcttgtttttgtaagatatgtcagagatcagatagttgtagatgtgtggcattatttctgaggcctcggttctgttccattggtctatatatctgttttggtaccagtaccatgctgctttggttactgtagccttgtagtatagtttgaagtcaggtagtgtgatgcctccagctttgttctttttgcttaggattgtcttggctatacaagttcttttttggttctatatgaaatttaaagtagttttttaaaaattctttgaagtcagtggtagcttgatggggatagcattgaatctataaattactttggacagtatggccatttttatgatattgattcttcctatccgtgagcatggaatgcttttccatttgtttgtgtcctctcttatttccttgagcagtgatttgcagttctccttgaagaggtccttcacatcccttgtaagttggattcctaggtattttattctcttcgtagcaattgtgaatgggagttcactcatgatttggctctctgtttgtctgtgactgatgtataggaatgcttatgatttttgcacattgattttatatcctgagactttgctgaagttgcttatcagcttaaggagattttgggctgagacgatggagttttctaaatatacaatcaaatcatgtcatctacaaacagagacaatttgacttcctgtcttcctatttgaatacgctttatttctttctcttgccttattgccctggccagaacttccaatacaatgttgaataggagtggtgagagagggcatccttgtcttgtgctggttttcaaagggaatgcttccagctttttctattcagtatgctattggctgtgggtttatcataaatagctcttattattttgagatacgttttatcaacacctagtttatttagcatttttagcatgaagggatgttttgtcaaaggcctcttctgcatctattgagataatcatgtgttttttgtcattcgttctgtttatgtgatggattacatttattgatttgcgtatgttgaaccagccttgcatcccacggatgcagccgacttgatcgttgtggataagatttttgatgtgctgctggattcggtttgccagtatttattgaggatttttgcatctatgttcatcaggtctattggcctgaaattttctttttttgtggtgtctctgccaggttttggtatcaggatgatgttggcctcataaaatgagttagggaggagtccctctttttctattgtttggaataatttcataaggaatggtaccagctcctctctgtacctctggtagaattcggctctgaatctgtctggtcctgggctgttttttggttggtaggctattaattactgcctctatttcagaacttgttattggtctattcagggattcgacttcttcctggtttagtcttgggaggatgtatgtgtacaggaatttatctatttcttccagattttctagtttatttggatagaggtgtttatagtattctctgatagtagttcgtatttctgtaggatcagtggtaatatcccctttatcattttttatcgtgtctatttgattcttctctcttctcttctttattagtctggtagtggtctattttgttaatcttttcaaaaaaccagctcctggattcatttattttttgaagggtttttcatttatctttctccttcagttctgctctggtcttagttatttcttgttttctgctagcttttgaatttgtttgctcttgcttctctagttcttttaattgtgatgttagggtgtcgattttagatctttcctgctttctcctgtaggcatttagtgctataaatttccctctacacactgctttagctgtgtcccagagattctggtgtgttgtgtctttttttctcattggtttcaaataacttatttatttctgccttaatttcgttatttacccagtagtcattcaggagcaggttgttcagtttccatgtagttgtgcggttttgagtaagtttcttaatcctgagttctaatttgattgcactgtgttctgagagacagtttgttgtgatttctgttcttttacatttgctgaggagtgttttacttccaattatgtggtcaattttagaataggtgcaatgtggtgctgagaagaatgtatattctgctgatttggggtgtagagttctgcagatatctattaggtctgctttgtccagagctgagttcaagtcctgaatatccttgttaatattctgtctcgttgatctgtccaatattgacagtggggtgttaaagtctcccactattattgcatgggagtctaagtctctttgtaggtctctaagaacttgctttataaatcagggtgctcctatattttgtgcatatatatttaggatagttaattcttcttgttgcatcgatccctttaccattatgtaatggccttctttgtctcttttgatctttgttggtttaaagtctgttttatcagagactaggattgcaacccctgcttttttttttctttctttccatttgcttggtaaatattcctccatccctttattttgagcctatgtgtatctttgcacactgataagtcttggctctttatccaacttgccaatctgtgtcttttaattggggcatttagtctgtttacatttaaggttaatattgttatgtgtgaatttgatcctgtcattatgatgctagctagttatatagcctgttagttgatgcagtttgttcatagtgtcgatggactttacaatttggtatgtttttgcagtggctggtaccagtttttcctttccatatttagtacttccttcaggaactcttgtaaggcaggctggtagtgatatttctcagcatttgcttgtctgtaaaggattttatttctcctttgcttatgaagcttagtttggttggatatgaaattctgggttgaaaattcttttaagaatgttgaatattggcccccactgtcctctggcttgtagggtttatgcagagagatccgctgttagtctgatgggcttctttttgtgggtaacccaacctttctctctggctgcccttaacattttcccttcatttcaaccctagtgaatctgataattatgtgtcttggggttgctcttctcgaggagtgtctttgtggtgttctctgtatttcccgaatttgaatgttggcgtgtcttgttaggttgggagagttcccctggataatatcctgaagagtgttttccaacttggtttcactctccccgtcactttcaggtagaccattcaaacgtaggtttggtcttttcacatagtcctatatttcttggaggctttgttcattcccttttattcttttttttctaatcttggtcttcatgctttgtttcattatgttgatcctcaatctctgatatcctttcttctgcctgatcaattcgactattgatacttgtgtatcttcatgaagttcttgtgctgtgtttttgagctccatcaggtcatttatgttcttctctaaactggtgattctagttagcaattcctctaaccttttttccaggttcttagcttccttgcattgggttagaacatgctcctttagctcagaggagtttattacccaccttttgaagcctacttctatcaattcatcaaactcattctccatccatttttgttcccttgctggcgaggagttctgattctttggaggagaagaaggccaaggcctttttttttttttgaaatggagtctcgctctgcagcccaggctggagtacagtggcacgatctcgactcactgcaacctccacctcccagttccaggttcaagcaattctcctgcctcagcctcccgagtagctgggattacaggaatgcgccaccatgcccagctaatttttgtatttttagtagagatggggttccaccacgttggtcaggctggtcttgaactcctgacatcatgatccgcctgcctcagcagcctcccaaagtgctgagattacaggtctgaaccactgcacctggcccaaagtctttatagttaactgcaaggtcctatgtggttataatctccttctcctcatctttacctctcttattctatgtactccaaccacaccatttcccctggattcctcaaacatatgccatgctcctgtctttatattaactggtctttcttcttggaacacctctcccccagatagccatatggttaactccattacctcctttgtgtttttgcttaaacattatcttctcagtgaggacaactgtgaacaccacatgccagtccaatctctcttactcttctgaatttcatagcacttttcatcttctaaattgttataaagtttactgatttattatgtttactgcttattttctgtcattccattagaagggaagctctatgagtgcaggtgtttttgtattttgtataattctgtctcctaagtacctagaacaaagactggtaaaaaggagatgcataataaatatttgttgagtggtgaaccaatcaatgagttattattaatatagaactagcatatatgtaacacaatatagacccaaagtcttttcatggagcaggaatacagtgaaatacagttacatcccaaatgcccattaactggtaaacagataaacaaacttttgtatagccatacaatggaaggcaacctagaacaaaaaggaacaaaatacagatacacagagcaacatggatgaatatcaaaaacatatgaaacaagccagattaaaaaaaactgtacataatattattccatttgtaagaaattttagataaatcaaaagtatggacatggaaagcaggttggcagttccctaatgccaagggtggtacagggatgtgaaacaggaattaactgcaaaaggacatgatggaataccttagggatctcaaagttttctgacacttgagtgtgctgttggttggactacatgtttattaaaacttattgaactgtttgctttaaatgggtacattttagggtccataacttattcttcaaaaagctgcaagcaagcctgggcaatatagtgagaccctatctctacaaaaaaaaaaaaaattacaaataattagctgggcatggtggcaggcacccatagtcccagctactctggaggctgaggtgggaggattgcttgagcccaggagttcaaggctacagtaagcaatgattataccactgcactccagcctgggccacagagcaagacgctgtctcaaaaacaaaaaacaaacaaaaaaagctgcaagcaataaacaaacaaatacagttaattctgaccacctactattagaatttaatctttctttaattcaggaagcacttcacaatcttagggcaccttcagaatgaatgagcacctctgtgtggcaaaaatgtggatttagtaatttgctaaagttcagagccttctctgtactaacctactgggcatccctagcacttggaggaacaaacttcttcttttttatttttatttttatttatttatttctttttgagacagagtctcactctgttgcccaggctggaatgcaatggctcaacctcagctcattgcaacctccgcctcccaggttcaagtgattctccggcctcagcctcccaagtagctgagattacaggagtgcaccaccacgcctggctaatttttgtatttttagtagagacagggtttcaccatgttggccaggctggtctcaagctcctgacctcaggtgatccgcccacctcggcctcccaaagtgctgggattacaggcatgagtcaccactcccagctggaggaacaaacttctcttcctccactgttaggatcatgtatttgtaggctgcaacacccaccctccaccgtacccatactatgacctccgccacaggagagtccatacctcacttatccttatgcccatgtgctagaggtaccacgcccatgggaagtcctcagtcaattctaggtgaatgagtagatgattatttcagaggggcatacaaaagaaaatttacagtcacagacagactcgatattctcttgctatggagtcaacattctatattattaccaaaattttacatgtattcccagatttttttttttgtccatacttggaagttaccattaaggagataacataaatgcttatttttaatttatcatctatgtattcagtaccctctatttgccaggcaaattttgttagtttctagggatggatgtgatggttaacaaaacaaagatttgggccttactggaagcaattattttgtgtaaattgggcagtcatataaaagatgtctttaaggactgttctctttagattttggtcaataaattaaagattattcattttatagcagtttttagagttttaatactatggatgagtactttgttttgcttatgaaatgaagtagagcaaaattacagacgcttttcctcccagggtagggagaatgtctttggaaaaggaaattccagcaccaccccttgaggtctttattttccagcataaatcttccaactgtggggctcactcactaagcaagcacacgtgagccacaccccgcctctgcagagactcacgcagggtgaggcagaggcaaggtattttgttaatccttttagcttgagcaagcagaagaaggaaaactcaggaaataaatcacatgaaaatatgagaacaataggaaagaaaagcctgtctttcaggtttgtttcctgttctaatacttgtggaatgtggtcttctactgatgcttaatataactagaatatgcaaagttgtaattctttccttaacaaaagttttcctttatctgttagcattatcctgttcaaaccagcatctctcagaattgttaaaatctaagatatagtagccatttagttgcaactttaccatagagtaacattttacaaagtaaacattagttacatatacagagttttcactgagtttatattatctagtaaagctcccatttgctttttatatttttctaagtaagctgactcttacaaaatgtagccaagttttgaagacatacaaagtttttaaaaaccagaagatcttctagtaaaaactacccaaatagttaaaacaacttttgcatatcgtttttagtatactattaggaaaactgctaagttttcattcatttccttcccattaagaaataatttttctattgctacaattcccattagccaaggaaatgtcactaattcacagggtgtctatggtcaaatctagaaataagggtgtaaattaatgtaatcttcatctgcttgtatatggccactatcaaccactgttgcctcccaggtcactgctgttctgatcaaccatctcatctcttgggactctgcctaacccttccctcccatcataattcctccacccctaacatctggtgtctcaaaatgaatcctcacacagctggcagcatctggacaaggcagagacctccaggattagtattcatggcatttgtgttctgaggaaggttccttcttcttcctgctccaggctagatttggctgcctagaaaaatctggcagtaacctaagttataggatttggtagtggtgactgtagtaattgtaaaccatcttctctaaaggcaccaagttgtatgtctgccatttggactttgacctagaaaagaactttctcacaaatggtccagattgccaatgtttaggcttttgtccgctttaactttaacctaatagatatagtggcttccatccaggaggagtgcaagtgtcactttgggtaccccaggtgggtgagtctaagacttcccacatcagacaagccagtgaagtctgtgttacagggtagaatgcttgaaaacctgataagtacaactttgtgtcataaaggcacactggctttcagaaggggaaattctatctcactaattcactttctttagtttctttctggaaataaatgaataaatcacagtagttctttcagagcttgaaaaatatttagagtgttccatggaaaaaatcagtagatgccattagtctatatttttaggaaggctaaatagaagctattcctcaaactcagccatggtatgatatgatgcggcattattataacagagaaaagtagcggtgtgctgaaggcagttcacacaggctggtgggccaaattgttacatttcaaggaattttgcaagctgtttgatatcagttttgctagctggttgaaggcctgtagaataggttattgtaggagtatttacatcacagtaaacaaagcagtctgaggccccctcctgcctcctcacccccagcccaaaccagttaagcatttaccaagatatcactggataagagattggtttagaaatagagaacaaagggtgggaccaatgggataaatgctgaagaattataaatagatagcttcctcagagttaggtattgggtctaatcctgtttagcattttaataaattccctagagagaggtagtatacagagaaatgtccatgcctttcagatgacattaaatgtttccagagttaaactataaacccatgggattaacacccagaactcttagtaaaactgtgtgagttctaataaggcaagagtaaggcaatttgggggaaaattatcttaaaattctcttgttaggtgataatatctaacctttgcgttacaacctagaaatgaaatttagagatttctgtagacgttttctatgttcattagtataacttgttagctgtgataaaaaggccacttaaatgccaagttccatcagaagctctagaaaccaagaacaagaactgtcccactcttagaaagaaaacttagtgcacacttcctgcagttttggttgacatgcttcaaggataatgtaatggaactggaagagtttcagagaaaattgcataacctggttagggtattataggaatcccagatgaggctgaagattatattaactagcaaatcatgaaaggtcttgaataaggtaaatatagctgtattaagcaattcctgaaaaactggaactatagtgcacctccttgatctttgaaataagaatttatagaagtaatagaaatatgctattgtttctcaaggaaaagaagaaatgatagcaaccttaaagtttaacttttatcagtatttaaaaattattacagttacatattttgaatgtgcaaaaggtactgtatatttcctctgatcagtgacctccctttatcagaaagactgtcaaaaggaagagtgaaacattctccctcttaacttacctttaaccacttttgtttgtttgtttttttcttacggcaactcaaagcaaagagctggaggagccagccattataattgcttactctcatcgcttagcgccccaggtgggatgtgtttccaaaacacatttttgtatttataaggaaatgtagttaggattaattttattgtcctaattagaactcacattttggttaaatcctcaatttcattaaaaaaaaaaaaatcagtgtttcttaagagtgaattaggcaaagggaagaagacaatggatcacacttttttagggaaaagatcttcctcacagtggtgggtgggctatttgggtgtgaaaaaacatagggcaacttaattaaccatgacaaaacagacaagtaagtgcctttcaaaaaaatcaaacaaggctctgcacgatcttaataataaaaattttagaaaaaaatgattttcatgttagttcagagttgattgtctaggataaattaaaaaatgaaagctgtggtaaatgacctaaatatattgcactttctgatattttttacattttaatgaaatatatgccttcagcaaagtgcacacatcattacagacatctcaatgaattttcataaaatgaacacatccagtaaccaccatccaatctaatgcaccatatacagatgttccatatactgtatatatatatacacacattatatatatatagcatgaagattacttatactaattaatcattaactgtaaatatgaagaatatttatttgtattcatatttttaagaagattgagatttaacaggatattatagaagggtttaattcacctttcaagtttgttatagtttttttccccttttgtgtattttaatcactttatttcacagtaattcttttgaaataaaggagaggtcagcactccagagttttaggtgggagacagcaaaaagtatattttgttgatctcacacgtagacctaccatttagatttgttgtcaagcctgattgaggccattagtgccgtttttaaaaaattatatttgttaaaaggaagataatttttaaaacgagaaaaaaatgggcacaagacatgagagtgccacaatactgcaaatagaatgtaaggaaggaaataacttttaagaaacaaattttgttaaattaagtaccgtgactaaatactttaattccttttcttgtagcccgtaaggatcatttgactttgaaccttttaagtcaaagaggagtagtctgaaagcctgaactccctaccaccctgagggggtgcgggtgcggcggggccggctgggggcttcccccaccccctgctcctgcgccctccccccgcttccccctcctcccctccctatcgccctcaccccccttcttcccccgtgacccctgaccccagctaatctgcatagaggaatgacaggcatccgctgggcaggatccgccgcgccggctgcggccggccgggctgggagacccgcgcggggtagaaggtgaggggacccggcgggccgctcggcacaggccgggacatgaacgcctggaagtctggctgggagcggacccatgatcgaaggaccaaaggagccgcttgatcgctggacctggccctgcgaccccagtcatgggccagacctcggtgtccacgctgtccccgcagcccggcagcggtgagtccggggcgcacgcgatgcgctcccgccgcgcgggcgcagggctggcggcggggccccggggcaggcagggttagtcgtctggtcgggttccgctcggacccgccaagtccctcggagaaaccccagaggtagcgctcgccaaactctttgtcgtgaaagaggaatgccttttgggatccagccgattttaccttaaaggcacaggctccatttttctgtgcgcgatgcctcgctgtggttttttatccaaattatttcggagccagaaacttacgggaaacgccatttgcgtattacagtgtttttaaaaacgcgaaacttagagagcaagagaaacatgccaacaggtttttctgtatttacgcttggcttccgaacagactaggactgaatgctttcaagcttgtcaactgatttatggtttgttattcggagtagaagcgctgatcgccttatcctggcagacgctgaatacttaataactagccccgaaatgcgtaattgtttcaaatgagacttgttttgtttatagtagatacagcagctataacatttagggaaacatatctcatgaacttagttctccaggactaaagttagttttatggagacgtgtgtaacgtgtctgagttctaatgctctgttttaaaagtttcttttttccattttcttaaacaaaaagagggaaggaaggtacgtctggcatttccccgacagtgtagggataaaaaaaaaaaaaactgtttggtggtgttacttgtgattggataaggaaataaatttaaaaggtactattttgatatttttccatcaacgattaaaaataaataatactcgaagggaccgtttatgttactcattgagatatttgatacactttttaaattgtgcaaacatcaacaggatcttgctgaaaggaaatgacagggtacagaggaaggttttttaatctgcctcaggatgtctagctagatagcattctgtcattccaaccccccaccccactttatacccagtgggtttctttaggtagcacagcttcactccctgagataccacaagctttgctgaggtttctgttaataccacagaagacccttctgcaaagaagagacatcagaatcagaatataccttctttaccattaatgacatggctacagctctgaaatcaaagacctcatgttgacagctttttgagagatatttgcggggaggggttgagtaggattttaaatttagtaaactattttgtgcaaataagacttggtttcctttgtcttaccttaaagtggtgtgagacttcttttcatttcaaggaagggttatatttttacatttgtgcaccggcgaagatagaattaaatctgtactccaatacaagagtatacagaaagtattgtcctgaatttagtgattttatcacaaaatattactcgagtgaatattagaaaagcaaattttgccttaataaaaatcaaggaatattatataaatgatgtctaagaagcaaataaaatcctaaagtgagactccctacgtcttagtacagcaaaaaaacccggattgctataattccaaataaaatgactgattataatgagaaactgtaatctacttaagtaaaaagtgttttaaacaaaaatttatgcttgatcatgaaagataattcagagaaatatctcacggaacggtgttatacttaaattgcaggtcctcagttttgcggattaaaagtttgtatgaattgaaatgaccaatccatacatcataaatacagggttttttatttttcagttaaggaatgacagtggttatgacttaagttgtggtattgtaaaagaacagttttctcgtggtatccagtgtctctaaatccgttagagctaccctgtttccctgaaggtttgccatcagattccaaatgaaaaccaaaaaaaaaaaaatttaaattaaataacgtttgctgagttttatattcatgtctgtatttttctgagtctgagactgtcaaactctctactattccaggtattttgttcactccttgttaactgtttaactctggctttacagatggcgtgaagatccttgttctgtttgatcttagccattgactagttgtttaagtctggagcagctgcttaggattacagtattaaagatgattctcatcttaaatgcttagtgggcgaaaatctgtttaagtcaaaggaatcaatagcacagagtttaattattcatacttatcgctcaatttggccttttgtaaaaatcttcattataggctagaagttagcttgctttccccgttttgactttaggctctctagagcctttcagtttaggttgcacctaattctctgggttctaggaagaccattaataattttttctgaaaatatgcagttagatccattattaaaaagaacagctgtattgatgtataattcacatactataaaattcacccatggaaagtgtacagttcattgtttttcagtgtgttcacagtgttgtgtgaccctcaatctctgttcccaccctattcaaccagtgggctctaccttaatgaaacactaatcaacttttctgtctctatagattttcttattgagaacatttcatgtcaatggaatcataatgtgtcattttgtgactggcttctttcagttagcataatgttttcaagggtcatccatgttgtagcatgtatcagttgttcatttctttttattgccaaataatattctactgtatgaatatgccacattttatttatccatttatcagttgatggacatttgggttatttctgctttgggctatttatgaataatgctgctctgaacttaatgtacaagttgttgtgaagatatgttttcatttctcaggtatatatttagtagtggaattgctagattatatggtaggtagttctatgtttaaccttttatggtgttgccaaacagtttccaaagaagttagaccattttacattcccaccagcagtgtatgaaagttacagtttctccacatccttaccaacatttgttactgtctttttgattatagccatcttagtaggtgtgaagttatatctcatggttttgatttccttttccctaattactaatgaccttgagcatcttttcatgtgctattggccatttgtatatcttctttggaaaaaatgtcttcagatcctttgcctaattttagttggataatttgacttctgttggagttttagttctttgtatactagatccaaatcccttgtcaggtacatgatttgcaaatattttctgccattctctgggttgtcttttcatcttggtagagtgatttgcagctcagaattttaaagttttgatgatgagcagtttatcaatttttttcttttgttgtttgtgtttttggtatcacatctgagaactacagcctaaccaaggcaagaagacttacacctgtgttttcttccaagcgttttataattttggctgttacatttaggtcagtaatacattttgagttaatttttatgtatggcgtcatgtagggtttcattcttttacatgtgaatatccaattgttccagcaccatttgttgaaatgaccgttctttccccattgaatggtgttccaccgttgccaaaaattgattgactgtgtacataagggtttacttctggattctcaattctgctccattgtctcttcttatgccagttaccacaatgtctagattactgtagctttgtagtaaattttgaaacctagaagtatgagtttttcaattttgttcctttaaaagtttctactggttattctggttcccttacattttcatatgaattttgcaatcaacctgtcaatttctgcaaaaaagccaattagagttttgatagcaatgatattgaacctgtagatcaatttgggtagtactgctgtcttaacaatatgaagtcttctaatccatgaacatagatgcctttccatttctttgtatcttctttcttttcaccatgttttgtagttttcagtgtagtgcagtggtgcgatcatggcttatccactgcaccctcaaccttctgggctcaagcgatcctccaacctcagcctcctgagcagctgggaccactggtgcccaccaccatgcccagctactttgtattgttggtagagatggggttttctgtgttgcccaggctggtctcaaattcgagatctcaagagatccacccacctgggccttccaatattgcagggattataggcatgagccaccatgcctggcctgaactcattttttagtcctagtagtttttcagtggattccttatgattttctatatacatgatcatactatatacaagatctatttacatgtgcaaagaaacaacattttaattcctccttttagagttgaatgccttttattttatttttttcttacttaatagttctggctagaacctttagtccaatgttaagtagaagtggcagttgtgagcatttttgtcttgttcctgatctaacaaaaaaagttgtttttttgttttttgttttttgtttttttttaccattaactgtgctattagctatgggtttcttcataggttcactttgtcaaaaagttctctgctattcctactttgtcagtgtttttatcatgaaagattgttcaattttgtcaaaggtttttcctgcctctattgaggtgatcatatggtttttgtcctttatcctattcatttgtcatgttacgttaattgatttttggttgttaaaccaaccttgcattcctaggataaatcccacttgggtaatgtgtataatcctttttgtatgttgctgggttaggtttacaaaagtattttactgagaattggatccattatttctaagtacaggctaaaacgatatgccctcaaataggatggtttcggtaccctctggcatcatgccctaggaggattgagacttctagtatttcattgtgaagtgtagagcatggtagattggatacaatacatttttgatgaatatatgaatgagtcaacaaatagtctcaataagcagcctgactgctttaaaccaatgattatatgaatgagaggtatgtattttttatattctttttttagtccaagaattacattactctggctctattgtctgaagggtggtatctgaatctagtaattatttcttctagttttttccaaccccaccccattttcacggtgccacagatcagcacttggctgcttctcctcaatccttgggttgaaagggcagacaatgccactgtccccatttttaagagacaagagaacaagtaaataaagtgtgcaggatcacacctatgttgtgatagaacctgtattcatctgtgtctctgggtttccaagttttgttcagggccctgtatttgtcttgtccagaatatttatccatttccttgtaaaccaggcacaggaagaggtcctaaaggcaaaagctgatggagtttgttttctttattccataatatatacatggtaggaagtcaaacattacaagatggtttgggataaaaatgaatttactccctcccagaatcctccagtcccacttttcatctataacccagcatgaacagtttttttcattccacacagttttcattcatagatatatctttatcagcagtcaaacaagacatactatacttactgctctatactttgaatttttcgtgtaatataacttgaaaatacttccaacttgttctctttaattctataaatgaacactattatagtatgtggatatatgaaaacttcctttaaaagaatcctgttgtattttaatattgttcctgggttctttgcatatgtatatgctcttatgaacaatactgaaatgaacatccatatctatgacctctctctgcactccaggctcaaatatgcaactccctatttgacaggtctgcttgaaaacttgctgggcatcccagaggtaacatggatctaatggaaggtttgattttgtcctccaagccagttcttcccttgactttctacatttcaccaaatgataccccaaccactcacttattctagcccaagatctaggagttattcttaggttttcctttccccctccacatggatccatcagcaggtcttgttcttttttcttcccaaatatatctcaagtccatgctcttctgtctgtccctactgccactatccaagctctgaggccatccattacatggacaactataaactacatgtcctaatgacatattagcagtagagttgctaggtcaaaagatttgtgtgttttattttgatagactttgctacattattctcaaagaggctttctcagtgttatctgcttattatatgagaatttctgtttctgtactctgtcaccaccactgaatatcagggtcactcttagcccatagcctcgtgagaattagaagtcacttcctctgggtgaggcagctagctccacagcacagacttaacaagtggaactttagcatgtatttaattcccactcattctcttacctatgtgtccttctgcagtcaacactctacacaactgtacatgaccacaatgctgtgcataaataattttttagactctttgtaaatctatatgtaaaaaatggcatcttattttgattatgagtgatgtaggacatttatatttctttttctttgaattgcctatttatagactttccttatttttatggtttcttacaaatttgtatattcaggagattaacctaatgtctatcatatattttaacattaaaaatttttttcttgtaccttaagtttgtttatagtacttttttatagaaacctttaaatttttaagtcaagttgattagtcgttttctttcttacagactagggctatttcaaaaatgctttcctctgctatttttctcatgttttgaatatttgatctctgtaatttattctagcttaagatgaatagatttaatagtataaaatttttaaacttttacatggccaaaaaaaattaacatcagaaagttgaaaaggaaaatcataaagttgaaagaaatatttaattatatatggaaaataatagttaatatcattaatgtagtaagacctcttaaaagtcagtaacaaaaagataagcaaccacataggaaaacaagtaaacaacatgaacaggcattttccaaaatacctaatggttacaattgtgaactcactatgggccaggaactactctaagtgctttacttgaattaactttttaaaacttatgacgttcatccggggtaactaatattaatatccccattttataaatgaggaaaaccaaagtacgagagctaagaaacttgcctatgttacctgaccaaagaagaacataagtgatcacttggtaaatgaaataaggtttaagcaattaaatgaaaaaaaaaaaaaaaaagggatgcaactgatcacctatgagtttagcaaagattaaaatgagtaattcccaaaagacaattgttttgtggtaatttaaattggtacaacttatcagaaaagcagtttggcaatatatattaagtcataaaatgtgcacttaggccgggcgtggtggctcacacctgtaatcccagcactttgggaagccaaggcaggtggatcacctggggtcaggagtttgagactagtctgaacaaaatggtgaaaccccgtctctattaaaaatatagaaattagccaggtgtggtggcgggcgcccgtaatctcagctacttgagaggctgagacaggagaattgcttgaactcgggaggcgaaggttgtagtgagccaagattgcaccattgtactccagcctggacgacagagtgagattctgtctcaaaaaaaaaaaaaaaagtgcacttagactacacttagacccagtagttctgctcatagaagtatattgtaaaagaaataattaattgctcataaaaacaatttttacaaaagccaaaaattggaattaacttaatagtcaagcatcaagagacttgttgaattgattgagatagacatgtggtagaataagccatttaaaaatgatgtaaaaatatttttaaaaggcaatttttatgataaataacatcaacatgtgaaaaggcaggttatgaagtaatatgattccatttttaaaatatgtaaagaaaaatttatatgtacacacacatagaggagaggaacttcattcttttttttttttttttttttttttgagacagagtctcgctcttttacctaggctggagtgcagtggcatgatctcggctcactgcaacctccaccttctggtttcaagtgattctcctgcctcagcctcccaggtagctggaattacaggcgtgagccaccatgcccagctaatttttgtattttaatagagatgagatttcatcatgttggccaggctcgtctcgaactcctgacctcgtgatccacctgcctcggcctcccaaagtgctgggattacaggtgtgagccactgcgcccacccaggaacttcattcttgaagagttagtgtgacagtcatggctttcccctgctttggacatgatcgaacccaaggtttccatatccactgtccacctggaccttgaccgtaattaaagtcatgagctcacctgcaactgtactagcttttctccagctgcgtggattctgagctttaagctcagtggctggttttcagctacttttttttcctttgtcagtgatgaaaatgaaaacattggtcccaatatagccaccttctttttaggtttaattgtttttttagtctgttcgataataatgtgaatgtctcttactttgagagaaagaatgtgagcaaaatttcaacatcacctacttctctttggtccatagctcatcagatttggtcagtgactaatatcccaaatattttaattttatttttagcagtctgaaatagaaaataataaatttattttatttttagcagtctgaaaacataatgactaatgagcaagtcacacgtcacctcttgccttcttaatgcagtggggaaggaaacaagaattgtaagaattggtcttacaattaagcctatttaatttgaatagagggaaaattccaacatcttttctttggggactttactgtagcaggttaactgctagtctctattcttgggagaaaatattaatatttagtgaagactcaactgatgcaaaagtgatattaaggatagaaatagtcttaagaaaataaacacttcttgtttcctccccacaaaagcaggggaacaaaaaccaaaactacagaaatgcggaaaggaatgggcaaatcacattacttgctaaaaggtcggtctaaccattatcatttatatttataaaccatccctccatttattttcatttcaaggggctggatgtttttattcacatcaaccttctggcaagtaaaacactgcagcccttaacactaaggaaatttggctgccaaggaaggactgaagtgctattttgcttaagaatatcctggaaagctgtgctggtatgtgcttggcaggtatagtcctacaaatcagcctgttttatgaggggatattaagaaggagaagagtggcaccttcatgcagcaaacagttcctaaattaaagttattatgtgtaaggtgttatgctaagcaaggtgggaagtttcaaagataaatcctacacagaccctgcccacaaagcgtccagtctagaagatgcttagtgaaaatgtgcagaaatgagagtggaagggaagggatatgtagagaattgtaggactagatcaggaggcaaaacacataatggggacaagaattcaggctctgaaaaggaaaggggtggaaggcaatactgaaagccacaggcaatgggaaccactgacgcttttttttttttaaatcaaaccagagaaatgattattgctttgcctccggagatgagttggcctgccgcatgcagtatagatttcatggggagagactgaaagtgggaccaagaagtaggctggaataatccagcaaggtgaagtggatgcctgatctggggtgaggggtgggtagagaaatgggagtagggtctcacccaactctcaactcccagagttacccagtttgtgtctgcaactctgacctttctctgcactgcaggctcaaatgtgcaactccctatttgacaggtctgcttgaaaacttgtgggcatcccagaggtaacataagtctatacagaaggtttgattttgtcctccaagccagttcttcccttgactttctacatttcaccaaatgataccccaaccactcacttattctagcccaagatctaggagttattcttaagttttcctttccccctccatatggatccatcagcaggtcttgtccttttctcttcccaaatatatctcaagtccatgctcttccgtctgtccctactgccaccgtccaagctctggggccatccattacatggacaactgcagtagattccagctgctctcctgcttctgttcccacccttctgcaattcattttccacagaacagctaaagtaatttcttaaagcataaatcatgtcactcactcactcaaaaccttcctgtcctcccactgcacttggaatgaaatccagattgcatagtatggccctcgaggctctacatgagcctatatgatccctgcccacctctctgacctcatcttccatcactttgctctggtcccctcactgcctttttcagtcctcaaacaagcctggatcagtcccacccatggaccttggccgttgctgcaccctgtttgagacactcttcccttcgctcttcgccaagctgactccttgtttcggctggatccttgtgcttcatagagaccttccctgcctacccctctccagaataacccacccaggtcccacccacagctctctgtgccttcactgcacttagcactcagatgatcttgtttgtttgttttattcattgtctctcttttctagaacataagctccatgatctaaaagacgttatctgtcttgttcaccaatgtctcttcttattcctaggtatatgcctgacaccaaaactatttgtcaaataaatgaatagctctgtttggccaggtcatacattagtagagtagtgggaactgagtagaaagttcaggggcatctaagaaatgtggagttgtttaaactgattctttaattctccagtctctaaatagcatgctctttgctacctattgattgatttttcagcatgacacattatctactgagctcacagtatggaaaccgaacacgtagttctcttttttaccctaccccaacccctgcctctccccatttcagaatcatacatttcctattatttcccattttcccattttctcatcttctcaagtcttttttttttttttgagatggagtgtcgctctgttgcccaggctggagtgcagtggcctgatttcagctcactgcaacctccggctcctgggttcaagtgattctcctgcctcagcctcccgattagctgggattacaggcacctgccaccacgcccggctaatttttgtatttttagtagcgacagggtttcgccaggctggtcttggcaatctggtcttgaacttctgaactcaggtgatacacccacctcagctcccaaaatgctgggattacccgtgtgagccactgtgcccagccccaacattcttatattgtgtttttgattttatcagtcatccatgtaatagcagaaatgccaacgatagctaaggcttgtggtaaaccacgatttctttttctctcctgcataccttttgtttttcctactggtgtttttgttagcttgctaagtgtcctacataccatccccacactttctcttgttatgtatttaacgaatcgcttctcaatatgttcaaatactcgagttattcttacaggttcatctttaagagcttcatacatagcctttgtcctcttcccatgtggactggattttctctgagcccactgtccagctgttgtcttgggatctctcttcatcacaccagggggattccttccactttcctcttgcattgaatcttcagattgctggatcccatgccccctttttttttctgggtctatttccttattttggcagagcacacagggtgcttcttgagaaaagctcacggggtgtatggtttttgagtctttgtattagaacgtggctttattctggcttcatgcttggtcgagagcttggctgggacataaggtagcaaagcagacttgctgcagtatgcacaaacactgccatccctcccaattaatcaggatgaacgttttccttttatctggaagacttagtttttctctttagcagatagcttttaactgatttcaaaagactttcttgggtgatggtcacacaagatctcaactttgacctggcttgttgcaatggtctaaaaaatattttatggacgtttaaaagttttgtggtacatagactaatttaaaaatgtgtttactgtgataataatgtgctggcattttttaagaagactcacatttaagatctacattgaataattgtggtattcctgtatttttctgtgtttttattttagggatgcgtcatctttatgggatgctcgttctgataggatcctgggggtattacaaactaccattgatatttcacaaaagtgcccaattgtgaaactcacctagtgtgcaaaatactgattgctgggtcccatattataggtcagcaaaatcaaagtcttttggagaggggtctcagagtctgtgttctcaacaaacattccagaggattcctaaggtgagaaacatcttctggaaaacaaattataggttagtggtactgtacagatggtcctcaacttatgatgggattacatcttgataagcccatcataaagtaaacaaaaatagtaagtcaaaccatggtaagtcagggaccttctgtatttaaattaaaaaaaaaaaattctcatttgaatctttatgtgtgtctttctctttacttgaggcaaaagttacaaaatatccagttcagagactcagatgttctgtacacaaatgccgggatgaattgggtcattcatatttactgttcatgagcaaatattcctattgtcaagtagaatgttgagattctgatggaatattattgccagaaacctgtttgcttttatgtacattttgttaatattataagcagcaaaatgatgcatttcccacaacaactaggtttgaagtaaatatatagttacattcgaaggcaaggaagttatcagcagaatgccaattactgtttaggaaaagaccacagaatttcaactcgttgccttttcaagaagacctctgtgaacttcatctggggttgctgcatactaattacttaacccaaaaccaaagtcaaagaacagggcactagatgaaaatagctgtttaataatgagaaggaagaactataagaaagatttttgtaaaatacatttctgaaaaggaggctgagcccttttcccttttagaactgtaggcggcaaattctgaaaattccaaaaggaagcaatcatttatttaagacttctgttcatgcattctgtcttggataatgtttggctttttattttcgcctctgtttgtacttcaggcatcctttcctttcaattgtgtgcctatttgcagcccattgcccactgtgaagtaaattccattcagtcttaattggggtctcttaaaagctttttctaaagaatttttcagcctccctatggaaggccactgttcgttgcctaaggtgtttcagggtgtgctgagcattccctctgaccttccttcttgtataaagatgtttctgacaacagctgggtggctcacaggactggggagggcagtctaaagggatgattcaggattgcactgatcaatttcatctattataaagggattttgtgtttttcaaaatttcttctgcatctgtaaagttagcttgtgttgacctgccaacctgtttatgaaagagccgggtgagaatggaaacttggaataaaccagaacaagttaactgagctcatgccgtgggttcctgttggcctgactgcgctgtttcattttcctaaaggcctctaaaccagaattgtatacatctaatgttctgtcgcttggaaagtacttgactgccaattttttaaagaaaacatgaaaagaataaaatcaaacatgagatttttagaagaatttagaactgtacacttttaaaaaactgaatccccttcagtcatccaaccacagaatgtcagaacacacgtatacctcattttccaaacaagaatgttttaatttaggaagccattataaagtaatcatagcaaaatccttcaaagaacttttctttttccttctttcaagtgggctgaggtggaggtgaggttgaaagctgtgtgacattttcactttaccttcgacatgttaataaataactttgcagataatagtaaatgtctgtacagtattcgtctgctaaggctgtcgtaacaccataccacagactgagtggctgcaacaacagaaatgtatttcctcactgttctggaggctagaggtctaagatcaaggtgtcagcagggttagcttctgctcagagcctctgtctttaacttgtagatgtctgccttccctctgtgtcctcatatggtccatcctctgtgcccacacacatctgtgctcaaatattttcctcttataagaaccccattggagtagggcccacccatatgacctcattttaccttaattttacttttttaaaggacctgtatttaaatatggtcccatgttgaggtactgggagttaagactttaacgtatgaattttgagggacacaattcagcccatagtagtgtcctttttttgtttttgttttgtttttatttttttgagacggagtcttactccatcacccaggctggagtgcagtggtgtgatcttggctcactgcaacctccacttcccaggttccagcggttctcctgcctcagcctcccaagtagctgggactacaggcacgcaccaccacacctggctaatttttgtatttttagtagagacggggtttcgccctgttggccaggctggtctcgaaatcctgacctcaggtgatccacctgccttggcctcccaaagtgctgggattacaggcatgagccaccgtgcccagccccttttttctgtattttttaaataggccatttaaggactttaagcaatgtccctaaaaccaatgtacaaaccaggacttattagcaatgtcccaaagcacactgcatccattgtcttttttctgatttttgagtttcatttcttaaccaattaaggcctcttccccactcacctcaacagtgccatattcatattacttgagtaagaggaggcattgaaggtgattttcagcaatggaaattaaccagtgtgactaggcagtacacttaggaagtaaagcataggctgtagagcatatggggtaaatttagaaaatggaatatgtgttcatgaccagcctgggcaatgtggcgaaacccgtctatacaaagaacagaaaaaattatgtgggtgtggtggtgtgcacctctagtcccagatacccaagagtccaagatgggaggatcacccgaacccaggagatcaagcctgtggtgatccttgatcacaccactgcactccagcctgggtgacagacagagtgagaccctatcttaaagaaaaagaaggaaggagggaaagaaggaagggagggaagaaggaaggaaagaaggaaggaaggaaggaaggaaggcctgcgacagggagtggggagggaaggaaggagggagggagggaggaaaggaaggaggaagaagtagaaggaggaaggaaaaaaggaaggaagggagggaaaggaaaggaaggaagaaaaaaggaaataaataaagaaagaaatggaatatgtgacattatgtttctgccattgtgtaagaaatcaataccagtatcttgtgattggagcaccaaattgatcgagtaatgttcaggaaagaaacccccaaactacttatcaagatcctaatcccagtgtggtcagtaactaatgtggccacctgactggttttataatcttctttgagggccctgaatgtgaagccctgtatttggagaaatgttttgttctcaaatgtcactacatatatagtcttccttttctgtgtttggttttgctggctctgtatgctttcattgtcttagatgtgtttgaaatccgcagggtgacatgtctcttttcaaagagctgctaaaataagaaagaaaatgaataagcgtgttaaagaaagatggtgtttaaacacctgtcaaagtaaagtcagaacaagaatgttcttgccagaaaacgcagagccccattgagacaggttggtaattcgaagatgattcattacgactaactgcatttgtattctagcccatatgcattgtaaaccacctagcaggcttccaatgatgtcttcctatcaattcgtaaatctcacaggaaacttttaactggtgcagtcagttttggtggactgcttatcttgtcaacgtgaagataatgcttcaacagcacacccacctcctctaggttcaaaattccttattttattgaaaaaggtccctcaagctggttaagcacacaaataagaattgggtgcatcagaatctagtgaccctaggtccttttgtaaaatgattaaaactctccttaaacctcagaaattatttaattttataggcatctcttggaccaggaattgccttgagatggcgagatacaagcattctacaaaggctgcaaacaagactcacttctcttaggccctgatccgaatccagattatgatggattgggcatggggatcagggcatgcagaagctcttagccaaacctctacaccctttagttgtgactctgtcattgtagacttttaaggcatcttgcagattagaatatgctgagcactcaatctgaggaaggttaaaagtcatagaatattggtgttcttccaagttgagaacagaacacttggatccaagaccctatttcagattcaacattcaataccctaaggcataaaaatggcgtcttactatagacagtggaaataactgataaggatttaattaattgcttgtggttttgcagtgccagtccaggtttattttcattgctgggcactgcagtcctagaggcaaagggaatgagcataaggttcctgctagatctttaaaagggaagggcagaataaacagagggccctttgataatgatttcttagccagtccagtggataacatgagtctcataatcaagaatcctctgggactttgtcatctacattgaatttataggtggtctttacttaaaatatctgaagttaatggaatcataaaacagatctttcttttctctttagattgtgacattaggcacatgtggaaacaacagtaaaatgcaacttcctgtgtttagcagccgtagcaacacatcttatacggtgcaggatttttaaaaaccaaaaggaacaacaatttgtatctgactaaatagcgcctaatcagtttcaccttgatttactaagcgttgtattaatcaagtaagcaactggccttttctataaaatagttttatgtttgttggtttgatttttaaaattttttattttttgcaggtgcaagcataaaaataaaaaattcgcaatttcccagctggtaggaaatagagccacgtccaactcttagctcctctctcattcttgtatatgatgtcaaccttcttgcttagtttctttccttaatccagggcatttctgctatagagtagtggggatttccctcgagtcttagttggttttagcagctcccagcaattatcttgagaccaacggagaatgcaggtaactgttttgggtgggtatacaggagtttatttatttcagggggcatttttgttttcctggagacctctagaagaccaggaaaatatttttccaagaaattttgctgccccaattgctccaaatcataaataacccactctccatttttattccccacaaaacctcttatcagcctttttccacttgcttacatgtattatctctattaacagtagccacaacccaaatcatgaattgtattaccccattctacagatgaggaagggactctgaaaggttgaattacagacctaaggttaccagctaggatggggaggaacagattattacattcagatctttctggcactggaagcccatgtttttcctttgcagtactcacaggtctgtgtttatatttaaatggctatttcctattttttaagcatacgcaaagtcatatcagggtgacacatagctaaagagttaaacaaaacaaaccattttcttctctggaagctttagtgtggaaatacctaagtgtcagccctctctccacttgtgtttgctccccttagggtactgttctaacaggagatatttgcttcacagtggaaaggtgagataggagaggtggtgtgttctgtttaaattggaataaaaacttgttgctggctgccagtcttaaagaatgattcctcgtcattgaacatgttacattgtagagtcagatgtttgccaccacaacactgggctattatgcaaggtagttctaccttgtagttccgatatatttagttaattgaaagcctaaaatattgccacataactgaacatctgtcataatgctatattatcaaagaatttaatttcagattaaaatggttttatagttttctatattgttccactgttttctaagagattcacattctcgtgtgtgatgcctaaagagaatggaaaaaacaaaagcagtttggatttagttccaatttagttaggtaacttattttcttgtttctttgccatggaacaaaattgcttttctggcttccccaattaggagaaagaaggttaagactgaagaaaaatctgagatgagaaagaaggaaatgttaacaaagagagtgctcttgaagaaattaattttcaccactcatcaccgggtgaaaatagaaacttcttaaaagacaatttcacatataaattattccagctgtttttcaattatttgtctttgatgaattgtctttcaattaccttgtaaagagcaattaagtgtttgcttacctgaaaactgtgtcagcaatgtctgtaccattcttatgagtgttaatcatccttcctgctggctctgatattttcccaatttcaaacattagtgtttgttatattatctttcaaaatatttggaattctacaggaaggcactgttggaaacaatttcctctgtgaaaaatctaaagacctgctaaaataaatcatagcctaggccttgtaaattattgccccacatttacccatgacttattctttttgtaaatatttttagggacctttttgtggcctaagtacagtataggggcaccaccaggaataaaatcaacttgctccctgtcctcatgggactcctaatctagtggtgagaagtattattttttcttgcttctcagagaggtagtcttttttttaacctactcacttaataacaacaacaattaaaaatcatttttatggtttctgaaaacattggtgaattgcaactggctattctgaggttctgttacgggctttttcccatcattctagaacatgttcaatgtttcttcagaccagtattgaaaatctaaataaaaattatattagaaaaggattttggaataagctagttggtttgatggtgctctaattggattcagaggctttctgtgtgtgttttatccaaatcctgctggagcaactcattctctggaatgcttgcttaacacacctgtcattttaaagaaagaaaccaaaatagaacatctcgcaagtggggcatcctcaataactatgttagaaaaagtataaaatcaatgctaaaggcatcattattataaaattatttttttaaaaagcaactagtggaattgtttctctcaagagaattaggtgtacaaaccaaggaatgttaatcttttgcttttcagtggcttttaaatggtttcctgtttaatttgcataggatatttctaccttttaggcaatgctatgaaactagactaaacctctgtagccctcaaacaattttaccctgaattttaactcataatttggaggccatcttgtgctatgtctgccgtgggaactaatgccacagtaccaccgtgtgagcctctggggtcccccacatttcctactcactacacactgcaggtctacgtttgggtggatggttgtttgactaatgtcagcctctctcatggcctgcaagcctcctaagggcagagatctgatctgtttttgcttaccattgtagcccttcctctataatagctgctcagttaattgtgcatgaatgtttccgttccacagtgaacacacttttctacagcctcattatttttgcagatatctccttcctcctctcccttggattgtccgaaccctgggtctccttggcaacactgttgccctggtaattctcttcaatggtggctctgttgtcctttacctctcctatcacagggggcgctgacattgcatcaactccccagtgctattccctgctcattttgcgtccagtcttgtgcatgccctcatctgaggtaggtgccgtctgctgagttttccttcacatttctttggtgctgtcatctcctgacttcctggtcatttcctcatattcactggatgaagttcagactctccctctccaccccaaatctcgctatgacctgaaggaattcagtccccatgcagtccccgtgtggctggtctgacatcctggctggtgcagctctgcagcccttcttctttcttgcatcttcaacaccccgacacccagggctccttctcctcagcccatgaacctgcttgagtgtccttcacactttatgaacttaaaacaaacagcaaacaaaacctttttctttacttgttcattctcaatgccaaaggagttcaacgttctttattgtgcaaagcccacttgctcctaaatgtaatcattctctaggagtttacccctggtcctcaacagctgcttttgtttagaagactccaccaaataacttcaactccagcttcttgctagagtgccagtaatgcatttctgactgtccgttggacatcttcccttgaatgttctgccagcacctgaagttcatggtgcctgaatacaagctaaaggtctctcctccaaatcttctctcttcttgacatccagccatacccttgtagaggttcaggccatggagttctcaggcagttcctcagactcctctcttctttctcctcagtgtccctcagatcatccatcatttccagtcccttttcgctccttctctccaagttcagatgcctgggttgctgcagtcatctcttaactgagctataaggacgtaaatctgggagccttggggactccgtatgactaattgacataaattcttctccatgggatggatctcccagcatcctgttttccatagtacatgcctgcaggtttcatgtctgccttggggagattgtccgggatactacatgtggccacggtctctccacagataccggccttggggaccctgtatgactgccaggaggctcttggacatagagagaacgttagtcacattatatatattctctgggcttttatttatccaccagcctttcgacttaaatatattggtctagatttaatgtgttattttaataatatttgtgttacattcatcctcaatgggaattttttcataattttgtctgaaacaaaatttagccccttacttaaaaactgtgatatttcagccaggcgcggtggctcatgcctgtaaaccaaacactttgggaggctgaggtgggcggatcacttgagcttaggagtttgagactggcctggccaacatggtgaaaccgcgtctctactaaaaatacagaaattagcaaggcatggtggcatgcacctgtaatcccagctactcgggaggctgaggcaagagaatcacttggacccaggagccggaggttgcagtgagctgagatctcaccactgcactccatctgggtgacagaacgagactccattgattgggggcagtggggagggggggcgagaggagaactgtgatatttcagtatattttatttcacaaattatatataaggtctaccagcttctcccctaaagttctgtgctgacgcacattcccagcatgaacagggtgatcattatcctatcatggatgagttgaaattctttcacttggcagattgtccattggggatatatcagctttttcttccttttcacaaacacagcacacactctacacaccatgacctgctccacttcagactccgggagttgttgtatatgactaacatctacggggaacaagataggttgttggttgattcctgtcacgtttttcctctctgtagcgacatcttgctattcctaagcagtcatcctatctgttcatagagacaacccttcccttgtagcgataacagtggcattcaaaacgtaaaatgcttttatttacattaaaattgatttttccattagcaaagtggccctttgcctactcaatcagaatttctgtaaaccccaaataagagcgactttatttaatctgttaaatatcctgtagcaagtctaggggatgttgttcatgtcagtgaatcaggatgtcatgcagctgcacaaacatattcgttctgcaggcctgttggccacaagtttaaactctggaattctctgtcagtgcttgcaggcagatggaagtctttagtagcttttccctctgggagtttaaaaataatgtctgcctctgttaaaaaaacaagtttaaaaattgatagtatcaaacttctaaaattaatattatgataaataaggattctgtacaatcaaattactttagtcagtataaagtatagagtacactgcctgccgccagcgtgaaattaaccgtgatgacactgggcattgttttagacagcaaaacagtacctaccctaactccttggattagcccaataagtggctgggagttgaattgagttactactcattagggtttatctcttgccttatcttaaaataaaaatccactcccacccactaccctcctccccatttttgtacagggaatacttgggaggtaaactccctgagtttaaatcctgcttaccagctgtgggatcttgctagttgcttggtctctcagcctcaacttcctcatctataaaatgggaatactaatagcaactacttcgcagggttgtagtaatgatgaaagaggcagtattgataaagcacttagaacaggtcctttttttagcataataaaatatcaagtaatagaataggtcttaatgtgacctacaagactgatacactcagcacaaagcaatatgaagtcatagaatttttaaagttggaaaggagcctagagatcatttaacctagtctcctaatttcagcaatgaaaaattgggatcctagcacaaggtcacagggctgattaagtagcagagttggaactaggctccaactctcttcttggcttacagtttaccatcccagttgggtggtcaaaacccagaacaataacacagatttattgcttgtcctgattgtgcaatgtcttctttgcttttttttttttttttttttttgagaagggattgcagtggcatgatcttggctcactgcaacctccgccttcctggttcaagcgatcctcctgcctcagcctccagagtagctgggactacaggtgcgcaccacgacagctagctaattttttgtatttttagtagagatgaggtttcaccatgttggccgggatggtctcgatctcttgaccttgtgatctgcccgcctcgtcctcccaaagtgctgggattacaggcgtgagccacggcacccagcctgcttttttgttttttacaaatagtcttactgctattttagagctactaggagtgttgctggttcaccatgagtttagctatcatatgccaatggagacagcctggtatagtgggaaataagcctggatcaggaatcaggtgacctagactcttatctctttcactagttaacaatttgggaagccagatagccttcctggctcccagtttccttatatatagggctttaatatatagcataatgtgaaagtactaaacatgatagttgtcccatggtggataacactgtaacccagtgcttttataaattacattgctcagaactactgagtgctctaatatgcattgtaagaatatatatacaacttttttttttttttttttttttttttacagaaaataaactactgctctacctttaatcttgcttcggtgaaattctaatttatcatggcttcagggcaacatcaaaagatggtagagaagtagattagctttcccagaaaccaagtaagggaaaaaagtttatagatgaatctcacagacattcagtgaaagaaatacaaaagattatattgtgtaattccactaagttaaagttcaagaagtgataaaacaggccagggcacagtggctaacacctgtaatcccagcactttgggaggcccaggcaggtggatcacttgagtccaggagtttgagaccagcctggacaacatggtaaaaccctgtctctacaaaaaattactaaaaaaaaaaaaaaaaaaaaagaacaggtaacacaaatcaatgctgctggaagtcaaaatagtggttatctgggggaatagaggtgagagggtggtattgatttggaagaagcataaggaggatttctggggctttggaatgattgacactttggtctgaatgtgattgtgagtgcaatatcatttacattctgtctgtatgcctcgaaaaaatctttttggaaaatctccatagtattaattttaatgactgtgggaacaactgatcttatcccaactgcctttagataactttgtagtttctttcaagtgatgggggaatggaaattggcaaattgggaggcatgtatgaatagcagggttacgagcaatcttcctccagagcgactaaaatcctttcaatacattctaatatagtaatgttttcacattctgttctttttctttaaatttaatttcttgcttacattctgttcttttactcttagggatttaaaaagatgatggcaaaataatttttcaaatacttttgccatgattattaccttaatgccgattatttttaaaggaaccatcagctgataaaaagcaattttcttctgagccaagatcttttctaactctaaaattctattattttcagatttttaagtgagggaatacatttatatatagaaagttcaaaaataatctaaaattttagattatttagatatttagatcgtttctttaaaaatttttacatttaaccatttcacatgttcaaggacatgactataaatttgttttaattttttcccataaatatgtatcatatgtctctgatgaacacagtactgataatgagaaaatttttcttggcattactttaaaaggtcagccagccttgatttattcacttcatggtaagtccatcatgggtgtgtgtgtgtgtgtgtctgtgtgtgtgtgtgtgtgtgtgtgtgtggtggagggatgtttggaatctcttctttgtgtattgtttacacagtaactgtggatgtatacctcctgatgcgtgctggagctgggcccattgtctaccattttgcaaggtgttgaatactacttaccttatctggatccatcatgtgctaaaaagtgttgaaacagccatttaaatgttctcttacttatagaatactgggaatggaagtattagtaaagggagaattttggagagaaagatggccaagtctgaagtatattactttccaaaactctttcagctgaaatctttactgttggtaaaagacagtaggcaccgaggccccttcgagcggacttcctcactcctaagaaaaaaatctttatcctcatttacctccatgatagcgaatgccacattttaaaatataaacttgattttagaatagttttagattcgcagaaaagctgaaaaaatggtacagagagatcttatatcagcatgatacatttgttacaaccaaggaacaaacactgatactattcctgttaactaaactctacagttcattaggatttcagtagtttttccctaatgtcgtcttttttttgttccaggatgcattcaggatgccatgttacatgtagcagtggtgtctccttaggcttctctggtctgacagtttctcagaccttccttgttttgaatgaccttggcagttttgtttttgtttttgtctttgagatgggatctcgctcagttgcccaggctggagtgcagtggcgcgatctcggctcactgcaacctctgcctcctgggttcaaggatcctcctgcctcagcctcccgagtagcgggactacacacacgctccaccatgcccggataatgttttgcatttttagtagagacagggtttcactgtgttagccagatggtctccatctcctgaccttgtgatctgcctgcctcggcctcccaaattgctgggattacaggcgtgagccaccgcgcccggccttgttttatttttgagacaagtctcgctctgtagcccaggctggagtaaagtggcgcgatcttggctcactgcagcctccacttgctgagttcaagtgattctcctgcctcagcctcccaagtagctgagattacaagcgcctgctacaaagtctggctaatttttgcatttttttttttttttttttgagacggagtcttgctctgtagcccaggctggagtgcagtggcgcaatcttggttcactgcaagctctgcctcccgggttcacgccattctcctgcctcagcctcccgagtagctgggactacaggcgcccgccactgcgcccagccaattttttgtatttttagtagagatggggtttcaccatgttagccaagatggtctcgatctcctgacctcgcgtgatctgcccacctcagccttccaaagtgctgggattacaggcatgagccaccgtgcctggccagaccttgaaaattttgagatgtactggtcaggtattttagaaatgtttctcaatttagttttgcctgatgtttcccttgtagttactacagggttgtgggttttgaagtaccattctccttatatcatatcaagagtacatactgtcagcacagcttatcactggtgatgtgaacctcgatccctggctaaggtcctgtttgtcagcatcttcaccgtaaagccacccctttctcctctctttccatactgcactctttggaaggaagtcactatggatagcccacatttaagcagttaggagttaagctccactttcttgagagagggttatgtatataaattatttggagttctgtaaggacttacctcttctcccacattcatttattcattcaatatttatctatatgagtatggatttgtggatgtttattttatactttgggttataatctaatactataattttactttgttgctgagattattccagctttggcctttggaaactcttgagtgggctcctctgtccctttaacctacctcctcccatcagtttgctttttgagcactttctgggactacaagatgttgcagggctcatctggtgttttccatgccccagctcttgaagcagccttttctgtaaggaggtggtgcttgcctattggagaatgctattagaaaccaagatctgtgcgttgggcgtgctcattgctactggggtgttactgcttctaggccttctgagaggacagagctagcaaatacatgtgtgtaagcaaacccatgcatatatacatgtctataattcatttacttatctatctgtctacctgggcaaacacgggttcatgcagatgtctccaactctcatcagggctgcatggatcattctagctttactctctcgcttatctgtaacttctctctccagtagtgagaaacctggcttccaccatctgccactcccgtacttccttgtttgatcccaatatacatgttcagcagtttcagaatttttaacctgcaccccgtgtgatgccacacattttgattcttctgttcattttctcttctccatttgccatttatcttacccttaaaaggaagatatttgacccaatctgctgtaaactctgattagcaagagagtaaggaactcctttagacaacggaaggcaaggatagccacttggctgccttagaaaccatgatccaagctcatctgtgatggcttataccatcacttcaccctgacctcatcactggcttataccatcagttcaccctaaccagtagtgggtagcttctgtgcccagatgttgtacatccgcccttgtttaatgatagcatgtatcttaagttattgtttcaattgagagagagaaagagacctcatgtaaatgtaggtaataaagttaaatcttccctaagcactgttctaatttttctttgccatatgttctgtggcttttaaaggggaaagtgacagaattataatggaaatacaaaaactgtaatagaaataaaaatatacacagataatcttaatattgtaaaaacataataaagcacaaaaaaataacaaagcctggaaaccatattttaaggaaatagagtttgatatccttagtgttttaactttcttaaagcatacacagcagagtgttatcaaagcattgtttaccacacatgatttctcctagttatttttgctatgattgggcttcaaaaatgcattctcatcgaccttcagatatttaaggatatttggagaaaagttgagaccatgttttttgccacctacttttttcccgcagggcggctctcagtttgtacaaaattagtaccaggagttcttttatggagattcttttctaaatggtccttcagttacaacatttgtgagctggaatactatgccacattagtctcagtttctcagtgcctgaaataattatgtgtggtgaaaaattaatatctaaaatgtcatatctattaaatagtataaacatacaacaaactctattaggtagaatcaatttttctaagaatctctataatttatttatcaaatttcaaagggaagactattcaaacctacaatttatttcatatgtatattagtctgttctcgcactgctgtaaagaaataccagagactgggtaatttatgtagaaaagaggtttaattggctcatagttctgcaggccagcttctgcttagcttctgggaagatctcaggaaacttataatcatggcacgtgagtgaaggggaagcaagcttgtcttatatggctggatcaggaggaagagagagagggaggtgctacacacttttaaacaactggaattcatatgatttcactcactatacagtatcaagaggggacggtgctaagcaattcatgaaaactctgccaccatgatccatacctcccaccaggctccacctccaacactgaggattataatttgacatgagatttgggtgaggatacatttctaaaccttatcaatatgataattatctagcctcatttatttttggcttatatggtcacatttgcactgggactgcctaactgatacatttctgtttaaataaaaaataaaacctgtgtatattttctgatttcttagcaattggtgttgtggggaaattctgttaggggtgggcttgtttcagtgggaagatagactgagctgtgtcatttaaagtctctacatttgattagctaatgactgtatttcaaaatatgctgtgttttaaaatgtagaactcaagtgtgaaaaggtaagttctgatgaatgacaagttactcttagtaacataaaaatggatcaaaattaatgctgaaaacaatcaggaaattttacctttcatctgggatttacctggcagtttgttcttatctgcatgtaaatgcaaaattcaccagacttactgtgaaataatttatggaaagtttcaaatggattttaatggaaaactgatccacaagaaaaattatagaaatatcaatagcaatgcccagtgtcctgggtatctaaagaggagagttaatattctgcccatactactcaaaagcagatgacagtggtcctcacattcatgatttaagagaagtacaatggcacatcggccaactgtgccaacatatggtttctaattgcaaatatggtctatgataggggaaaaataggctgttcttaattgcttcagagggaaagtagaatttttatgcagcatcagggaactggatatgtggattgggagagaaagatcccatgtattgtaagaaaatgaaaactggacatgtagccacagagatgaatttgagatggaaacttttgtttctatgttcataataattagcccttttatattttacaacatttaagttgttcaaagttaagcccttccatgagagttcagcacaaagtcttcatgaagaagtaaaaccatactctcagttccccctgggtttgccctctggttcaaagagggaagttggacaggagttaaattgaagtaataaatattttgctcctttactctgaattagcttcaaaatcagtctgtcccctgtatctctatctgttgtgctatggctgaaagtagggttaggaaccactttcagaagaatcagttagcgtaggacttgaatctccaattttccctagcaatgcacagtgtctgcccatctctgcccagatagtacctgaaattagagtagacttcactagtggaaggaataggatttattccaatttgtgtggaaggagaactcataaggatttaggaagtggcatctattgattgtctgtcttcattcagtttgagattttcctggttcttagtgtgtcaagtgattttcgatggaaacttggacatttttgtattatgttatgtgactctagatcttgtttgaaacctttggttttaactggctttgtctgacacctctatagcaggggaagcagtgggtgccgccttgtcaccccgacatggaggtaaaaatcccatttctccacctgtcctctgttgacatgctgtgtatgtgtgtggggtgtccttgttactgttgggcacaggtagaatttccagatccccatgtggtctcccttgataccacagttggggtggtcttgttcccagtgtgcaatgatttggccacctctgtattagggggaaggggagagatacccagttattgctgggtagggctggatgtcacggcttcctacatggtctccactgacactgtggaagatgcttcattatcagccaccaggcataaaggtgctagtttcctgcttggtcttctctgacaccactctagtaggggtattaggggtccttttcagagcctcatgagggtggaaatctagtaactccattcagcctttgctggcatgcatggtcacaggttcttctatggtgctcggctgtagtagagcagttattgtctaaaagtttcttatgttgctactctgcccctttcctggttatgtggctagagagtgcagacgtttgtggtctgtgcccattggtgtttctgggttgctggcttccatgcttgttggcctttcgaggtttcttacttcttcagctacgagtctgggatatttgaggcaaaaagaaaacccaggaatctcaccaccgtgttgtttcttgggttctgaggtcccaggcttgtctaccttcccttggccttacagaattttcttacatttttatgtaacacccgtggttgttttttttagttgtatttagccagaggaataagaaaaagttaagtttgggctgcgtgtggtggctcacgcctgtaatcccagcagtttgggaggctgaggcgggtggatcacttgaggtcaggagttcaagaccagcctgggcaacatggtgaaaccccgtctctactaaaaatacaaaaattagccaggcctggtggcatgtgcctgtagtcagtcccagctgcttgggaggctgaggcaggagaattgcttgaaccaaggaggcggtggttgcagtgagctgagatcgcgccactgcactccagcctgggcgacagagcaagactctatctcaaaaagaaaaagtaagtctgtttcatcttcttggaagcagaagtccttgctcttcaatttttgtttttatttgttttactatgaccaatattatattaagaaagttgttaaaaatacagagaagataaaagaattggtatcacgcctcatatgcgtatctaccagctggattcaacacttaacattttgctatattttactttattgcacttttatccatctgccttttccatctatctatccagttattatttttgacggacatcagtacacttcacctctaaacacttcagcatacatgtcattaattagacttcactgtcagtttacggttttttaaaggtaaattttacaaaagtgaaatgcaaaaaattgtaaataccatttgatgagttttgggtaatccaaccatcgttgagataatttccatcaccgctatacgttccctcaagtttcttctcaggttatttctgcctccaagaaaaaactactgttttgattttttcttttttgccataatttcaagtgctattttattgatggaataatattatagttcatcccttctggcctgcttccagttctttgccattaaaatttgatagttggtgtaacataagtcattgctatcttctgtcagcctagaacacagtgcaagcaaggcaacttaagattttgtgcatttcttctgattaataaaatagtgaagacatacaaagacatgtttttatcacacacagtacccaaattttccacatatttcttgttgttagtgtagttatcagtttctttgaagctcaaaaccttttttgtaatagaagcaaaagatagttttagccttgtaaaaatagaatttagcttcctggcaccaaattttattttgtgaatgagaaaccatgattttaactacaccataactgtaatattcattactgagaatgtcagactagtctctggaggaacagcctatttcacaaatacttagaatactctattcctgtacaaaatattgatggggttgttgcagatggattcagctgtgttgcacagacactcatttgtctggccccatctataatgtaagtctcttgcttctagtctgtttccccagaatgattttctaagtgggctgtaatttctgattgactgattgatatgagggaagtcctaccagctgtgaaatgggacaaataaactttatgtgagattccaattagagtggacgtgcttaccgttaacagcccagggaccaattgatgatgtggttttattacaaccttttttacaacctttctctgtctatatctttctttatacagttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcaggtatgagtatcataacttgttagaagatgggataaattgtaaaacgttttaaaaggtagaaaattatgttttacagtgtgttttttcccagaaaaaaattaatccgtatttgaaatgaaattctttattttaagaataaaataaggatgaaacaacttaagagttctgatttgccttctttctatactgaccttgactttctaatatattcttatttaaaaatatatatttgtaaatttatataaaaaatggattggtgaggcgagggagtgaaatagtagaaaatgataagtggaaatgctattcatcaacattgtgatgacaggtatccatttttatatacacatgatgttatatatttagttagactatactatttatattaatatataaatatttaacgatttaactagtagactatactgctatacacataacgtaatgttaacggtcttgttcgttaattaaaacttttttaaaaatgtattttttgatgtatttattctttaggaaagattttagtggctatatgaaagaaaagttttgttatatttgattttagatttctatcatatccttaggacaaataaatggtctctgtcttaagagagtagaggcacaaccctattggtgtgaaaatgtttgattgttaatttagtttgtagatttgtgaaaccttaaaagttacattgcttagtgcctttcatatcaactcgtggacaaagctggctttaaatctcaggccagaattcagcccaatttaaacaagtgttagtgtgagtgtattgtgtctaagatagaaaagtgtttagtaagttcaacgttccccatgcttactgtccaaggcaatcccttcatcaaaattcctcactgcaccacagtctaatattgttagtggatgtacagggtcacagagcatatcttattggtctgtactaagataagaaccagagttttgttctagagctgtgaaatgaaattaaaaatactacacacaatgcaaggatatggaataggagcatcaaagctccccaaaaaagtggtctcggatgcatttgcagctatatagtttatttgagcattttatatttaacaagaaataatgataggctacctggaatttgtttcaaaataatcctggaggagtgtgaggtaggtaagattatagataaaggaagactggcaatgggttgttcaagctgggcaatgggtccatggtggttattattctcatttctctgcttatagatattggaaaatttctgtaataaaaagatagagaaagaagagaaacttggcttaagggaaaataatgctagtttggttattgggtcctcttcagcacctaagtggctttctgggttaggaggcagtgagaggtgagggacagggtgctgtgctgtgtgaggacacccggctgggtgactttgaacaggtcagatcagcctcagttttctcgcctgcaaaatcgggtagttgaatgtgctaaactcggaggtgcttcagttcctgattctgttgttggtctccagagacacccttacacccttgactccttccagtccctggctgggcatcttgttctcctctgttttttggttgtggaaggaacctcactggccttcttcaagtgcctccctctcacatgtgcttaagcattgggagaatctggctcttcacgttaccaagactacccaagatgggagcagggctccagacgtaacgtacgaaaacgaacataagatacaaaatggtgtatcatacattagtttttttcacattggagaaagatgtcatatctagaggaaaactgatatattcagttggtgcaaaagtagttgcgatttttgccattacttttagtggcaaaaaaccgcaattacttttgcacaaaactaatatttggatataaccaagagaaagttattttcttctttaaaaaattatctcaagcagtggaatcaagctgtttggatatgatcagggccatttgctgtctgataatcaatgaagtacaccttaggccagacccacaacatcttgaggtataaaagaaagttcatttcttccaagaaaagtaactcttctacgtttgtccttctcttaaactcctgggttggtattcacatggatatgaaccttattgtgttctgccgcacagcgataaataccacttttcctggtatgggtttctgttataggaattcttaattggtagtagataggatgtaacactaatttattaatgcattgtaatagcatgtttattattgtagtgggagttaagaagggtcccattcgtggccagttttggtggtccttgaatcagttgtattttggagtgctcattctacgtctaaaggacatcttgccctataaggcaggctgggcttatgccccagcttccagttctctggccttgttttaaagcagaaagtttccaatatcttcaactctgatttaggctgttcagtgtctggctgttagattctagggcaggagaatagatctcttttccgtccacttctctcagataccccccttcatttcttttcttctcctgcatgagaggtcccacgtaagctctaggttcttctatcccttccctattgttagaactcaaaatggcatttacatctttttttcccctacataatcattttttcccattttgctttgatttgatttgatttggtgggaggtgaggatataaacatccttcctttggatttttatatatgcttgtatctccccaaagctaagagtacaaatgccctgcctaaataaacacagttgtttctctaacttatcacagtgtattaccatcaaaaccaaacttactgaaaatctaacctatctctgctgcctctactttctttcttcccacattctcattccttttcccactgcaatctatctctgtgtcctgtattcaccgaggttactccaagcctccgaaccattaaatttagtgtcgttctcttattttcattcatttcaacctctacaacattttccattactgaacagtcagtcctgccttaatgtccaaaatacctcttccttaatttacaaaagctaccattgtcttgtttgtctttgacttctctttctctcttttgccttttctcttcttcttctcatcacccctaacccccagcaggaaggttgctatgtgccttagcccttctgttgctttgaatatgcacttctttcctatacccacatccctcaaactggcccaggctccagctgatgcccatgcacatctacccaagcacctgatgggtagcactatttgaggacagcatgttaactcaaaatccattcatatggtctaaatgtatttctgtggaaaacatgctagttgctaggcactgttctggaagctggtgttctgcagccaataagcaagtgaggttcctgccctcatggagctttcattctagacaggtagggtactaataaatgctatgatggacacagggagtgaaggaagagggagtggaaaagtactatctataaatgcattccaaccaaaacagatcccctgccaaccccagctatccttgttactgtagacatggcttcctttggcatccagactttgaaccacggagttctttgactcttctttctctcaccatcttctacattctatcagttcctaaaacgtttgatttattttctcctcacgcagagtctttaacatcagcctatcctgtcaattcctgttgtctagtcctatcacctaatgtctcaattagtgcaacgtagcttttttgctatgcttatttgtagctagctatagaaatctgtaggccactagagaagacaggaagaggtagggttctagcagcaagcttacctacgaggggaacctgacctagctggtgaggctgacaggggaggtttgggatgtcacaggctgtcaggaagccgagtgaccaagataatgactttacaagtatcaagcctggcaaatagagcaatgagtacttcactacaaaatggcacaagttccaacaggtagggtaaatctcagagcatccaggtgagcagtattagaaaattcaggcagtcctcagtaaccagggtattcttttctcaggtaggagtatttaggtggggcagatggtgtctgttatgggaatcagaaagacttgaacagggccttggtcacccaggctggtgtgcagtggtgctatcacagctcactgcagcctcaatctcctggcttcaagaaatcctcccgcctcagcctcccaagcagctgggaccacaggcacacgccacgatgcccagttaatttttgtacttttctgctgtacttttagtagagatggggtttcaccatgttgcccaggttggtctcaaactcccgggctcaagcaatctgcccacctcagcttactgaagtgctgagagtacaggcgtgagccacctcactcagtctatggccttatccttttttaaagaacaagggaatagagctgataagtaggacaggaacttaccaaaggactcaggacagaaacttgctatataaagtggaacacagggaatggatttggaagaggagtctcccaagatcctaagcctgtggtgctggagctactgttgctagaaatgacatagcccaagagctgggtgagcagggagaggagggcttgctctggtcagcagcagtggcccaacatgtgtggatctggggacataggtgggcagagcacccgtctcccctcttgcccctccatatcctcttggataaccaccatcaggaaacattcctcagatgggactttgctcctgtcacttcttgctcaaaaagtgtgactgggtctgcattgcttcttcagtgaaacccagactcctcagctcttctcagtttaacccaaactgaccttatcttttctattcgtccatagctcttggacttcagtcatgctgggtcactggctcagcatgccccaagccttcttggtcccttggcttttcttcttgctctctcctgttcctatgagcacctccttcctccagctatacctattgaaatactaccaatcattcaagggtcagtaacatgtctcttcctcctgcagatattcttgactttgattcagcaccagctgatcctcctttgcctgtactcctgttaggacatgtttattttaacttgttttcttgtttaagtgtctgtcttatgctcctaatttactacgtaaagtatttaagggcagagactatcacattcacttttgctgcacttcacataggttctttatgtaataacatacatgggatgtaataaaaaaaacatgccttgaattgcttctttattaaatacccactgtaaccaaaaatgcagtactgggtgctttaggactttttttttttttggtgggggaagggggtctcattctgttcccccaggctggagtgcagtggcacaatcacaactcactgcatcctcaacctccctaggctcagatgatcctcccacctgagcctcccaaatagccgagactacaggcacacaccaccacactcggctaatttttgtgttttttgtagagacagggtttcactgtgttgccgggctgttctcaaactcctgggctcaaacaattcatcctccttggcttctcaaagtgctgggattacaggcatgaaccatcataccctgcctatgctttgggactttataaaagaaattgaagattttaaaaattataacaaattaaaatactaacaaaacatgtacttcacaattacagccatgtaccactgttaagaagccaataaaattggaaaaaaatattttcctatcttttgtccttatttaaaagtaagttatactcctgtataaagaaaatcaaggcaacttatcttcaataaaatggagacttttatttgtgttggtggtaatagaaaaagaatgcctgtctagatttttaggtagcattctaggaatcagatctttgattttctgaaggtactgtgtactccctaatagtaataataatggctaatttttattgaatgctgttaggtaccaggttctgctccaagaacttgattcatattaactcactaaatcatcagtacaacctcatgaactgcaatctttaagggctactattatcccagttctactgatgaggagactggggctagaacattcagatgacttgcccaagaaaacacacctggcagtaggcaaaggcaatatttgaacctaagcaatgaggtcccatagccagtactttcgaccattcactagttgcatctctaaaaggtgtcttcctacccacatcagaaaggactgatcactgaaaggtggctctaatatatggttttgcctcacacattagtttttgctgtaagaaggattttgtctgaagaattactttatttctacttgactggcctgctttcctcagtgcacatgtagaaaaatggttggcaaggatcaaagttatgtttggtcctattaaaggataatattctcttgtaaccatagagacctaatgttgctatttaggattattttccacatctagaaagtagggcgaagttaaaggatttgcttaaggtgatatttgttaaggattgctctggttgcattaataaatgacagcattttgattttgcttgtcttattccactaagaagttggaaagttggaagtgttttttttttttttttttttttttggagacagagtctcgctctgtcatccaagctggagtgcagtggtatgatctcggctcactgcaacctctgcctcctgagttcaagtgattctcctgcctcagcctcctgagtagcagggactacaggcgtgtgccattacgcccagctaatttttgtatttttaatagagacagggtttcaccatgttagccaggctggtcttgaactcctgacctcaggtgatccacctgcctcggcctcctaaagtcctgggattacaggcgtgagcaaccgtgcctggcctagaagtgcttttatttatcattcaccctcacatcatattggaggaagaggaaggaatctttcctttttcctaatttactgtatcagggagaagttacgtaaccagccaaaggccacacagcacatctagatccacagagggcttcttgctttgtgttcgacacttctttttttttttttttttttttgagacagagtctcactctcgcccaggctggagtgcaatggcgtaatctcactcactgcaacctccacctcccaggttcaagcaattctcctgcctcagcctcctgagtagctgggattataggcatgcaccaccacacccagctaatttttgtatttttagtagagacagggtttcaccatgttagccaggctggtcttgaactcctgacctcaggtgatccacctgcctcggcctcctaaagtcctgggattacaggcgtgagcaaccgtgcctggcctagaagtgcttttatttatcattcaccctcacatcatattggaggaagaggaaggaatctttcctttttcccaatttactgtgtcagggagaagttacgtaaccagccaaaggccacacagcacatctagatccacagagggcttcttgctttgtgttcgacactttttttttttttttttttgagacagagtctcactctcgcccaggctggagtgcaatggcgtaatctcactcactgcaacctccacctcccaggttcaagcaattctcctgcctcagccttctgagtagctgggattataggcatgcaccaccacacccagctaatttttatatttttagtagagacggggtttcaacgtgttggccaggctggtctcaaactcctgacctcaggtgattcacccacctaagcctcccaaagtcctgggattataagtgtgcgccactgtgcccagccaagtgttcgacacttctttgtcctcagcaagtgtttactgaccatcttcatctattgtatgtgatacatacaatatgtcaggaactgttacaggctctagggatactctcatagattttagtgacataaaagagacaatcttccttcttgcaaaaacttgcattctagtaggagaaggaagcagaaaataaacccaaataagttagatactgtactagaaagtgagaagagaaaattaaagcaaggaattggagtagagaatatgggagggaggttacagtttcaaatcgggaaatgttcctgggaaggtaacattgaaggaaaggcaggaaggagggaagggaaagcactgagagaatcctgggaagtcatcacagagttagcaatagcatgcactttcagtaatggtgtggacacattgtgattctaggcctttacaaattttgtctgataatgtaaccattaaaatgcctcacattcacgaacctcatggttgttaatctttttgttgttgagacaggatctcactgtgttacccaagctggagtggagtgcaatggagtgatcatggctcactgaaggcttgaccgcctgggctcaagcaatcctcccacctcaagtcccctgagtcattgggaccacaggcatggaccaccatgcctggctaatttttgtgttatttgtggagacgagatctcgctatgttgcccaggctggtctcaaactcctgatctcaggtgattctcccaccctggcctcccaaagtattgggattacaggcgtgagccactgcacctgccttggttgtcaatcttgatatctactgcagctccatggctcctaacaaattatggaacttcattctatacaattttaccagaagaggagcagggtttaactctataatataagcattttgttatggctttctttcttcaactcaaattcgcaaggcagattctgacccaccatcaaaccaaaagtcagaaagccaacctcatggagttccagtttagaatggcgcatatgttggtgttttctggtggacacagtatcaagtcctattgagactgcctttctaagttgaaataataatgcattattgcctctgtcttaagcaatccttaacttacagactggtggtgtctctggtactgcatttttagattatttggaattatgggtatgctcccaaactaatttacaaaattgagtttaacccataatacgcctgaagcctgggactattaatatttattcaaatacagccaaacactatttattgttactatagtaaaacactttcataattttcaattgaaattaagaatttttgagttgtaaaggatcttagccatctagttctctctctagggcaggaatcaaccctgtctccagcagccctgataacatgcagtcattgagcttctccctgaattccttattcccagctctaattgttgaggaggtttccttttgtgttggcctgaaacaaattatctccagtctttctaactatcttctgatgtgtgtgtgtgtgtgtgtctgtgtgtgtgtgtgtgtatctcctaattacattgttacatgatcatccttccatcttttctttaagtttgttcatccctttatctattgtcagtttcagagtttctcaccacaggagtgtactagattgtctaggtcactcagtttttatggagttcctggcccagtgcaggtgtgtgctagggacatggtcataaacaagcctgaccagttccctgtgctcatggagtccacagggtgcctgtgcatctggcagtacctcatgtgttctttcttagctatttttaatcctaagctaacatggtgacttttccaaaagttcttattatttctacttcaccaaccacattttcagtatttagaattaagtctagaatagaatttcatcttacttaaagaggaatttaccagtaagaattaagcatcttgtaaatgtctagggagctggaagttcccatgaaaactctctatcacttttctgcttatttaatgttctctttgtggaaaatatcacccagagcctcctaacagggtgatctgttttatttttttataacaatatattttctgttctttctctgtaccctcatgtggatatatgtacatatcatatccacatttcttggatgctagtttctccgaaagcactagaagtctctggcattggtttttttttctattctggccactgtcctccatgatatctggttttataccattttgtgggtgttttcttctctcttgaattcaactttaagattctcttcaataggccaatttggtgagcatcttcttggcatgtcatttttttcttaaatttttttatttttaatgaatgcataattttcgtacatattttggggtatatgtgatatttttatataagcatacaatgtgtaatgtttaaatcaaggtaattgagatatacatcacctcaaacatttatcgtttctttttgttagaaatagtccagttccactcttttagttattttgagatatacaatattgttagctatagtcaccccattgtgctactgaacactagatctattctttctatctaactgtacatttgtaccccttaaccatccctcctccccactacccttcccagcttctggtaactgtcgttctactctatctccatgagttcagtttttttgttttagctcccacatatgagtgagaacatgcaacatttgtctttctgtacctggcttattttacttaacataatgtccttcagttccatccgtgttgctacaaatgacagaattttattcttttttatggctgaatagtattccattatggtggaataatattccattgtgtatatgtactacattttctttacccattcatctgttgatggacacttaggttgattctatgtcttggctgttgtgaacagtctggcatctcattcctattttcatgtaatgaaccacatgtcttgtcaggctattgtaggactgttatggtccagaaagtcagatcttgtcttcgacaccatcagttgaaatggcttttcccatttctttatccactcttttcatatgtcatgatctctagccagaagagaagagaaccacatctcaccttccacgccttcctgttttccactcaggacttctgactagctagaccatccagatggcttctgaggaagacaattattcttatttttaaaaatcagtagaggagggtttgaggagttttgatgtgccctctttcatgtcctaagaaacacattgcaagaagacagcgttccttctgattagccaggcaggtctatgcaaggctgtcatctctagcactggcacctcatcaagagctcctcagtgaccacttttgacttttcctgctgggtctcatgaatcctccttgtcatccattcatacagcaaatattcactgagcttctaccctatgcccagattctgttctagagaaacaagctcatgaagctgctattccagggaagaaataccagggaagggtgttgtggggaaaatcagagtatacgtggagatcgagaatagcggtcagtgagagaagcaagacactgggtcggagtctctggtacaccacccttctctatcttacctactgctccatgccagatctacacagcacatcaattctccctctcctgtgtgttatcttttttctcctattaactcttgacaggacatcttggttttgtcaagaggttgatctcttggttcctattttttcctcaaaacatttctttttgtgtggctttcttaactgtataattcttccgtttttttcttttttctttttttcttttttttttgagacagagtcttgctgtgtctcccagactggagtgcagtgacatgatctcagctcactgcagcctctgcctcccaggttcaagcgattgtcctgcctcagcctcccgagtacctgggattacacgtgtgtgagaccccacttggctaatttttgtttgtttgttgttgttttgagatggagtctcactctgtcacccaggctggactgtagtggcacgatctcggctcaccgcaagctccgcctccttcatgccattctcttgcctcagcctcccgagtaggtgggaccacaggttcccgccaccacgcctggctaatttttttgtatttttagtagagacggggtttcactgtgttagccaggatggtctcgatctcccgaactcgtgatccacccgcctcagcctcccaaagtgctgggattacaggcatgagccaccgcgcccagcctaattctttcatttttttctagaaaacattcaccttttccagactagagcaaaggatgatgcgacccaacttctttcaccttcccttttagtgggaaagctggtttatatttatagattgcctcttggtggctcctctccaaggaagaaaaatagaggtcccagccccgagtttctacacagtcccagaccatggggtgtcagggttacctttggttgtttttggcagcccctcttggaaacatttcctgtaaatagcccctcaacaaactgggcctttaaaaatggggcttttttgttgagccctggtttgtgccagctatgtcaatcccttgacctttcagaaaacacaagtagctttttgacttttccaaaatgttttcctgccttgcctctctctttggttgtggccatgggccaatgagcctatagttcactggaaaatgtatgtattcattctgacagctccagtgtggactcctgagattcttcttagaaatagctgtggtgtggcatatgctggaggcagatgtacaaaggtaccatgaacaagttcactttctatggcgaatatgtgatcatgaccttctccaaagaggttatctcttggtcattcaccatgtgggtgtttcctctttgttttatatgtgtctgtgtatatgtgtgtatagtgctaagaattttaatatacgtatagttttgcataatcgctaccacagtcaggatatatcagagttctgtcactccccaaatctcctttgtgctgtctttttttttttttttttttttttttttgaggcgaagtctctctctgtcacccaggctggagtgcagtggcgtgatctcggcaagctccgcctcctgggttcatgacattctcctgcctcagcctcccgagtagctgggactacaggcgcccgccaccatacccggctaattttttgtatttttagtagagacggggtttcaccatgttagccaggatggtctcgatctcctgacctcgtgatccgcccacttcagcctcccaaagtgctgggattacaggcgtgagccaccgcgcccggcctgtgctgtctttttatagtcacgccttcccaacccctaacttctggcaactactggtctgttcttcttcaccatagttttgttgtttcaagaatgtcataggctgggcaggtggatcacgaggtcaagagatcaagaccatcctggccaatatggtgaaaccccgtctctacgaaaaatacaaaaaattagctgggcatcgcctgtaatcccagctactgggaggctgaggcaggacaatcacttgaacccgggaggcagagcttgcagtgagccgagactgagccactgcacaccagcctggcaatagagactctgtctcaaaaaaaaaaaaaaaagaatgtcatataaatggaatcattcagtgtgaaatctttggagactggtttcttccactttgcagagtgactcacgagagcttcctccaggttgttgcatgtattcatcattccattttttgttgaatagtatttcatggaatagatgtaccacagtttatccatacatgaaagacacatgggttgtttctagtttggggtaattataaataaagttgctataaacattcttgtgtacattcttgtgtgagcaaaagttttcatttctttagggaaaatgtgtaggaatgggatcttggggtcatatgttaaatgtgtgtttaactttataagcaaatgccaaacagttttccagagttttgcattcctgcaagtagcagagaaaagtttcagttgctccacatccttgtcaacacttggtattgtcattattttttgttgttaaggtaaaaacatttgtcataaaattcactatcttaaccatttttaaacgtgcagctcagtagtgttcaatatatttacattgttctatgaatagatctccggaactttttcatcctgcagaactgaaactctacatctattagccaacttcctttttgcccccccagtaacccaccattctactttctatcactatgaatttgactactttagatccctcatataagtggactcagatagtatttttttgtgactagtttatttcacctagcataatgtcctcaagtttcctccatgctgtagcatgtgacaagatttccttttttcaaagactgtgtagtatactacattgtttaaatccattcattggtcagtggacatttgggctgcatccatctcttggctattgtggatactgctgctctgaacataggtgtgctgtaattagttttatgttaaccattctagtaggtatgtagtggtattttgtcatggttttaatttccctaatgggctaatgatgttgaacttttttattgatacataatatttgtgtatatttataggatacatgtgatattttgttccattcatatactgggtcatgatcaggtcagggtatttaggatatccatcacctcaaacatgtatcatttctaccattggggacatttcaaatcctcttttctagctgttttgtaatatacaatacattgttgcaattgcagtcaccctactgtgctattaaacattagaacttatttatttgatgtaactgtatgtttgtacccattaatctgcctctctttatcccttcccccactgacacccacacacccttcccagcctctcgtaactgtcattctactctctacctctatcagatcaactgttttaaactcccacctatgagtaagaacatgtatttgtcttcctgtgcctggattattttacttaacataatttcctccagttgtatctatgttgctgcaaatgacaggattttattcttttttttttatggccaaacagcattccattgtgtgtacataatcatattttctttatccattcatctttgatggacacttaggttgattccatatcttggctattgttaacagtgctacaataaacatgggcatgcaggtatccttttgatatactgagttccatttttgtgggggtgagtacctggtagcgggattgctggatcatatggtggctctatttttagtttttttgagaaacctccatactgttttctgtaatggctgtactaatgtacattcttaccaacaccgtgtaagagttcccatttctttgaatcctcaccaacatctgtcattttttgtctttttgataatagccatgctaactgaagtaagatatatcattgtggttttgatttgcatttccctgatgattagtggttttttcatatacctgtttgccatttgtatgtgtttttgagaaatatctattcatatcttttgcccacattttaatgggattatttggtgttttgttgttgagttatttgagttccctgtacatacctcaacatattaaagcccttatatgacaaaccaacagctaacataatgctgaatggggaaaagttaaaagcctttcctctaagaactggaacaagacaaggatgcccactttcacctctcctattgaactggaagtcctagccagagcaattaggcaagagaaagaaataaaaggcatccagaatggaaaagagaaagacaaactgcagatgacatgattttatatctagaaactcttagatctgataaacaaattcagtaaagttacaagatacaaaatcaacataaaaatcagtggtgactcttttctttctttcattctttctttcgttcattcgttcttttgttcttctttctttcctttttttttttctttctttttttttttttttttttgagacagggtcttactctgtcacttaggctggagtgctgcatagatgcttactgcagcatctacctacagggcttaggtgatcctcccacctcagcctcccgagtagctgggactacaggcgcacaccaccacacctggctagttttttatatttttttgtggagacagggtttcaccatgttgcccaggctggtttcaaactcctgggctcaagtgatccaccagcctcatgagatttttcacagacgtagaaaaatttgtatggaactaaaaaagagcccaaacagccaaagcaatcctgagcaaaaagaagaaagctggaagcatcatagtacctgacttcaaaatatattacaagtctatagtaaccaaaacagcatggtatttgtataaaaacagacacatagaccaatggaatagaatagagaacccagaaataaaactacacatttacagccaactgatttttgataaaggtgccaagaatatagattagggaaagaacatcctcttcaataaatggtgctggaaaaagtgaatatctaaacacaaaagaatgaaaatagacacctatgtctcacagtatataaaaatcaacgcaaaatggattaaagacttaaacagaagacctaaaactatgaaactactagaagaaaacataggagaaacactctagaacatcagtctaggcaaagattttatgtctaagacctcaaaagtataggcaacaaaacaaaaaagcacaaatttgactatattaaactattaataaaaagtttctgctcagcaaaggaagcagtcaacagagtgaagagacaatctgtggaatgggagaaaatatttgcaaaatattcatccaacaatgaacttcttttcatgtacgcatctgccatccatatatcctctttgatgaagtttctattcaggtcttttgcctgttttttaattgggttatttgttttcttactattgaattttgagatttctttatatattctagatacaagctctttgttgtatatgtgatttgcaaatattttctcccactctgtagattgtcttttcattcttataacagtaccttttgcagaggaaaaatttttaattttaatgaaatccaccgtatcagcttcttttaaaatagatcatgcttttggtctcctgtcatgcctaatctcaggtcacaaagatttttatcctatgttttcttctaaatgtttttatagttttatgttttacatttagatctatgatcagttttaggatcatttttatgcaaggggtgaggtttgggtcaaggctggttttttgcatgtaaatgtctagttatttcaatatcatttgttgaaaagatcatcctttttctattaagttgcctttgtactgttttaaaaatcaataagcatatattgttcttccacatattctctttggtaaaagtcttttgtccaatttttactgagtagtttgttttcttaatgttcagtttgagagtattatatcttctaggttcaatgcctttgtcagatatgttacttggtgatattttctgccaggctctagtagcttgtctttccattctttaacagtgtcttttaagagcaaaggctcttaattttgatgaaataccattttttttctcttttcagatcatgcttttggtgtcatgtgtaagaaatttcaacagcatttgttgaaacgactattacctttgcacctttgttcaaaaattgattggcaacatatatgtggtctatttctggactcactattttattctcttaatctgtgtctattctttcaccaatatcacactatcttgattattatagctttataagtctgaaaattaggtagtgtgattttccaaccttattcttcatttaaaattgttttaactaatctagtttgtttggctttcatttaaattttagaaccaacttgtttttattgttgaaaaattactgctggggtacttttttttggctaggatttttatttaaactgcattaaatctatgctgcagtttgggtagaactgatacctataccatattgaactttctaatttatgaactggtatgcctctccatttgattagcttttccatttttttattagcttttgaagtttttagaaaacagttaataagtttatacttcagtatttgttttctttattttttagctactgtaaattatatatatttttaaatgtcaatttccagttgttccttgtatcatgctaccttattaaactcacttatcagttctagtagttctagtgaaaataccttaggattttctacatggacaattatgtcatctgtgaatgggaatcattttatttcttccattctaacctgcatgttttttattttttcttcccttttttcaccagctaggacttgtactacaatagtaaacagcagtgttgaaggagatatccatgctttgttcctattcttagggggaaagcattcattaagtatgatgttggtgtaagattttttgtgtgtgtttgtttgtttgagacggagtcttgctctgtggcccaggctggagtgcagtggcgcgatctcggctcactgtaacctccgcctcttgggttcaagcgattctcctgcttcagcctcctgagtagctgggactacaggcacgtgccactgcacctggctaatttttgtatttttagtagagacggggtttcactatgttggccccaggctggtctggaattcctgacaacatgatccgcctgcctcagccttcaaaagtgctgagattacaggcgtgagccaccacgtccagcccagttgaaggtttttatacatgccctttattaggttgaggaagttcctttttgttcctgactttctaagagtatttattatgaatagatattggatttctcaaacgcatttttctggatcaattgatatggtcatttcagtttttttctttagaccactattatggttgattacattggcagatttttgaattttgaaccagtttttgcatccttaggataagtcccactgtgttgttttgttttgttttgttttttgagacggagtttcgctcttgttgcccaggctggagtgcaatggcacggtcttggctcacagcaacctccgcctcccaggttcaagtgattctcctgcctcagcctccggagtagctgggattataggcatgagccaccacgcccggctaattctgtatttttagtagagattgggtttctccatgttggtcaggctggtctcgaactctggacctcaggtgatctgcccgcctcggcctcccaaagtgctgggattacaggcatgagctacggcgcccagccagccccactgtgttgtggtgtagtattctttttatatgttgctggattttattgaataatattttgttgaggattcatggtattgatctgtagtgttcttgcactatctttgtctaggtttgatatcagggcaacaccaactttatacaatcagttggcaactgttccctcctcttctgttcctggaagagactgtgtagatttgttgttattttcttcttgaaatgtttggtagaataaacagtaaagcattatggacctgaagatttctcttttgaaagatttaaatagcatattcaatttcttttatagttataggaccattcaggtgatctcttttaacttgggtaagtttaagcaggccctctggtgctttgaaatggaaaagaaagtgaaacttttcctctagatttctttatggttaaccaactgccttatctccttccataaagtctatgtgcaaatgctactttctcagtgagatctatctggattgttctatttcaaatctctcctctcccccagaattctttaaattaaatggccttgttgacatataattgatataccaaacagttcacccatttaacgtgtgcaactcaataggttttagtaatattcatgagctgtgaaaccatcaccacaatcaattttaaacatttccatcactctagaaagaaatcccatactcattagcagtcattccccatttcaccagtctcccagctctactttctatctctgcgggtttgcctattcttgatatctcatacagatggaatcatacaatacatatgtggtcttttatgactgatatctttcacttagcaagctttcattggtcatctatgttgtagcgtgtatcagtacatcatttcattatcaaataccaaacattccattgtatgaatataccacattttatttattcatcagttgctggacgttgggtttctttctattggcggctattatgaataatgttgctgtgtgcatttgtatataagtttttgtgtacatatatgttttcacttctcttggtttcatttctcttggttatatacctagaaatggaattgcttagtcatgtggtaattcaatgtttaacattttgaggaactgccaaactgtttttcaatgcagccacaccattttatattcctactagcagtgtatgagcattctaatttctctacactccagccaacatttattactacctgtctttttttattattgctatcctggtgggtataaagtagctccacccagcacttttgattactccttgtcttttcttttctgatttatttatttatttgagacagggtcttgctcattcacccatgctggagtgcagtggtgtgatcatttctactgcagcctctaactcctgggctcaaagcaatcctcctgcctcagcctcccaagttgctaggaccaaaggcatgcaccacaacacccaacttaattttaaaaaaaaattttttttcatagagatggaggcttgctcagctgcccaggctgggtgtccaactggcttcaagtgattgtcctaccttgacctcccaaagtgctgggattatagatgtgagccaccatgcctagcctgattcctcctctttttctaccttacttttttcattttccatagcacattttaccgtctaacatctataaattatttctattgtttgttatctgaccccacttcctagtagattataaattccatgagaacagggatttttgttttcttctttggtgagatctcaaagaaacttgtatagtgcctggcttatgttaaacattcagtaaatgtatattgaatgaacgaatgaatgaatgaatggctcttgatggaccttatcccatcctatatatggagcatttgcaagtgaatcttttcgatttggaaagtgctggatttggggtgaggggtagggaatgactgcttgttttcaatccttctttagtgttcataccactgagagttgcttaaaacagcctcaagaaaccctgaaaagccataacagactaaatgaatattttaccaatttagtgggtagggtggggagctattctctcatgaatggataatgaccttaagtaactgtgactgctctgtatggcagcattgcaaaggtcaatgtgggaacatctttctcagaaaggaagtgtggtgggggttgtattttaattcaaccatttgtgttcttgtgtatttcacaacaaaacctaatgagaccaaatgagtgctagaaattctgtgggcaagagatattatataataattttattacgtatgcttttaaaaaatatcgtctattattttcctaaaggtatataattgtgttaaaacagatttcctctatgtgctctaaatataaaggagactaattatttctccccttttcttctcccagtagaatggattttttttcttggttcaatctttttatacataggtggatggaaagactcattatggcccatctttttatttatggagcatttattattcattataggtctattctagtggtaaaacccatttatgggaaagagtaatagaatatgagtgctaactttttgtgcatttgtcataattgaagttagtggttttataaatatgggatgcttccaccatgggtttagaatagcccagctgcacaataaatggcctaaccatcaggtcctacctcttacagatcgataaaaccatgaaatctttttttctaaatggagttgaggagtctcccttgcttcctgtacattctggaaaaagtgggatattgtgtttaatccaagccgagctctggatttaaatgggttgcaccatagacctgactagtatctcaagtctcccgtcttttccagggggagttaggtttttctagtgaattcagataagcaaggcattttcactgagcattctgtgaaagcattctcaaatgagacatggatgctactgattttgctgatttctgattacaaatgacacattttaaaaatcacacacatagaatgaattgcagaattgttaacttgctttcccttttttttccatcacatttgattgctaagggggatgtggagaaaaggagcactgttcccacccacatcttaattaaataaggcctccattgggttgagacaaagtgggtttgtattgctttaagagaagatccgattgtttatatcccttgcttgggtggataatttcctaatttcattttcctttggagtggtgccactttaaacacttttaaaggtactacagaagcccttctggcctgggtcagagaattcatgtcaggaaagtccattattttatttcctttgcatattatttccctttgtggttttgttttgtctttttcatcctgtgatatgaatctggtccttatcactgagggctaagtcctggaaagtgactgttttttggcttacatattttcctgatttatttctcacttagaatataagatgcaatcttaatttttacttcttttgtgttaggtgtttgctcacctaggcttataacactttttgtccgaaggtttctccaactgattcccaagcctagactgtaagttttgaaattggtactcatgaagtttcctttattccaaagtataagtgtttacttagtacccataagacagggcgtaagaggctatatacaaaaatacaagataataaaaaaacatgattggaaagaagactagatattagaaaattattagaaaactgattatgcattatcgtgatgaaaattctttcttgtctgtttttcatttcagcatttatagaaatctatagtcctaaaatattttacaatttgattttattttaaaatccataatgtaaatttaccatcttagccattttaggtttacggttcagtagtgttaagtatattcacatcgttgtgcaacagacctcccgaactttttcatcttgcaaaatgaaaactctgtgcccattcaacaacttcccatccccccaccccaccacttaccctctgtaatgtttttttaaaaaaacttcagatgaatcaaatgcaaaacattattgacaccaatgaaagtttaatcacctgtgttaagtaagacagtgacatattgctggcattccgtcatcttttctttttgctgagtttttcatttcaattcaatgctaaaaagttcaaattagttactaccccatgaggcttgaaaatgttccctttggataatttgggtaatttctatatgtgtagcattgtgaagtaaagtagtttttcctaaaaaaattaaagtttaaaaaatgtatttctgttactcatttgaagtttcatttaggattaaacttaatataggaaaaagatatgtgggtattaataataatgataactaactcattgagtatttactatgtgtcaggcactcttttaattaattattaataaatttttatagacacgttctctctctgtcacccaggtgggagtgcaatggcacaatcataactcaccttaacctctaactcctgggtacaagcgatcctcctgcctcatccagataattttttaattttttgtcgaaatggagtctcactatgttgctcagcctgtgatactattttaaatgcctgcaatcttctcagttaccctatgatgcaggttactattataatctcacttttactcctgagtaaactagcgaggcacagaaaagttaggtaatcaccctaagttccaggccttatgcaaagcatagccagtatttaatcctcagaaccctgccttgagtttgcattcttaatccctatactatgctgccttctaggtcaataagcatgtcaaatgaaaatattggtggattattatcaaggaatatgcaaatgtatacaggagaaatggaaagtagaggagaaaaaaactcctatttctttggtctgtaatttatgccaaaccctttacaattttttttttttttttttttttttttttttttttttttgagacggagccttgctctgtcacccaggctggagtgcagtggcaagatctcggctcactgcaagccccgcctcccaggttcaagccattctcctgcctgagcctcggagtagctgggactacaggcacccgccaccatgcccggctaatttttttgtatttttaatagagacggggttttactgtgttagccaggatggtctcgatctcctgacctcgtgatccgcccgcctcggcctcccaaagtgctgggattactggcgtgagccaacacgtccggcctacaagatattttaatcatcctaacgtctattcatgctaggttttagtgcctgtgttttcacatgtggaaataaaggctcagagaagttggggagtttgcctgtgttcacctaccaataacttgcagggtctggatttgaacacaaaggtatattcttaagaggactggaatacatcctatataaaagtattctattatatagagtctattatatataatgtaatataacatcgtgaacttctatataaatattatataggaatgatatttattttatacctttctgtaaatattatacaggaaacaatataggacaagaatacttctacacataacatattctagacctcttaagaattatatatattatatatatgtctatgtagtatatagcagtctattctttttaaattaaattaaattttatttattattattttttagagtgatggtgtctcactgtattgcccagggtggtctcgaactctgggctcaagtgatcctcctgtctcggcctctcaaagctttgggattacaggcatgagctgccacacccagcccagtctattctaacctattgtatgaaatattctattatatatagtatgtattaagataaatatattcttccttctacatttcatagcctttcagtcttcaagaaggatgagaccctgatattacccaaataatcacaatatttgaaacacagagtggcaaggagggattattgaaaagagcataatgtctaagtacaaacttagctttgctatcaaaccttaagtgttacagtttcagctacagtgaaaagttacctttccccaaactgcatttttgtgtttatcttagaaaataaaaacttcagttgaaactacccattttcctatcactgcagggttgggcaggaatcaggtgtagtttatctttcctgctttagtttaggcctggaccagttttgccaaaggaatactgttctttacaaatactgtgctctctgttgtgtaggcaagatggtaggtagtggacagaatgtgaagaatgctccagaaaataaactttttaatcatcttaagaaacctggtctgattggatatgtaaaatgaaagtaataaacatggatttggggaaattcctactcaaatcttcttacaacttagactggttatccccacctacctgagttggtgttgttttaatatgtattgttcatggctcaactcaataaaaaataggcttttaaagattatacatttttggccaggcgctgtggcccacgcctgtaatcctagcactttgggagtcctaggcaggcggatcacaaggtcaggagttcgaaaccagtggggggcgcctgtaatcccagctactcaggaggctgaggcaggagaatcgcttgacccgggaggcagaggttgcagtgagccgagattgtgacactgcactccagcctgggcgacagagggagactccatctcaaaacaaaacaaaacaaaagattatacattttttttcatgacccccctgaaaagatcaacctaaaatataaagaatttcagccacctttaccccagggcaatagaattagatctttaaatgagttgggaccagcacagtgactcatgcctgtaatcctagcactttgggaggccaaggtaaatggatcacttgagctcacgaccagcctgggcaacatgacaaaaccccatctcttaaaaaaaatacaaaacaaaaattagctgggcatggtggtgcatgcctgtagtcccagctacttaggaggctaaggtgagaggatggcttgagcccgggaggcggaggctgcagtgagccaagatcgtgcaactgtactccagcctgggtgatagagcaggaccttgtctcaaaaaaaaaagaaagaaagaaagaaagaaaattaaatgaatggaaatgtcttcatttaggatgctttagtgtcactaagatttcttttctatctaatcttgcttgctgttgactgatgaaatgagatattatcccatcttgatcaaaggtgttgagtccctgaaatgtgtagattgaaagcagatcatggagaagggtgttagaagttcaggctctctggagcttctcttccaatggctattgtttatgatctcttagtttgaaaagcttcattaccatttacagctgagattcactttatttatttattatttatttatttatttttgagacggagtctctctctgtcccgaggctggagtgcagtggcacggttttggctcactgcaagctccgcctcccgggttcactccgttctcctgcctcagcctcccaagtagctgggactataggcgtgcaccaccacgcccatctaatttttgtatttttagtaaagacagggtttcaccatgttagccaggatggtctcgatctgctgacctcatgatccaccagcctcggcatcccaaagtgctgggattacaggtgtgagccaccgcacccggctgcgagattcactttaaaatcagttctctagcctgttctttttgggacgagattagagtgtaatttctctagggatgattatcattattcgtatttcaaacattggtcccctctgtggtgtcactgtgtcttaggtttaccatcttttactgtaaagaaacaggaaatggaaacacgcaagcttttctttgaactagatgaattcaaaaacacctgtcttaggcattcgtgtttcttatgagtttgcgagagtccgagtgaaggggaaggacaggctgtgttacacgtagcactcaaatcttcgcttctaattactctcctgagattgcttgtacttcctggcccttctgggattgaggacttgctcattgtttgaatcttggacctttattccttcggaattagaaccataggtccccatgggctgatctcccatgtccattcccttctgctgtttgcgcaggtctaagacaatcacctcttccctcctcccacctcggtcttatctgtgacctcctactacctgaaatttgtaaactattatatacttttgttacaggaactgggtcctgctcaagaccccaagagagggttcttggatctcggacaagaaagaattcagggggagtccataaagtgaagtgaaagcaagtttattaagaaagtaaaggaataagagaatggttactccatagacggagcagccctgagggctgctggttgccgtttttatggttatgtcatgattacatgctaaacaaggggtggattgttcatgcctcccctttttagaccgtatagggtaacttcctaacattgccatgccatttgtaaactgtcatagcgctggtgggagtgtagcagtgaggatgaacagagatcactcttgtggccatcttggttttggtgggttttagctggcttctttattgcaacctgttttgtcatcaagatctttaagacctgtatcttgtgttgacctcctagctcatcctgtgatttggaatgccctaaccatctggaatgcagcccagcaggtcttagcctccttgtacccagcctctattcaagatggagttgctctggctcacacgcctctgacacttttacaaaaacaaaacaactattacaaaacatccttttaattaaaaaaaaaaaaaaaggaaaaaataaaatgaatatttgttcaagtatgtctggaaggatacacgagacactaataaaagtggagaattgcttgtggagtaaggctgaggttcaagtctaatagttgggaggcggggtgagagtgagaatttacactgtatccttttataatttgaactctgtgagaatgtactaccattttaaaaatacccatttaaaattaactttaaaaagtgttctgctgtctgctttcttaagaaaaatcagaaagcagcgtacctctggtgggaaagttggaatctttacaattatgaactcagattggagaatacaaagcaggagtcttttggttacacacacctgggttcaaccaggttcctactgtgtgactggaaaatgtatttagtctctgtaagtctcaatacccttatctgaggaggaaaataaaaataattgcttagctgagcgcagtggctcacgcctgtcatcccagcactttggaggctgaggcaggcggatcacttgaggtcaggagttcgagaccagcctggccaacatggcgaaaacccatctctactaaaaatgcaaaaattagccgggcatggtggcgcatgcctgtaatcccagctactcaggaggctgaggcaggagaatgagtcaggagttcaagaccagcctggccaacatggggaaaccccatctctactaaaaatacaaaaattagccagtcatggtggcgcacgcctttaatcccagctactcagaaggctgaggcaggagttcaataccagcctggccaacatggccaaaccccatctctactaaaaatataaaaattagccaggcatggtggcgcatgcctgtaatcccagctactcagtaggctgaggcaggagaatcgcttgaacccgggaggcagaggttacagtgagccaagatggccccactgtactccagcttgagtgacaaagtgagattccatctgaaaacaaaaataacaataataataagaagaagaattgcttagcttatcttttagggatagtgggtagaaaataaataggaaaatgttctccaagcacataagaaatagatgattactatcagatttctgggtgaaattgcgacagtaatttcccaagaggaggaaggaacacagatcttcctctttcttaagtcctggccaagtttcaaactcttgagtgggtaaagaggggctatattagttctcctttcatatttctgccctcaaaaacctagagaatctgtggtgactactggaagaaaattcaatttaaaaacatttatttgaggctgggcgcagtggctcatgcctgtaatccaagtactttgggaggctcaggcaggcggatcacctgaggtcaggagttcgagaccagcctggccaacgtggtgaaaccccatctctaccaaaaatacaaaaaaaattagctgggcatggtggcgggcacctgtaatcccagctacttgggaggctgaggcaggagaattgcctgaacgcgggaggtggaggttgcagtgagctgggatcgcgccactgcactgcagcctgggtgacaagagtgaaactccatctcaaaaaaaaaaaacaacaacatttatttgatacttttttgattagtcagggctcttcactgctgatgaatcatgacaaacttaatgaaagagagaactcattggctcatgtaactgaaaaatccaggggcagaaaaccttcaggcgtggttggatccaggtgcttacaagctatctcattaagaacctgtctcgctccctcttttgagtctgtatttcctccctgttggcttttgttgttgttgtggttgttaacttcagttctcctcttgcggaggcaaggtggccactagccactcttgctcatatttgtctggttttaacagctccagaagaaagagaaagccttgctttcctattgttccagcaaattttttgggcctggatcttatttctgcaacttgagcatgtgtccctctctgaaccagtcaccagtgccagggagaaactgggctctgattggataagcccaggagcccaagagccttgtgcccagggatgaggttagccttctacaaataacatggactaagagagggggaatgtggcttcccaaaggaaaaatgtcaggaaggccatttctaaaagaagtagaagaggatgctagacatgcctttcctccttccccccaaaaagacacttaggtccccaatatctactctgtgcgatatattattttgggcattatgggaatgacatgataaacacgacatccctcagaaggcttagactagaatcatgtgattatgcaatcgcatacacatgaatttagtaatgaacaacttagtaagtgctataacagaaataatagttaatagctaatatgtattgaatgctttctagatcctaggtactggtctcagtattttacttggtttaacctatttagtctccaaaagaaccaggaaagtagttgctatctctccattttgcagatgaggacgctgaggcacagagaagttggttgaaagtgcttttggaacacaaagttctagcccatcaggatagtgagatctccatgcagagctactgtgtgaagagaacttaacattttagggtagatttcacccgagagggatagggaaacagtctaaattctaggaagaaggaacaatacatgaaggaatggagctgaagaaccgcagatgtttaggaaatggcaagaagtaaagtttgactttaacaccaggcttgcaaaaaagagatggaaggaaagtgatgggaaaaatggttcgctgggacgggttgtaaagcttggctgccgttccaagtccagctggttccacagactgtagaattctttagtaggggagtggctggagcagataaacaaaaaaatcgccagacccctgagtgtttttaggtggggatgttggctttgtatctctgctgtacattcttgggatgttttggaaggtttttgcaaatgtcctgttgggtggcattgaagcggttgtttctttaaatgacttagctctgccttagtgaagatcttgttaaaagcagaccattttctgacattctgttttctgcaactgctattgaagaggggcaaagccgagccaggctcttgtagaacactttcaacacaagacaagtggttttgtgtgtttctgtcacagttttacagtgaggccattcagtactcagaactgagaagatagcatggcacgcttatttaatagtcttctatttgctcttctattttgtccagtcattaaatggtgttagaattgagaattaggactctctttcctcgccaaagaaaaacacaagtgacttgttgactacaagatttactctcacagatatttccagagtaatatgaaatcccagccaagtatccgcagaaaaaagccagcggcatatgctccagcctcttttcctgagtgcagctccacagctacctctccatgcccagaaggacatcataaatcatttctaatttatgaggagcccagtcgtgtactacaccctgctaggtgctggtgtttgtcgtctacagactgtgagctcccttcttcagtgcatacagagactttttcagatcatccataggacagaaggttgagaatttttttccctaggactggcccagccaagaattaaggagggagaagacagaagattcttgtcgctcagggttttgccacaagcctcacttgctttttcccaaattgaggactgggaaggggcagaaacaataccattctcatgattagctattttcttttattcaacaaatacacatattttttcaaagccaacagcctgcaagtcaacgttggggacacagcagtaagcaaaacagaattttggttctcaatgagattatacttacacatgttaggaggtgacgatgggttttgcagggaaagaagagataaagttgggaaggggaatagccattctacatcaggagttcagggaagggacttccactaaggtgacctttgagcagagacttgtgggacaggatggagtgagtctagcagttgtctggggatatggcctcctgggaaggacagaggccaccatgcagggccccaagaaattgaagccaagagccagaaagaagtggttaggagccaggcacgtgggaggcgggacagcctaaggggctgcggtgagttcagggattgttggaagtaagatgggcagccatgggaagtttttggaagattaccagagtataagcctgaagtcaggaaaatacagggcagtgtttccttcacttcccagagagaattagagtgtgcgctgctgttatcagaattgaactgtcaaaacatcaattagcccaatgcagagtgaaacagaaatcatggctttgtttgatcttggtataaaaaaagctcttatgcttttccagttgggataaaagtgagaggccatgagtcatttatttactcaactggcgataatacttttcatggagacaccttagctactgtattcagctacgacattcagcgacctgtgccccactagcgtcttccctggcagtatcttggttgtgctgtagctgtggtgcatagatttctgtgcatagattggtgtaagcttcaaagtcaaagagcagctggtgggatacttgggatcagattcgagcaggctgcaataacagcaggctctcagtgatgacctggagccgactgctgccgttttctgctcacaaacaactgactttagtccggagctacagagagcttgggttagattgatgcgcagaagttacagggagtgcgatttgactccttctctggaataccttcctcaaaatgagggtgatcgatactgaagtgggttgcgccttaaagtgagcatcttccctctgaatgattttaagcaggtgagcacatctcaggaatattctgagacagcccctgctttgtgcggtgtgttggactagaatgacctctcagattcattgcaatgcaaaccccctctgagcccatgaaaaagtgtccagtgaatgtgctctgcaaacatgcaggcactatataaacaagaggcaaatattttaaaaggtgaagaatgagatacttgtactgctgtgagagcggtggttggaatgttgtgccccagcaacatactttccgtgctcggtcgcctgcagtttgttctcattggccctgtacagaggtatccgcattgtgtgttaaatacgctctcagcgaaagaccaaacaaatagccaacggcattttcctatcagagcctgtttataggaggtagagcaaaagaacaaagctgttggttttgattcttggcaggaagccaaggctgctgcttcaaagctccagagtttacaaggaagaaagagggggaatttttagtttacaaggaagaaagggggaatttttagctgagactaagttagaatttaagcaaaactcaaaactaaaactaaagaatcctccgggatccataatggaaaggcagaataagaaacctggtatgtttcaggctatcggatgattttttagtgcaagaacgaacgttttaaaaggtgcccgagcagagattacagacagcctcgattaatgacacaggatcactcagcatttgagctggatgaattgtccttagtgatccttgaattgtgtcccttattttacagataatggattagaggcccaggaactcaaaatgactgcccagggtcactcaacaagttgtaggaattcaaggactagaatccaggactcctggcagccattttgtgttttgggcaattttaaagaagcagcaaaccagtaaaagttttgtttcttatgagcaaagggccggttaggaagacagccaccgtgattgaatgctgaattggcagtgcatttggtttgcgagaatgtggcccgatccctaggccagcggcacttgctcttgcagttgccaccttcatccttaagtttagggcagaacagccgtgaatctctgggcctgttcccaggaatggaggccaagacaactgttggaggaggtctacagagtcccgccacccctcagagcccagtcaagcatgaatgggcttttacaatccgtaggaggctgcagtggtcaaggtccttctaaagcacctgcaaaatcccagcagtgtcccacctgtcactgtgggtgttctttggcttcctgccgttgataagagttctctcctttttgacaagaggccgaacaaattgaaactgtatttaaataacaacactctttttacataatagaacacccagtttaaaaaaaaaaaaaagactctttgcccggttaacttttttcattgaaattactaacctttaagtgagctgttgttacttgcttctggaagatacaggaagaatggggtcagtgaggaatctaaaggaagggagggaagccttctgtgtatgtctcctttttaacccaaagctgttcgttgtcattcttttgaccatttattcattcattcactcattttcctgtttgtttctattctgattctatccaaaaaaagtttgacaaaatgtgcagtaaagagcttatatattgtacataaaatataagtcaagtcaggttttagagaaggaggaaacagagattccatccacgaattgtcatatgaaatctgtgtcaaatatccagttttactctgatctttctagcaaccaggatttaaaaaggaatacacaatttctattatcagaaaggaaaaaaaaatccaggttcttcaagagactaagcgttgctattctgtggcacatgcaattagcaaacacttaaggaagactttcatgcacttactacaaagctggctgcccagggcgcatcctcccaccctgtctcctatcagtgtccttgcttgaggccctggagcccctgagcaaacatgttcttagtgttatcacaaatgtcttcttagtgttatcacctgctccctttggatgtgtcagaacctggtttggggtaatggctttagtttagttgaaacgatgttgtctagagcagttccaggatttgcagataatgagcccaggagtaggaatcggggaacgtcagaaatctcgtgctactgcagctgcatgttgtctaccagtgtagctttcctgctcttcaaagtgccctagactccttatctggcccttcgctgctgtatcaaagtgcatttttgaacagaaggtctggaggaaatagagttctgcagaacacgctttgggaaatgttgactcaggattaatagatgacatgaccacatgttaattttacgcaccttcttggcccctgaaagtgaggaatggactttgcagttgcatggacatatagagcacaggatttaatactatacacactcaaggggaacacaattgagatcctgctccggagctcccaagccccattccaaagttctaccaggcatttacatttgttccagaagaaggaagaatcaatgttaagatccccatggctttacatgtctgtgaaaactgattattattatttttttttttctgagatggagtttcgctcttgtcgcccaggctggagtgcaatggcacgatcttggctcactgcaacttcagcctcctgggttcaggcgattttcctgcctcagcctcccaaatagctggggttacaggtgcccaccaccatgaccagctaatttttgtatttttcggagatggggttttgccatgttggccaggctggtctcaaactcctgacctcaggtgatccacccacctcggcccccgccaaagtgctaggattacaggcatgagccaccgttcctggctgaaagctgattattcttaactgccttctccatcctcctaagacctggggattgtcagctaatatataagaactctctagaattagtgagaacgcaggggaaagagttatagaaatatgatgtgttgggcttttgtaatagatggagtgagagagaaaacactagaaaatagttcattttcctggaatgcaaatgggttacccagaatatttactgatgtttatgtgtttttttctttaatgtaagcatacatatcttcttcatacactgcatatccatagaattatatgttttagaatgcaacatttctagcttcagcgtgagaagcaggctttatgctctctagttgctatgtaataatatgcctggacgccaggccaaaggtggccatttgaaagaccagggatggcggttggacttcagatcatgggctgcagccatttgctcttgtcatagctgtgttgattccactcagatcatgtgttttttttaagcaactaagaaaacgagtttgagccctcatgtgaggagaataaatgtgctcaattctacttggaatgtttttcataattatcttaaggaatgacttgattcttacttgtgcttgttctttttaaaagtattagaaaggaagatatccacacgacaaagtagagaggagctgataagaaggggagtgcttaaggaattgcctgatcaaggtgaggaaattaatcatacattttaaatattttggtccttcattctttggtttttcttttgttttcttttgaaatttaaagggatcatggtctttgtaaggtaaagcggtgattactgcattccaagcgccgtgcttccattggtaatgcctttgtgagctgcagagaatctgaaatattatagaattctagtgactttcctggtgaatccatcaccatatgtcattctaaacctaaaactctgcaaaggtacatccgagggcaatacagatgagatacaaatgcttacggctccttctcttctctattcttgagcttcagtctttctattcacatgaaactcatgtgtttgagtaaatgcaaagttttagcttggttcatgctattttgtttcttaagactaccaataaaagagaagagagaaggcacacatacctcttgtcctttgcactctataataacactgaaatgtacaatcaataaagcatgaataggcaaactaaactaacctgctttctgctttctctcatgtaattttgcagtactgttctcttttcatttctctgaatctttccctagcaatgattatttctaattttttcccctatctctgatcttctctttttttctctatcctcccgaggaggaactttgttcagaaaagacaaggatcagatagaaactggtactgaccctcaaaagaagacgctaacattggttatttctccaaataaataatacctaatgattttcatcgcttccactattaaatttaaaattaaaggacattttgttgcaattttgttgattaagctcatgcctcccttcccctcacatttactgtaataataaagtattattattgtacttttatgggaacaaataaaatgctattaatttagaattgaaattgaaattgaaataataatacagctgttttcctgatatatgttccttgcaaaggacttaacattttttggcattcactatttgtaaatcaaaatgacatgcttttttccagcatctgaataattccagagtggagctgagaaatgctttcctgtttttctcctgattcaaagaaagtagggaactctgcagtgaatagtagcattttcttaagccctcgcaattttaggtattttacttcaatttctgacctgtcaaacttttcttactctactttatgaatgaattttatgttttccctgtttttctattattttgaagctatttatttcctgtttgagacttttaagagttaaaaatgcacatttctaactttttaaacttaaaggtaggcttgcaatatcaaaattaatcccctgtccaatgtctctgaaggcaatagagaaataatatacccattgaaagcttaacactgggccatcagctttatgggatgggccaatgcatttattagacatcgtttatttagaaatattttaaagaaagtacaaaatggaaaattttatgattgaaactgttaatgggtttaaatgtgaagattaaaagcccatctttttttcctaattaaaatttgtaggtagaaaaagaatttgctctgtctgaaaaccaagtagcaatagtcaatttaaagaaatgatttttattctgccgaatctgtgaaactatttgcctcatagattataatttcttgggccaacatatacttctcagaaatctgactctctgatctttttatttaacttttccagtggaaactaaaagttttaaaacataaaagaacaaaacaattttttaacctaagcataatataataataggcttaatgtttgagaagtcataaaatactagattttactttccagcttttccatggtccctatctagaaccgtagaaattatctaatggttgaaggttcctgaggatgtcagtagtaaatggagtccttccccttttcagctgagggctggagaaaatagttttctgtgattttcccaaaagcaattatctggagaatttcagtctgagagactagaagctgctgttcttggtaacaacctcctttctgctgccagtgaagattcattgtttgccttgatcttcttgaccttgcgtctgctcttgacagtgcctgtccatcaagccctttattcagtgagccagatagactttaaaaatccctctagctaccctgagtctgaccccatcccaccatatcccatactctcccggctattgttatttttccttttaggttctcttatttacatccagacataccttcaacctaaaagttcagtgattcgtcttctctcctgggaagtctatgatctagtccaagtttgctgcttacctctgcttttttccctccatcttttcccttagcttttgacatgaggttgtggaggtggttttgcctgtgtgccatcctttccttttctcccactgtggacttttgtcacttgccttttggtcatacatgattttctctttctatctgtccctcctttaactatgatatatccccaatacacctgtttactagaaggaggtgacccccttcaaacaccctcgtgttccttatttaaccacttgttcctgtttgtgctttatctctgttttctttaagctgacaactacgttttgagttttctctttcctttgctctcgtgagatgtgttgacttgggccgcttattgtcacctgccatccagctcagcatcttcttgccttcctttgctctgcttgtattttacttacacacacacacacacacacacacacacacacactatatcaaggatttaacttattttaattctaaaacaacttccttaacactcaatactagaaagccttttcaatatacacaccagctaattaataactttacttcccctctgttttgttcttgaattccatatttatcacaaatgtgtctcttttttctacaattattttcatactaactagctttatttcatgcctcaaagtaagtattttccacattgttgactatttctctctatcataggataagacactttcttcttgtgtcacagctattaaaatttccaggtttttctaaatttaataaatcagttatttaactaaagaattttaatataataatgcttaaaatagaattaaattgtcattgacatgacttcaatatacttttattatcaactaactaaagtcaaagaaaacaaagataaatttatatttgagttacctaaaaactgaagatttttatacataagcaagtggttttctattttgtttggaattttccattcttcatttttattttatctggatatattgtgttctcctcctttttatagctaatttcttgggatttaataataggatttaagaatcatttgggttctctttgttttgatgtatagtcttttaaaaattcttactttaattttattaaaatagttgagatttacttgtaatggcattgccttcaattattgtttattttagttttacacgggacttagttataggttattgggagttatatgactaagcaacgattgctttttcattctaaaaatgacataatttcatgatatgtagttgatttattaaaatgtcatgtctgtttgttcagaaggcaaatggattttattgttaagccaaagcaattcaatcctatttaatgacaatttgggaaatggtttctgttttataatgattgccaagataagagtagtaaaaaattgaaagagctgtaatcaagcagatttttaagtttgctcaaaccttccatttgttaatttttcttttacaatgctagcaaagcctcttaaaattttccagatataaagtagggttaatcttttcaagaatcactgaattaaatgtttctgcaaagtctctttcactttagaaacccccaggaattatggaaatacaggagttaaaattagtaatttatgatttagatctctcaacattgtatccattatggttttttaaaattcctttgtgattacttttttatgtgtgttttttttttctcgaatgttttcaaattatttttaggacaacttagggactttttggctagttatatataataattacctgagtatactttaatctttccataaacaaataaaaataaaaatagccttgctatcatgttttccctgaacatagagtagcagttatattactgtgtgaagttagcacatcatatacttaatatattctggaaccagtagtacttggaaattttcatattctcccacttattgtttgtatgtgtaattacatttcatgttatttgtgtatttgcattcaccttgtgtttttggtgcttgtaaaatgtttattccattttccagattattcctctcgccattctgtttctgaatgacaaagaaacacataactattgacttcagacaaacctaagcacatgaacgagggactctgctgccctgggatattggataattaggatgatcattcctgttgtcttgaaatggcgcatagatattccctccatagcagcttttccccaagacagaggattttctagctcttttgttttgaataaaccggtgaaacagtgcagggtgtatttggttcccagggactgaaacatgaatctaaattttacaatcctagtaactggaaaacttgtttttaagaaagccagcaagttagacatctaggtgtttctttcccattttagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaaggtaaaataaagacaaacccatattatttactttagtatatagctcaatgtctagaaccagcacttaggctccaactagtgactctaaaaccagcagtctgcagaggagaggtttacaaatagaaaaaagaaagaaatgataactagtaaagtgaaatcggatgattttctcaggtagatgcatccattttataagcacagtatttgttttttcaattattaaaaatgttaattaaaagtaataatcagaaggggtggcctctttaatcattagagatgtctgggaagattatcctttcttaggagctttgtctcaggatcataatgaaagtgagaaatctgaacatctttctctgctggttacaattggacccgtgagcagttcagcatggaggaatatcaaaacccacatggcttgttcagcccagcactgtctccagcagtgggaacttggcaggtggcatccacatatccagcatcataggttccagacgtttctgagagagacccaggaatagctcccagagatgccacggactgtggttgctctgctggctgattcccacagcctctgtgcaattggaaacttcaaaatgtgccagaggcgattatgctattcccagaagacttctttagagaccttggttcctagagtgaatatgctacagtagattgagatacctgcaaaatacatgtctatcagggactcccagaacattcacaaattcctagttatggattgatgacatctcgataccactgctgtgatgcgtaggaacctccaaacatgaaatgaaacttctaaaaggaaaggttttgtggggagattctagatgcctccatgcagcatagaaaggaatctttaggaaatatactatttcctattttataatgtctgtctctaagttgaatggtaaaattttgtcaaacctagtgtgtgttctgtgggcattttgaactcttagaaactgatgaaagtgaattctcttcctctgttcttgacccagatccttgagagcgaaagggaaaaaagattatttgatggccctattaaacacaccattgtaacttaaaatcatcctctgtggaagttcataaccgttcattatttgcatatatattagcctttaaaagttttagaagcctgtgtaaataatctgttggaaatgtattattttgctttatttcaagggctttatctagccttgttccattgaaggactctggttaagcttatgtacacaaattatgaaattaactaatactttcaatgataatattcctggaacataaaaagaaagtagacttaaataaattttagtgggattcagttgaaagtattaacgcaagtagtgatgttttttgtttaagtctttctgtcctgtctcgccagactgttgaatttcaaatccatctgtggtttgtccctggcagccttctcacatccaagaatcgcatcctgcattacgtaacagtgccatctctggtgcctggtccgtgcagggtattcgtcactggactggccagacatcaaaggaagtgtttcccttatcaacataataaaaagttcctgacagttttatatgaattaaccaacagaccttgatgttcttgaaagaagatagcagaccttatgggtccatgaatagttgagagatgtttttctttgcttagaattagtacattcaattcttccttatctgataaggtccaagagagcctgttgcttggctagtaggtacatgaggaaggagctgggagtgctggatgctgacataccactaaagaggcagtgcggctgtctcctgtgtggaaagtgcacacaccaaagccacaaggagaagcgctaggtatagaagccacttcgtgagactgaaaagaatgtcacgcataactaatattacagtgtattatgttaattagaaaatgccttatgacaaaggtaacaatttatttctctagaaaaacatttttcattctgaagaccaactcaagcttcacttttgcctctgctcctcttctggtctcactgcttgtgtgagctcactgccgtgcaaaccccaccatcccatgatcttaattcaccctttattttgggatacagtgctccctttcctcctgcatgaagccaacttattcaagagcattctgtcatctatttggttatatttgccaaaccatatcatctgcctttagagccctagatgtgtattatatctcttcataagacaatatctcaatactttaatatttgaaacatcaccgtcaaagaaagcaaaacaaatggcacgtggtgtccttcacacttgctctgtgagtagattccacccaggccccctgggcatttctggggctcctgaaggcacctgattctgcagttggtacagtggtcttgggcctcctctgcctaatactagagacttcttccttaaggtctttggggctcttggtctcccattattctttctcagtaagtgcctttatatatataagagcagaaaaggccgggcgccgtggctcacgcctgtaatcccagcactttgggaggccgaggcgggcggatcacgaggtcaggagatcgagaccatcctggctaacacggtgaaaccccgtctctactaaaaatacaaaaaaaaaattagccgggcgtggtggcgggcgcctgtagtcccagctactcgggaggctgaggcaggagaatggcgtgaacccgggaggcggagcttgcagtgagccgagatcgcaccactgcactccagcctgggcgacagagcgagactccgtctcaaaaaaaaaaaaaaaaagagcagaaaaactcacttgctccctgttaaacaaagcttagtattaaatataagaaatcttatggctcacgcctgtaatctcagcactttgagaggccaaggcgggcagatcagctgaggtcaggagttcgataccagcctggccaacagggcaaagccccatctctactaaaaatacaaaaatagctgggtgtggtggtgggcacctgtaatcccagctactgggaagctgaggcagggagaattgcttgaacctgggaggtggaggttgtagtgagctgagttcaggcaccattgcactccagcctgggtgacagccagtctcaaaaaaagaaaataataataattttaaataataagattttataagaattctaagaaatcttgcttgacattatttttattaagttattattttaaaatcttcaatgaaataacaagtgatgaacacttatttgttccacaaataatgaaagtctaccataggtgagactctactaggggccaggaaaagagtagtaaatgaaaaatggcctttgccttaagagcatgacctgtgaggagaccagaatgcaaacgggcaattgtagtgcaagatgcgaagtaccgtagaaggcctgagcacagcaacccaagggagctcacagtgagggccaacattggttctcagaggaagatatttatgaactaagacatgaaggaaacaagaaggaggtcatcaagtgaagcagaggaattgggtaagaattgcattctaggcagggtgaggaccacatgcagccccaggcttgttctaagtatcgttgacctcaaaccttccagggctcaaaggagccaagcctggaagtatgggaaacagcttgttttccagaccgcattgctggaaaggctagcgtccttatcaagccagaatgacgaggcagccctttctcaaccttctcttgaagtgataatactcctatatgccatcagtttatatcatgtcttcagatcacatggtaagtgtaaaatatacaacttgacataattcattacctcccagctccaactaaagctctgttttctactgatgtgtgtgtcaataactattagacagtcagtcccattcgttgaatagacatagtgtttacagcattgtgttcgatggaattttaaatttcagacaaaaggagtttataattcagtcaaaaaattatactatttgcatactcatatgtccctgcgtgtgtgtgcatgcacacgtgcgcgcacacacacacacacacacacacacataacttaagaattaccagaatgacaaatgttcacacatagttggtagcgttcgaagagtcaagaggagcggacgtattctctaaggagccaggagaaagtctgtttgcagtgtgttcattttctccctagtaggtcttgtcattgccaaccaatctggtgaactatctcctccttcccaaacccagaagctggattctttccggtatacctttagaattttaagccttaggcagaaaggaaaaacatccctcagtgacatgctattaagggagaggataaaacatgtgtagagtttgtggtatataagagaattaaggtgacatgtgttacagatcagtttgactttcactatggatgacactattgggcttagtctccatacttcatggtattatactgggggctaaagttacaaagatgtatttaaagaatagacttcaaccatatgtcagaagactgggaaattaatgtatatttatatattttaagttaaaattaaattttataggtgtgtatcaacttgtatcattctcaaacctaactgacttttgtgatttacttgcctggttaagactggctgagttaagagggccattactattagtatacatgatactcagcttagttgaggagacaagatatataaacagaaaggcaaaaatacaaaatagcttctgataaatgttgagtaagtggctcacacaataagcccaagtaagttcagagatagaagggtcaacttgggccacagtgacagaagaggattttgtggctgaggcaggatcaaaggtgaactttaaaagtaaagctttattgattacctattgtaactgaagtcatctatgctaattatatatgtggattgatggggaatgtggttaaaagagaattctatacttcacactcattaggataagaaacaaaataatataaataataataaaatgcagtatattccaatattaaaaccctttctagagcattcaattatgggagccttggttaaggctcgatcttgtcttaacactgtctcaaggtttttattgtgccccatttttaaagaaatgctgcttagctttttggactagaatggtattttagtttaattctcatcagccactattagaaagaatacagatgtgaatatatgaatgaactttcagcatctcatctgtctttcagtaacaagagactaatactctttctcctccggttacacaaaaccttgtgagaagctgctattcttaggtatgagttttggatgaattttagcctttgtctttccaaaataattatttggtttacattacaaaatagacctaagtatttcttcgattcggcaccatctagatgtacctatagttgtgacagtatttgaaaaggccaggcatggtggctcatgcctgtaatcccggcactttgggaggccaaggcaggcaaattgcttgagcccaggagttcaagaccagcctgggcaatgtggcaaaaccccatctctacaaaacattcaaaaattagctgggcgtggtggcaaacacctgtggtctcagctacacaggaggctgaggttagaggctgcagtgagccgtgatcataccactgcactctagcctgagtgagagagcgagaccctatctgaaaaaaaaaaaaaattttttttttaagattttctttcatgcacacacatacaaaaaaaaaaaaagaaaagaaaaggaaggaaggaaagggcagaggaagttattttagaacaggaagctgccaatgtactgggaaagctttagaaaattttgctagtagaagatgattcattctaaagcgcattgttgcctcatgtaaaagattctccagagtctctcttagcttacaaaataattgggttttgatcacagcgaggctgaacacagatccctttcagatggatcaggcttgagttctcaagggtaaccatgagtccagcagttgctgtagctgtcattcctcaccccacagcagtgactgtaacgtgttcatctgccactctccaggagccttcaactttgttaaatcattgtttgttcaatttaaatgtagcacttcatgcccacatcatcatccagcaaccccagatccaaggctggaactgaggcccctgactgcaaacatttacacacatcctcaacctaatttcgtcaaagtagtttgtataacccggttttattaaagggtgattcgtgtaccctgagaacacttctcagtttgtctttcagcctttgttttcaccctaaactgtgctctgtctggtgcagaactccatgctgattctcaagtaccaagcagacacgctttgtgtcactatcgtcatgtcttgctccttgtgtttatatggtgtgtgtctgtatcagtctgcttctgttcactttctcgtttatagagaacactgaaaaccactctgaaacaccggcagctcctgctctacctccttctgctcctcctaagcctagacccaaacctaaacccaaaaaatcacctgtgcctccgaaaggggccactgctggggccagccacaaaggtgatgaagtgcctcccattaaaaaaaataccaaggctcctggtaagcaggcccccgtccctccacccaagccagcaagccgaaacacgacccgagaggctggtgagtatgcccccagtgccctgtggggtcacttctagggtgcttggctctgggatggggctaattgtttcttctaggtgtgatgggcttttggtgtcttaggacattacaccagcaggttcagctttgacacaaagaatgcccaggagattcctttgttgctctctaccaaaggaaattcaacccattgaatagttcacctcattagtttttgagtgaatatactggtttcatcttgagtatccactatcagcaccagttgaaggatactgggagtagtatgcctgatgaatgacaatgatctgatataacattatttagacattgactgaccttctacctatatgagcctatgggtggctttttggcttggattttctttcaaaatatctaaggtttgcatataaaaatgtgacaattataactttgatatatttactggatgttaatgtgttaaatcctcagcatccatagtcatctcccttctgataaatgacaaagggttcatgtcacttgtttcagctccaccccaccactttctactgcagtgaaaactatttcagtggagtggaaagttacactctcagtgttccacacctcccctgtagacttgtgtgttctaaggcaaaacatcctggtgtcatgtggttataagttactattataaatcaccagtggatgtttgagtgacctgcaataactcatgcaatatgtatccagctttgctttacaatcagatatgcttgatgcaaagtggaaactcccatttttttagtgaagaggaagaaagatgcctaccatgtcatttatcttttaaaaggacattaatcaggccaggcccagtggctcacacccgtaatcccagcactttgggaggctgatgcggatcgatcacttgaggtcaggagttcgagaccaacctggtcaacatggtgaaaccctgtctctgctaaaaatacaagaattagccaggcgtcgtggcgtgcacctctaatcccagctactcaggaggctgaggcaggaaaatcgcttgaacccaggaggcagaagttgcggtgagctgagatcgcgccactgcactccagcctgggcgacagaatgagactccatctcaaaaaaaaaaaatctattttccttaaaatcaacagcaactttctagcagttgactgtcaggatttgccttggtgttgatctttttcctctcataatgtatgaccataatgctcaaattcagagagcggtttagttgacagtataacagatctctgaatgccaatagacatccctctccctgtgctcctcatgtcccgcctttgacctttagtgtctgggtctcttctaataagctctaaactgaaatttcccagaatgatgtgccaacagtgcccagtggccatctcctcagggagcagctgtcctcacccatcagtgtccattcttgttgggatctgtgtgtgttttctagacttcctagaaaaccctagaagcactgcttaaagtgagggaggcactgatcttcttcttaaagaacagccccaaatgatcactctgtcattgggaattaagctcctgtcttgcactaacttctccactttcccattctccacgtggtagtggctcactctgaactcagcttggactctctttacttccctcagaagaaagccgatgattaacaccaggtcaggggacagctttcataaacgattttgaggtttttccagatattttgcttgaagatttatttaggcactcatgatgctcctaagagaatagtacagtcattttattcattgtattgtaaaaggcctgacttttccagaggctatcacagagaaaacaggggttgcacttaagtacaccaacaagcccatcatgtaagaatcgttttatcaaatattgataatatccctttatgatcctactgatagtccatttgtaaccgtttagaactttctgcatagtaactttgttttatttgaataatatggaccttctagaaaagtttgttcaaatgctactcttgatgttcagcccagtgatttaagttgttaaaacaaccataagttaagattctttctctattactaagttagtgtagacctgtagctacctaggtatcggttttagaacattcagcttctttgccagagaaatcgggttaaatctccttgatttttgtttctcattgttacacattattaacaacaaaagtacttaactgaggagaggcgacatttttttttatcatgcccttaattgaaggtaacttaagcaacatgtttgatttcaacaaagacctgttatttaagaagattctttaagaaaaactataatgtggcttgaatttgcactctgggcagtgaaaaaaaatgtatctttttcctcaagccaaactaaaattaacttttctgttaatgatgaaagaattttattggccaggcattgtgactcacacctgtaatcccagcactttgggaggccgaggcaggtggatcacctgaggtcaagagttcgagaccagcctgtacaacatggtgaaaccccatctctactaaaaatacaaaaattacccaggcgtggtggtgggcacctgtaatcccaactatttgggagactgaggcaggagaatcacttgaacccgggaggcagaggttgcagtgagccaagattgtgccactgcactccagtctgggtgacagagggagactctgtctcaaaaaaaacaaaaaaaaagaattttctttaacaaattattagaattgttatgtggaaaggattctgtttaacttagctaagaaaataattgaacatggttaggcaccgaatccttagcgtctttgttgtgaaaagtaaatgtagactggacttagattgaaggagtgtgcttaatgagtttgacttctaggctagggaaggttgttttctataaagtaacaggtctagatttggggaagaagaattctagttatgtatatcttaaacgataaagaccccaaaaccatagggattccttttaagcctggaacctgtcactaaataagactggcttctttagtatcagtctaatcagaataaatgaagtcttacatctcattgtctattctttcatttattcttcatctcttcaccctcccaattgacttcaataaagtcataactggaggtaagttataataacatctgtatacagtgtggattggcttcacaatgctaacaagatgttttctaatcgttctgtgaaagatagttgaacccttcatgaagagaaggagcataacaacattataacagaagaagccattaggataaatttataggtcatgaaagaaaagagtattctcataggagtttattttatcatcatatatttactaagatgacataaagaaaaaagtagttaatctttttgttttgaaactgttttgattgagggtgccctatccggaagtaggcaaatataccatagctatccttcgatgaagaccttcttggaacttaagcattaaggaagatcacatttgcgaaggtggagtcagaagacctgagaatgatatcctttccattcacattatttagaaccagacacggtggctcacacctgtaattctttggagccaccaaagcctctcactttgggaggctgagatgggtgaatcccttgagcccaggagttcaagaccagcctgggcaacatgacaaaaccctgtctcaacaaaaatacattaaagttagccaggcatggtggtacacacctgtagtcccagctactcaggaggctaaggcaggaggatcacttgagcccaggaggcagaagttatagtgagccgatattgcaccactgcattccagcctgggcgacagaacaagaccttgtctcaaaaaaaaaaaaaaaaaggagcaacccatgtaaataggttttgtaaacaacaagtttttttctggccttttgatgctttgaagggagtgtacctttcctgtgtggccatgggttttccctttaccccatctctactgcagatggaagtagagtccagcatggcgagctttcttctctggagctactggaaagctggtgtggattttctcttttagcagtaagatgagtgattttgtttttgacccagaaagaagctggatatataccccagtctcttctgaatacaggccaccactctattcctagaaagacagcatagaacatgtataatttatgatgagcctaattgtgtgctacacccagctagctgctgatgtctgtcctttacgcaccataacattccttcttgagagcataccgggcttttttcaagtgaaccatagacaaggggcagaagattctccctttggctggctcagctaaagactaaagtgagagaagacagaggactcttgttcctctgagttttgccgtaaatatcacttgctccttgctggattggaggaagggaggggcagaagacaagactattatcatgattagcctattttctcttatacatttattcaacaaactttaaagggaacattttaaatgttgttgacagttacaccttggttactttattttaaaaagcattgtattctttgattttttaatgcaaggtctctctattgtagctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatggtgagttggggaacaaaccccctattttatctgagaactaaagatcactaatatattctgttggaaatgaagcaccgggtttgctttcttatataatttaatctactgagtgttaggtaggcatacatgtgatccaaccattgctttgtcagagccctgccctgggaatgcctagggctgctggagaaaattacattggtagagctgacaaataccacttgagatcaatgttttcaagtacacttagaacctgcttcagcactgctcagcagtccacagttcccttctctttcctttcagtgcttattttaaatctttactttaccattgtgcttacctactcatgtcagcaagttactgagccttccccttcaccaagaacataaagaagatcagaagagaactctcaaatttgaactcttttttctccatcagtagagttgtcccctttcttgttcctttaaattcccacccagcttaaatgttatgtcctctgtgaagccattcagtacttctagacagaattggttattgtgtctactatacttaaccctgtgggacagaattagccaacatgtcttacataagacacctctgtgtgcccagcaaccactccagagtctgatatgccataggcacacaaaggatgctcattgaattgttgaaagaaaataaaaaagggatttaagatggttatagataaagtcagcctactttaacattgcggaagcagcattgaagataagatgaccctattgctagattttgtagagtataatggaagataaaagatagtgctcaagtagtcttagtttcatttaagaaggtacctgaacaaaatgggccaaggaactcaatgttacctcaccctcatccagttggtgggttagttgctttaccaccacccagttgcccaagctggaaacctggggttcatccaagggtcctcattctctttcattctttgcatttcatcactcacaaagtcctataaatattctacttacaggtaaataaaacatattagccctgtctcacgagtatgaagggatggatggctgtcagagtatagtagacgcaatgataaattctgtctggcaaaggcttagagctcttgcatcctggctttttgctcctgagtctaagaacaaaacctgtattcattgttcaaatcatgtaaaaggttctctttcaaaacaatctgtcatgttagacttaaaaaaaattattacattaattaggttggttttggtcaagaaactaaaatatcaactttaattctttaattgctaatgataataacctttatttattgaatactcatttagtgtcaggaactaagcactgtacatgtattatcattttatttacacaagtcttcccaaaagtatccctgttttatagataagaaaactggcactgagagagctaaaatagtttgcaccagactgcccagttggtggtggtgaagccagaatgcatacccaattccatgctctgaatgaataatttcatgttttccaaagcagtggcttctacttctactgccatttctcttctgttagtttctttgggtttttttaagtcattttgagcaccaatatttgaaggacagccaagaaaaaataaatgtcaaattacaaattaatttattttctttgtttgacattttaataaaagatatgggaaaagaagatttattgaaatgaacggttatggtgtctttcttaggacattttgtgctgctgtaatagagtacctgagactgggtaatttataatgattagaatattggcttacagtcctaggggctgagaagtccaagatcaaggcagcagcatttggcaaggatcttctttccatgtcatcacatggtggaaggtggaagggcagagagcacaacagagtgaacctacccctgtgagcccttttgaaaatggcattaatctattcacgagggcagagccttcatgacttaaacacctcccactaggccctacctctcaacactttcacactgaggatgaaggtttttgttttgttttgttttgttttttgagacagaatcttgcactgtcacccaggctggagtacagtggcatgatctcggctcacctcaacctctgcctcccaggttcaagcaattctcctgcctcagcctccccagtaactggaactacgggtgcctgccaccacgcctggctaatttttgtatttttagtagagatggggtttcaccatataggccaagctggtcttgaactcttgaccttgtgatccgcctgcctcagccttccaaagtgctgggactacaggcgtgagccaccatacccagctaggattaaattttaacccatgaattctgagggacacattcaaaccctaggagcattcttaatacttccagcacacagcaaatgtcttcatttaactatagtgagtattttccaacattgccatcacttccaaccattagaactgaacattcattcttacagcatatattttttgattgccttttctgtgctgggcaatgtactaagcaccaaggatacaaaagtgagcaaggcaatatagttaagactagcttttaccaaaatattgtctgatgtgcccaggaagtataatgtttaaggtaacatctgaattttgggaactagattgggtatacgggattattgttcaatatactaaagaataaggtgcaacatgtaaagtgtttcctgatatagtcttaaacactcagagagctcatatccaaaggtggcctgactctatcccgttcatttccacaaatatttaaggagttcattttattgtgctaaacaacacacaacatactaagggcttaatatcagtcttcatctcaagtatatgaagaactgtcagaccaaagaggtaagcatctgttcttcattcctactgggactataatcagagggagtgagcttagtacatcattagccattgaggctatttataatagatattcctgtccatcaaggtagttataatgctttcctagaagaggccatagggattttcttctctgtatattcttcaaaatttaaatttcagttcatcctacagggatggtttgtgtttgctcttgaattaatgaacctggagtaagtagtctctcaaatttccttccaaattccttctgcctttttcaagtggatatttggattagaatatctggctcttagtcactttctttacttagaactttccttctgagttatgtttcatcaactaatgtgtgaaaatcttgtcattttatgaagagacttctgtttggaatacaaatatcaaaactttcaagaagacaagtggctatgtataaaaatacctacctctcttcccatatggcagggtactaattatttggtaggcttccattcatgggcagcttcatcagtaacacatatgtgtgatacaatataaggtgaaaactaataagcccatttggaggccatatccaaaaggctactttgtacagttcattttcacaaacatgtatagaatgcactatattgtccagtgtgcccaggaacccgagggggaaaaatgaggggtaagtcatgagttgattaatacaaatttggaatatatttaacatcagatataatttataacataactcattaagtgtaaaatataatagtataataaatgtaaaatttaataggtagaccgagtcttcagtctggattctagacaagacttgctaccttggttaggcaactcactcatggtcttctttgattccatgaactataagttatctgccctccttatacaatagaatacttgtaaattgtagatgtatgctggactctttgaaaaccatgaaacaaaatacaaatagtaagattagaataataatcaatatgataattaattagtgaacaatgacaccaacaaataaaggactcatctctcaaatttgttctgttattcagaacatattattaattggcatgtattttaaacattctgtgatcacccataatggcagccaattcaaacaagaatggcttccagtggcaatcaactaaaaacccagactgtggaaaatttttcctataaaaatagatcttctcttatttaagatgagatttcacactgtggaaaacagtatggtggttcttcaaaaaattaaacatagaattaccatgtgatccagcaattctacttccatgtatatagccaaaataattgaaagcaggcacttgaatttgtacaccagtgctcaaagcagtattattcacaatagccaaaaggtgaaaacatacagatgtgtattgattggtgaatggataaacaaaatgtgttatatacatagagtggaatatcattcagccttaaaaaggaagcagattctcacacatgctacgacatgaatgaaggaaccttgaagacattatgctaagtgaagtatgttacatacaaaaagacaaacattgtataatttctcttagagaaggtgcttagaatagtcaaattatagagacaaaaagtagaatggtagttgccaatggctgggagataatggttatggggagttgtttaatgggtagagtttcaatttgggaagacgaaaaagttctgaagatggttggtggtggtagttacacggtaatgtgaatgtgtctaatgccagtgaactgtacacttaaaactggttaaaatggcaaattttatgttatgtatattttacacaataaaaatgagatttcctatttccctgtttgagaacaagaatatagtctgttgggtttttctgataagtgagaaacaaaattttgacagtgatcactcaggtttataactatgaagtagggttttaaatacctcatattctgataaagtttatctgtgtttattgctggaagaactttttaccagaaagcaatttgggggatctttgtgtcttaaaatgaagattacattatttttgatgtgatgtttttatgtaaattactatgtattttttagtctagtctttgaaaattggcaatctttgtacattaatagtaactctttaaatcatagacttttactaggctaaataatagaaaattattgcttccttgcatatcaccttttttctttctttctttcttttttttttttttttgagatggagtctcgctctgtcacccaggctagagtcatattaccttttttctaaaaagtgtatttaacttgcacattgtctgttatgttacaagaggcagttttaaaaatgaaaacacacataggataaatgagtttttactatttacatattgggataaaagcaggattaattcatatatgtactttacatatatatatatgtatatatatatatgtatatatatatatatgtatatatatatatatgtgtgtatatatatatatatatatatatatatatatatatatatatgcttttttttatttttttgagacagggtctcactctgttacccaggctggagtacagtggtgctagcatggctcactgcagtctcgatttcccaggctcaagcaatccttcccaggctcaagctgggactacaggcaagcgccaccatgcccagctaattttttattattttattttattttattttatttatgtatttatttaatttatttatttttgagacggagttttgctcttgttgcccaggctggagtgcaatggcgcgatcttggctcactgcaacctccacctcccgggttcaagcgattctcctgcctcagcctcccgagtagttgggactacaggtgccggccaccactgctggctaatattttgtatttttagtggagacaaggtcccctatgttgcccaggctggtcttgaactcctaggctcaagtgattctcccacttcagccttccaaagtgctggagttacaggtgtgagccaccgaacccagccatatattaatgaaagaagatgtacttttctacgtcattaccttctgggtgctgtgatgcaaaacaatgagtctcacttttccaggaacttgtgggattgagaaggcagagaagcaatgggtggtcaagatgtagtatgctaagcactctagcgggatcgtcttcaggtccccatgggacagacgtgggggcaaggaattaaactgaaggtccatgaaagcttcctgaaggagctgaggctgtagctgacacttgaaggaaaaaataatttgcaaaatgtagttttaccctatttgtttgctaaatgtatcagataccaagcgtttgcattttacagatgaaaaatgtaaaaccttgagaattaaggtttcatttcagtgactttagcctggcctatgtcaagtgtctgctttcctcagcctgaaggaagcccatgaaactagagctctttttcttagtgtcagtgccgccaagggttgctctgagcttcacatcactcccatgcttttctgcctttaacagtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtaagactgttttcaagaggcagggaggagcgtgggtgataagcagaagcagctgcagtttataaagaataaaagcctcattaggaaccagacatctgatgttttctttcccctcatcctcctttctcaaattagaaatgtgtatatcctaaagtttagcttttgatgggaggcctttccagaagatgatgtcacatggctggatctggcctttgtcgatgagctagatgagctagatgtgctagatgtgcatattagtatttgtgctgagaatcaaagctttctaataacagagacctttctcactatgaccaaagagagcccttccactctgggcctgttgttgaagaaagaaagtcagtgcagattcataggcttactcattggaggtgtttgaaattttcactcgcttttgtactggggtttatagaaaggggaaggaggaatgagtcaagaatgccaaatacctcattagcattaagaggctgggcacggtggctcatgtctaattttgggaggctaacgtgggtgaatcccttgaggtcaggagttcgagactagcctagccaacatggcgaagccctatctttactaaaaatacaaaatccagatgggcatgctagcgcacgcctgtaattccagctgctcgggaggctgaggcaggagaatcgcttgaacccaggaggcagaagttgcactgagctgagatcgcgccactgcactccagcctgggagacagagcgagactccatctcaaaaaataataataaaaagaatgctaaataccttgctagcattaaaaaaaatcatacttccacaataagtaagatagtaggccttctaggaaataataatatcatttatgtattaaaaataatggcaaaaaccacaattacttttgcatcaacctaatataacttagagatatggaaagtgcttttatttttttttaactttgtgctggataacatgggagggattcactgtggactgaatttgtagattatggcaagttattactatattagtgattaaatggcactttttcaaatcccttttaatttgcatggagcaaaaaaaaaaaaaaaccattatcatccatgtggtgttacttatcatttgttgaaattttcaggattctggggtaattaagggttaaacattggtagactctgccaggatggcgtctgagtagaggaaaggaggagacaaggattaactgtacagaataaaagcaaaagaactaagttttttaaacttgaaaaagaaacagaattgtgcaatcattcatttctatgatccaccctctcagcaaaataaactgcagctatcactttccaaacgatgaagtgatacttctaagttttttcatggtgtcccaatatttttcagaacattaaaaagaaatagcgcttcagtcctctcaaaatgaactgcatccaactcaaagtctttttttccttaggttaattaagattctcctcctgcatgaggagaaagaatttggtctgggctctatttaaagtccatgccatgtgtaacctgagtgccactggctaaaagcctctctctctgcatttctgctctttttcaatcctcaggtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggtaattgctaacattttaggacagtactgactaatttgtatttttctccctcccaaagcttcctacctaactggggtcattgtgaattccttatgtacagatacatctggcctactgggtcttttaaagttggtcttgcatgatgaaacactcgaagaacctgtcctttggcccagctagccagtggctttgaggtcaccaaagcctattccaggagtcaaaaacttttttttaaagaccagttggcaaacatttcaggctttgctggccagacagtctctgttgcagctactcaactgcgctgctgtagcataaaagcagccataaataatagataaacaaatgagtgtggccatgttccaataaaactttatttattcataaagctggatttggcctgcagatcacagtttgctcaacaatcctggcctaatttatggactcactagcattcctgggaatgccatgaggttctgccctgtggactgtgagactgcagaaatattatttgccttcaatggtctgcctccatccaagtcaggtagccttaaccctcatatctgaacatccctcttccaacttcaagtaaatggatcatctgacatctcttcctgcctccaaccattgtataggatttttgcttttgccactggtgactttacaagtccctttaactggcagttttaatagaagtgagcattcatgccagaggtcttatttttgatgatcagtttaagcacatgtaagaattagttgttctgctgacttgtcttactctgcatacacaacagggtgcataactgggagaaaggaactgtctagaatcccagagcaggatttggaggtggggggaaaattgctgtccttgcttggaagtggtataactggaggcaggattggcatggaggctgctgaccatttctccagaggaagagtaacccctaaggcacctccttacagctgagttgtgcagaaaggtgtcagagacagcagctgtggcatctatctgaaggaaaagcacagcctaccagggaacctcgggggaggcttagagggtctctctgttctgtaaaccctcttgcgactctggaagaaatttgggaatgtttaccagtggtctctctcgctctcgtcttcttaattcagccctaacctgtgaccatttctggcttcgggaaaaagccagcagaagcaagagggactaacgtgattaatggtatcgagctggaaaaacctacagttctaaacttgccatcttaccaaggaaaaacaaggggcctctctgaggcccagagagattaaggaaatgtctcaaggacagacatgcagttactgagtagcagaaccagaattagaatttcgctcctgggctctctgcccaattttcttttgtatactgtctcctgttttgtactttctactctatgtaagagagtatatgcttctaggttttctgattgttttattactcttgtttatgttttactatgaagaagaatgtaaatcattgaataatatttgcataaaataataatagtgttatcatagtaaggagtaaaaaagtgtgaagtatcctatacccacctcaataaatgtcaaagtagcagtaaagaaaattttgtaagtttttgttaaaatcctaaacaaacgaggagttgtaatcccagcactttgggaggccaaggcaggcagatcacctgaggtcaggagttcaagaccggcctggccaacatggcgaaataccgtttctactaaaaatacaaatattagccagctatgatgactggcacctgtaatcccagctactcaggaggctgaggcagtaattttggaggcagaggttgcagtgagccgagattgtaccactgcacaccagcctgggcaacagagtgagactccatctcaaaaaaaatgtaaaaataaatttaaaaaatatatactaaatatcttactatagggagaaaccctaaagtcatttcctttaaaaacagaagcaaagaaaaattccttaaccttactgtgctaaaagtctggtcacaattatttgtggtgaagaaaaggtataaattgtaggaaagatatactgttattatacatggttgtatacctagaaagctctaaaaactgacccaaaattgctatatataatgatttcagcaggtttgcttgatgtaagattaacctataaaaatcaacattatgtttatataacattgttacatagaagaaaatacaatgaaaaagggagattgcgttcacggcatagcaacaaccgcattttaaatacttaactattcacaggcagaagtccgtagtcaggtacctagctaacatccaggccgatctgttgctagaaggaaaggagactgtgtaatgggggtcagtgagcagcctcagccatgatctgtaggcccacacatacctggtttgaaccactgcagtttttggtctctgctacagcttagcttatagtctaattaatatatagctcattagggtctaaaataggatgctgtgcctggccaggtaatcttaatattactgtcacatgacactccccaggtaggtgagcgatccagtatggtgggagcatggctccttgaagtctgcctggcagccccattccttctgtcttgctgctctcccatcccctagatggtctcagctgcatgatcaaagctggctcacaccatcatgctgaagttctagcctgtggaaaaaggaaagagaaagaagggagcatgcacccaggcattttaaggatgagaaggggaagtaacaaacatcattctgctcacatcccattgcagaaactcagtcacagcacgatacctggcttctagggaggcagaagtctgtagtcaggtacctagctaacatccaggccgctctgttgctaaaaggaaaggagactgtgtaatgggggtcggtgagcagcctcagccatgatctgtagtctccaaactaatgggaaggagacttttattttgcagctttaaaaatggatttttatttctcaaaacatgaaaaatagagctttgttgttttattctgagtctcctactagggtaccttgtttttaacctgtaatatatcctttttgtcatcataggaggctgagccagaggcccacaactgaagaattagagcaaagaaacatcctaaaacgtgagtattctatactatagaatgattccttgtgtaatcgctaacaagctgcctctacagatgatcgatttatcagtaagaaaccatcatatattcatttactcaagatggactgaaatagtccatttatgtcacatttatatgtaattgtttatatatttttttaatttcttgaatttgatatttgattttatggctttgagccttatacccgcccctagagcagagtcatggtcatgacaattgtgtttaagaaagatgaaatatattccatgtattctttcacccaaatattaaatagaaaaagaatgctctagtcttctcgcaaataaatgtcaaagaaaaggccaaaagaatccacaaggaaacaaatcaaacattcctatattattattaacaatacagtttgttgctagtttaacaaatggctcaattcaaaacaaaattttcaatccattgcattttcctatgttatgataactcggcttccttcttgagttgtttataatttctcagcactaaaacgttctccattcattttcctactttattttcccattctgtttttccctctgttctctttgactttagtttttactcatccctgcagtagtatttattggagttagtatgttaaagctataaagctaatagaaatacagtttgtcatgctattgtgtgtcagtgtggacaggcactgcagtgagttaagaaacggatatttttaaattgagcctagctgtagttttatatattgttaacccagtttcaaaagatctttttattgtatgaaatatcaaagaacagggatgggtaaaactccggctagtactgcaatggtagtgacccatggtgtgggggaaatccttgtcagccaggcttttcgagttatcttggcctgctagaagacccctcttctccaatctaagatactttctttcctttagggaagaaagattttagtagcatattgtattacagttgttagtacgaaatcaattcaacaatgaaaatgaactaccatccagtgagaggaactaccatccacccagtctatgggatcactttctttggaatgcttttttctggcttttttttttttgacataactagaatacagctccaggaaggacttaagtggctactaatgtatagaagagccaatttggaggaggaaaaattcacggctagaaaagaaggaaaattttgtgtttttgctttgctgaggaagagtagaagcagcatctcattttgacacaaaacaaaccaaaaaggttcattgcttttcatgataggttcctgggaaatgcttgttgaattaagttttaagcatgctcaaatgcagaccctacgctcctaaaaaacacagagattatgtcttactggatgcctgatccaatacctagaagaaaaagggaagagcacattttgggtaattctttcttgatcctgtgagataaatagtgccaaaccacaatggagtttggttatctgaggaactgtttcatagatctagaaacttaccgcgtgttgatcttaagtgctgcattggcctttatatcccattttcctggaggtttgggaaagagtgagacacttcagatttgactccagccctttttttccttccttctaagttcacctaagcatatttatttctggaaacagaggcatatttccagcctagagaggctgataactggcttatgatttcctgacccactattgtacagccaagggaggcagaagaaaactgggagaggtcatctttccctgagcagtcacaggaaactgaatggcctaacttacaaacactctactcagcccgtttgtgtcttggttcttccacatagattgctcttgttcgtttgtttgtatgtttcatctccagcttttgttcaagaacagtagaaaagtatgtgatacagtgtggtttttaaggacgtttactttaactaggtcatctttttttttttttttttctgagacggagccttgctctgttgcccaggctggagggcagtggcactatctcggctcactgcaaccccgcctcctgggttcaagtgattttcctgcctcagtcgtcccgagtagctgggactacaggtgcgcatcaccatgcctggctaatttttgtatttttagtagaggtggagttttgctatgttggccaggctggtctcgaactcctgacttcgtgattcgcccaccttggcctcccaaagtgctgggattacgggtgtaagccaccgtgcccggccctaactagggcatcttttctggcaaactagaaaactaattcacagaataaaacattcaacaatttttagagcccatcactagttcaataaacatgagtcagatgccaataaatgtcattagttttcattggtgaccacaggacaaattatatttcttagtgtcaattcaccatgccagtccttacttgatgtctttcctaattattttggtgatactagagctttttaaaaagacatattacatatacgtatttatattatattatattatattatattatattatattatattatattatatttagttattcattttagaaccagttcctaaaaactgataaaatagaaagcaacttttggtacttaaaagttcaacttttgctaatcaagaaaggtgatgtatttagctgagaatgtaattctagccatgtcttctatagagaaaaatgaattaggccattgagttctgcatatatttttccccaacattttattatgaaaatttttaaacatgaagaaaagttggaggaattttacagtaaatccgcatatatctaccatctatagtctgtcattaacatcttgctttatgacatatctatgcatctgttgatccagctttttttaatgcactttaagtttatgtgtgtctttttcatttgctaaaaacacccatatgaggccaggtaaggtggcttatgcctgtaatcccaaagccttgtgaggccaaggcaggagaattgcttgatgccaggagtttgagaccagcctgggcaatatagtgagatctcatctccaccaaaaattgaaaaaacaaaacatctacatggaaacatgtaaaaagcagaaagaaaaacaaatccacaaaaaaatttggctttttgaacccattttatctgaattaacaactcaagaagataatactccaattgctggtatttttatacttttctttcttcttttagctcatccacaaaattctctgggtaacattgctcgctaggcgggtttcctgtggtgcttgctgctgtttaaccacatgtattatttgtttatttatcggaaatgcttcttgcgggtcgtccgaaatgttcgcccctctctgctctgatgagagtcactgagagcaagatttgtcaatgaaccacgtcacttccttcatgcatatcccaccagcctgtttaaattgaccagaaagatttgcatcctactttataattagtcctctagtgaatcaaaaaatgaaggaagcatacaaaaaacttggtgtattttcaaatactgagtttaaggtttaaacttgactctatgagagattttacaatgactgtttaataagattcagagaagctgtcatggtagctcatgctggtaatcccagctacttgggatgctgaggcgggaggatcacttgagtcctggagatcaagacaagcttggactacatagggacagcccatctctacaagatgaaagtaaagattcagaggaacagtcatgttggcttccctctacctctcaccctcgtcctctaacttcactaaaagtacaattttgaacatggaaaacttaaagaaatcagtttctgatgtcaaaaatgaattcaattccctaactgcatttggcccttctctttttagacatcactgttacctggtagcactagctgaacaatatgcttaataaggcaaaactttcaaatattcccttcaaggaaatatcatttttgcgtatttaatgacgactggagcatttgttagctttgggatgtattatatccaattttttaatctttgaaaagtaccttaaaaatatagcataaatactgtataggaagaattgacaaaaatgttctcagaattatatttttctttttattaataatgtcatcaatatcactaacaatatcatcactttttatcaacaatatcaacaatgttattttcactatcgtgtcaccttgtaaagctctggtttaaatcacaagaaccacagtgtggcatttgtttattatgtattttgacaatccacaagctttatccaactcatatgaggtaattctttgaacctaagtatgcatttttaaggatatgaaaggatatatattttgtgaagcaattaaaaccctagagtactttcataggaagaaatttaaattataaccaaatttgtttgactggcacaaaatgaaaggatattaactcattgtttcttgtcttgtggatgattacagtttatgtccactctttgtctaatcaccttctttcttatgcattaaagttattatttcagaagaacatagaaacttttccctgttcagagaaggaaaactgatagagaatttagcctgttcaactaacaaatacagctgttgcaaatattgaatactgatatgttattcacagtaaaaataatcttagttgtaagaagtctatttgaattataaaataaatatatttcatacctgtcatggattaaaaaaattttttttaattgaacccgggaagcggaggttgcggtgagccaagatcgcgccactgcactctagcctgggtgacagagcgagaatccgtttcaaaaaataaaataaaaataaaaataaataaacaaatagaagaagttttcctttttcaaccttttggtcaaggctttatatggtgttattttcctgcaaaagagttcataatagcactttctaaaacataatctttcataagcatcggtatccaagaagcaaaatgtatgctcactgatcaaacagatgatcagctaaacgaagcaacagagagatgttcctcaagtaagcaacaaccagcaaaacctgaaggggtgtttatttctttaaaaattttggacatttttctttaaatcccatctgttgggcagcataaaatcgtactacttggtgaatcactagagaacgagaagactttggaaaggcaaagtcacaagaaaataaataatttccacccagagtacatcataacctcatttagaacattctggtttgaaagcaaagtccaaggaaatgcttacattctgcttctatggaaacgaaggaagacaaatcaaatattttggttggatttgagtggaaatcagcagctcagacatgcatcggatggttctaatttgctcttttaatatgtctcagattttcacacgaaggccagatccagaagtaaatttttatctgaattctggtaaattgtgcttataagcccatgaaatgatcagcaatagagggctttcattagaatatgggcactcctgtggtttttttaagaatacaacaagacatcaggaagcaaaaacgtttaaaattagtaaagcaaaccagtcctacaaaaaaagcatgtgtgtgtgtgtgtgtgtgtgtgtgtgtgtatgtgtgtgtgtgtgtaagatgatcaaccttcctacaaaatattttgacaactttttaacaatgttggttgtgtgtttgatcattatttgttagagtcacatgatcgtggcctgatacacttttctgaatatgaaatcatctatagtaactgtcatcacgactttcctcctttaataaacagaaaagaatgaagaagaggaacaagaagcaaaaatggaacttaaacgcagactcagcagaaaggtaatgaaatcataactattaatgagcatatgtgttttgagatatacttttaaaaaaaaatactaatcctctctgtatgtgtaaatcagatgtttagaaataattattcctattagtctataatcatagacatcaaaatcacaagcctgggcaacatggtgaaaccctagctctacaaaaaataaaaaaattagccggcatggtggcacatgcctgtagttccagctactcaggaggctgaggtgggaagattgcttcagcctgggaggcagaggttgctgtgacctgatatcgtgccactgcactccaggctgggagacagaatgagaccctgtctcaaaaaaatgaaataaaataaaataaaacaaatcaatataatgcacatgctatgagtgatgtttctgattgtgtgttgtgctaattttgaataattaacaagggttttaagttgcatttactccatgaaagtatgtactctgtgtgaaaatttttaaagacacaaaaaaagaaaaaaataaaatcatgtctttcattcagagacagccattattaacatttcaatgcatgtatttccattttaaaaaattgttttgagtcaggtgcaatggcacgcacctgtagtcccagctacttggaagctgaggcaggaggattgcttgagcccaggaggtcaagaccagcctggacaacatagtgagaccttgtttcaaaaaaaaagaattaattgaaaattaatctcgcttgattagaacaatgaaaaaaaaaaagaaaaaaagaagtgaaaaaagtttttaattatgataaaaattatttcttaaaatgctcacactttccatttagtgttggaaatattaaacaagtaagtaatttgttactcctgaagatttcccactattccacatcacagctgggtaagtaatttattaagtgaacttgatcatccagcctgcctgctacagtgctacccagattgacaaatgtcttacctcccaaactcagacaattgttgccacttatttatgaatatataaatctgatgttagggccatcacttttttctgtgttaaagtaatagcctttggaaaaatcaagcaccatcagagtttatatttcattataaatccttctaatcattcttcaggcataccttatgcacctaaaaatggataaagtgactaaaatgtgacatctacatgaagtgtgacctgacccacatttttgtgggctggccagggagtcttcaacaaaagcattccaaggcagatggaggcaatgcttcattcccacagaaaagctatgggactatgttgaaagtgtttggttctgtttttcaaggaaaaacatccttaatttatccattgtattagtccattttcacactgctgataaagacacacctgagactgggaagaaaaagagatttaattggacttatagttccacatggctggggaggcctcagaatcatggcaggaggcaaaaggctcttctaacatggtggcggcaaaagaaaatgaggaggggaagcaaaactggaaacccctgataaacacatcagatcttgtgagactttttgactatcacaagaatagaatgggaaagaccgagccccatgattcaattacctcttcctgggtccctcccacaacacatgggaattctgggagatacaattcaagttgagatttgggtggggacacagccaaaccatatcattctgcccctggcccctccaaatctcatgtcctcacatttcaaaaccaatcatgccttcccaacagtccaccaaagtcttaactcatttcggcagtatcccaaaatccacagtccaaagtctcatctgagacaaggcaaatcccttccacccatgagcctgtaaaatcaaaagcaagctagttacttcctagataaaatgcgggtacaggcattgggtaaatacagctagctgttccaaatgggagatattggccaaaacaaaggggttgcagggcccatggcaagtctgaaatccagtggggcagccaaattttaaaggtccaaaattatctcctttgaatccaggtctcacatccaggtcacactgatgcaagaggtgggttcccatggtcttgggcagctccacctctgtggctttgcagggtacagcctccctcttggctgctttcacagactagtgttgagtgtctgcagcttttctagacacatggtgcatgctgttggtggatctaccattctgggttctggaggacagtgaccctctttgcacagctccactaggcagtgccccagtagggactctgtgtgggggttccaaccccacatttcccttctgcactgccctagcagaggttctccatgagccccaccccacccccaaccctgcccatggcaaactttggcctgggcatctagacagaggttcccaaacctcagtttctgacttcttttcacccacaagctcaacaccatatggaagctgccaaggcttggggcttccacgatctgaagccacagcccaagttctacatttgcccctttcagccacagctggagtggctggggcacagggcaccaagtccctaggctgcacacagcacagggaccctgggccctgcccacaaaaccactttttcctcctgggccttcaggcctgtgatgggaggagctgtcatgaaggtctctgacatggcctggagacattttccccatggtcttgaggattaacattagcttccttgctacttaggcaaatttctgcagccagcttgaatttctcctcaaaaaatgggttcttttctgctgcatcctcaggctgcaaattttctgaacttttatgctctgtttcccttttaaaatggaatgcttttaacagcacccaagtcaccttttgaatgctttgctgcttagaaatttcttctgccagataccctaaatcatctctctcaagttcaaagttccacgaatctctagggcaggggcaaaatgccgccattctttttgctaaaacataataagagtcacctttgctccagttcccaacaagttccttatctccatctgagaccacctcagcctggaccttattgtccatattgctatcagcatttttgtcaaagccatttaacaagtctctaggaagttccaaactttcccaccttttcctatcttcttctgagccttccaaactgttccaacatctgcctgttacccagttccaaagttgattccacatttttgggtatcttttcaggaacaccccactcctggtaccaacttactgtattagtctgtttccatgctgctgataaaggcataccctagactgggaagaaaaagaggtttaattggacttacagttccacatggctggggaggcctcagaatcctgacaggaggcaaaaggcatttcttacattgtggcagcaagataaaatgaggagaaagcaaaagcagaaacccttgataaacccatcagatctcatgagactcattcactatcacgagaatagcatgggaaagaccagcccccatgattcaattacctccccctgggtccctcccacaacatgtgggaattctggagatacaattcaagttgagatttgggtgaggacaccgccaaaccatatcatttttttttctcaaagctcataaatgtcaaataatgatcaaactgaaagactttattgactcaatttctagggatgactctagttttcaatggcccttaagttaccatctgtagacaatcaatcaccccctccttattgccctgggcacagtcttgtgatacaaatcatctttctcaatccagctgggcccctccatgaggcagcagtgccagcccttaccctctgcacccacttgcctccaccatacatagctccatgccgtaggtgcaggtcagcccgtagcactggtagctaccccatgactgggacagtcctgaggacaagactggatggagaatttctaacctatattgccattggtcactttccttctagccagttcttaggagcaagggcttctctacctccttatttccacctgccccaaagtggcagcaagaagctagcaatatagattggacagcaactagactatagcagatcacttagattattctttctcttgtccattgcctaccggggctctatgaagatagagggagccatagttggcacatccctgctccagtgggctcagggtatgggcctaggccttctaaaagtccttgagtgctttgaatattacagtattggcttagttcagaaggaaactgaggcccaggaaagggctgttaatgactacagaatgtagacccagtgcaaaataaggaatatctctggacaggtgttgtggcttatgcctgtaaccccagcactttgggaggctgagatgggagaatcgcttgagcccaagagttcaagaccagcctgagcaacatagagagaccccccacccactctgtttaaataaaaaaaaaataagcaatatctccggagaggaccacttagatgatgggtagtctggctgtatacagagtatatataagagaggaaatatatgaaaatgggccctatggctacaatagaggtctaagtctacctctctggagataactgtgataccacccaactaagaaagaccaaaatgggagtgaacctccgtagcagagagtagataatgcctgtttaccaaggggccagctttctttcacctgtcagagtcttattcttcggtttgagaaaggacccagaaagaaaagcaatataattacaaatctgaatttgacaaagaccacaaggaggaaccgaagttgttagaagtatcttaaaggttggagttgattttaagcagtgatggcctcaaggaagtacagttctccatcaactctcccctccccattcgtgtacatcggtttttctggccaagggcatgtgtctgattggggtcttgtccttattatgaatatcttaaggacagctgtgctgtaggcacaccctttattggaccctttctatgtcataactttgtacatttctgagtgtatgggcttaatattataggaacaggtttttattcccatttctaaaaattccatggcttttgccttgataattcaatcaccaaaccagccattctgtatctgggttactattgtgtctgcgcattgcatgttccttgcgtcagggatgatagacctttatcacagtgccaggcaagttggggaaaatagcataatgcaggtggttgccaaagactgtgacctatctaaaacgatgatttttttatagtctcaaaaattagggcacatggctttctagttctcattagaaattcccaagatgctgttgcctttttttttttttttgatctgaaagtgaccttatttaaccataactttgaagtgttctctatagaaaacttgccaccatgaggctgtaagtggtttactgaactctgcctttttccttgtcctcctgcagctcagcctgagacccacagtggcagagctacaagctcgaaggatcctgcgatttaacgagtatgtagaagtcacggattctcctgactatgaccgccgagcagacaagccctgggccaggttaacacctgcagacaaggcaagaatcccagtggattttgtgttgattgtattgcttttctggaagctccaatatccacatcccccctacttaagtcatcccaggggacgagatcttaccaaatattacaacagttttctgcctctgattatttaagccacttaagtgatacatttagtgatatcaatgtagttctttcaactaagtctcagagaaaagtagttatttaccatataacctacctgctttcatacctggatgaggagggctttctcacatccaggatttatccttactcttagaaaatataacttatacaacttatcattttaaagggatatgttaatagaaaggtttaatcttcgtcgagactggcacacttttaatagaaatgacaagacagcaaatagtttaggctatgtgggccatacaatctttgttgcaactgcccagttctgccattgtagcatgaaaacagccacagacaatgtgtaattgaatggatatgtatatgctccaataaaactttatctacaaaaacagatggtgggccaaatttgacctgcaggtcaggcttaccaacccctaatctaaatcattgcacacaattcctgaaaaatgaaatatacagtgggttctatcaatgtagaaagacttttaccttattagtaccattgttccataggcaaagattcgtgccaaccgtttgtttttaaattgttctaatttttatctcttagcaaaatctggtattgaataaactcgtgctatacccagttttttttaatcataagtacttttgcttaaacatgccacatcttaatgctaaaactaggcatttaatcatgctctgtgctgactctttttaataggaagcttcattatttaaaatacctgctatgcatcaagcatatactggagatacagattcagaaatccttagctcataagtagaaatgaaaagtaagaaggaataagatcacaaaggaagaatgttcagaacaagaatagaagagaaggaggctgagaaaagcactccagggatgttttaggaagaagcagcagaagaatattgagaagaaatgtccgtgaagtggggaaagaggagaagctggtagcacagcagcttggaaggactgtgtcagggaggacggacggccacatgtgtgcagtgacatggtgagagggagcattttggtggcctgatgggtggaagcctgtggtggagacaacgaggatcaaacacaatcctgagaatttgggctctgaagtatgatgaggcagttgttcaacgtatggctggtgattgtgaaggtcaataagcttgggtgcgtaaatttggaaaatgagatacagtatcaagggagtgatttttttttaatttatgggaaatacttgaacaattttttatgtggtgaaggggtcaaaagaaagggagaggttgaacatacaggcggaaaagtcagtaactgatagcgtgggaaaaatcactggagtagcaggtcagtacttatgtgaaagaggcaaggagcagacccttgaggacggagggagagcacaggctgaggaagctaggaagtcgtatctcattgtgcttttactttgcctttcgttcattatgaatgagattgaacatattttcatatgcctattgggcatttggataccactccaccgaagtgccttttgcccattttcttttgggttgtcaattttttctgattcataggagttcttcatatattccagttatgtatgttgcaaatattgatttaacaagattctttttttttttttttgagacggagtctcactctgtcacccaggctggagtgctgtggctcgatctcagctcactgcaagctccacctcctgtgttcacgccattctcctgcttcagcctcccgagtggctgggactacaggcgcccgccaccacgcccagctattttttacaaaatatttttagtagagatggggtttcaccgtgttagccaggatggtctccatctcctgacattgtgatctgcccgcctcggcctcccaaagtgctgggattacaggcgtgagccatggcgcccggccaacaagattcttaaacttaatacagtcgaatttatcaacctttttctttatggcttatgattttgtttctggttttaaaaattctttgcataccaaaatgatagatatattctcatatactgtcttctaaattgtttataattttgcttttcacatttaacttttttgtttacctggagttgttttttgggggaaggtataagatatgctttcagtttgcttggtcatctgtattatatgtttgttttctatgtcattatttgttcttttctcttcttcctcctaattttttgggctttattggctattctgttctaacctaagatagactctccagatcattaattttcatccttccttactttctgatacaagcactgaaggttagaaatgactctgtgtgtcagtgatttgcaaccttggctacaaattggaatcacctatagatctttaagaatgtggatgtctgggtcccatctccagagatgctgatctcattggtctgggatgtggccttcatattgggatttttagtaattataaatatctcacatgtccttgaaaacaatatgtgttctatggtttgagggtgtgcaaattttcctgtaagatcaatcttgctagttctattcagatttctgtacccttagttatttttttgtcagtttgatccatcaggtaacaaacaagacatgttaaatctcccactatgtggatttttttttttacttctccttataattctgttaattttgcttcatttattgtgaggtgtatcattagatatatatgtttagaatgcatacattttcttgatgaaactttgttatatttaaaaatataatttttaaactggattgtcaaaatgagttattttatactaccttagtactatgaattgaagcagcaaacctctgtgatgtttagctgatggcttcaaattttcagggtacatttcatcactccctgcctatccccttacttactaagcaccagcttgcaattttttgtttgtccttggagggtcagatattctagcttacccttacactgagggtatgccatttggtccccaatttatggagagagaattatttattagacctgagtgggttttgtgtgtcttctgtatttcaccaaatcataaagatgcctgctcaaattcactagatttaacacaagtgccctcaaggtcaaagccagtttcatttctcacttaccttatttttctggccatgatcttcttttactcattctcatcaaagtattttttactcttttcccagctgtttagtacatttaaagcagtttttagatgccatgtttagcattttaattgtttttcaatagaagagttagtcaaggcatctggtatgccattttgctagaaatagtactgcattatgaacttggtgcaaggtttcttccatcctcctttcctttcagttgtgggcttctggtcattcacctctcatttagtggctcctagttgaccctgctctagtcactgtttctgtgcagtgaccttccccaaaacttagtgattgaaaacagcagctattttatatcttacagattttgtaggttggggatttagtcagggctcagctaggtgattcttctgctcttcatgaggttgactaaggtcactcaatgttattcagctgacaaataggctactttggaggctccaagataacctctctaacatgtctggtgtcttggtaaggaaggctcagagactgggctcaattctggctcctagtccgccaaactacctatacatggcctcttcagcatggtggcccgagtcatcagtcttcttacttggtggctcagcaaatgtcccaagagaaccaggtaaaagctatatggcctttcctgatctggctttggaaggcatccagcctcacttccactacgttctattagtaacaggcaaatcataagaccagctcaagcttcaaggaaaggggaattaattagctccacttcttgacaggggagtggcaagatcacaattgtggccaaatttggaaaatacaattttccacacccaccattcccagctatcttattattcaaatgcaaaacttcagaaaggcaggtagggccagataaatgagtaaagatcactgcagttgccaagtatgcaagcagggagagtctaaatgactaaccaccctcatgtggaaactaaattgtccaaaccctagaaacagttccttttgactcttgttcttttgttggaaggtaaagctcattcatctctagctgtaacagagaggatttttttttttaattttatgttgaaacaaaaatgggattttgttctggacttctaggttgcaggggaaaggtacatgaccaggttttctgccacaggctttgtttctgttcatgagtgctttgaaggcatatgactttgacatctcccttgcagatctgagccccagagcacagccactgcccctctctcctcacacatgggcctcattttctccctctgacagtatctctcacatttctcctgaggctttttaaagtctaaaaagcagcatttttagaagtggatttttattgtgtatgtgtgtgtttctctggaagaaaattaagaggtagaatttcttttaaatagaaaaaatattggccaggcatggtggctcatgcctgtaatcctagcactttgggaggccaaggtttcttgagctcaagatttcttgagctcaggagtttgagaccagcctgagcaatgtggtgaaactctgcctctactaaaaaatacaaaaaattagccgggtgtggtggcgcgtacctgtagtcccagctactcgggaagctgaggtgggagaattgcttgagcccaggagcaggaggctgcagtgagccatgccacggcactccagcctgggcaacagagctagaccttatctcaaaataaataaataaataaataatatggtacactttttaaagataaaaaatagaaaaatgcaacaatttaagatgtttatgtgtagtatattgtatatacacaagtgatgaatattcattgggccatatctgaatattcaaaaatgcaaaaataaaaaaagaaccactttaatgcacggtacttttaataatttctaaaaataccatttactacctaacactgaaaaaaattgttccctctagttgttaaaagataagtgtgatgaaatagtacaatattattgcccaaagatcctaagactatcaatggtcttagtgtatattttattttagaatgaaaataacacatgctaatcaccattattaacaagcatttctggtttttgttgctttttaccttaaaacattttataatatattatttattatatatatttagatcagatttaaaatattgtattaagttaattcatgtaaaaattataatttagctattaggtttaaaaatgagttttatttttaacttttgagctctatatcccatttttaaaaactattcaaagtaaatatttccacctctgctttaaaaaataaacaatgaggccaggtgcagtggctcatgcctgtaatccaagtgctttgagagggtgagttgggtggatcacttgaggtcaggagttcaagaccagcctggccaacatggtgaaaccccatctctactaaaaatacaaaaattagctgtgcatggtggctcctgcctgtagtcccagctgcttgggagactgaagcaggagaatcacttgaacccaggagacagaagttgcagtgagctaagattatgccgccgcactccagcctgggtgacaaagcgagactccatctcaaaaactgaaccaaaccaaacaaacaaacaaacaaaaaatgagcttcctttcagcctaaaggagacatcttttttctttctcttatcttagtgccattttcttagccccattaagctaccaccttgcattttaaagagtagtagccaatcagtcagtaattaatcaatgcctctcctttctgtgaaggaggaaggcccttgctggttgtggtggggaatctccggaatctggtagtctggttaaatggctcatgttggaaaagagaagtggtgggagaaatgccttattaattgtgaacttgattgagctttattcacctttaaaataaaattttcaggtcggggcacaatgactcacacttgtaatgttagcactttgggaggccaaggtgggagggtcacttgaggccaggagttaaagaccagcctgagcaacatagcaagaccctctctctacaaaaactaaaaaaattagccaggtgtggtggcacacccatgtattcctacctacttggaaggctgaggcaggaggatcccttgagtctgggagttcaagactgcaatgagctgtgattgtgccactgcactgcagcctgggcaacagaatgagaccctgtctctaaaacaaaaataaacaaaataaaattttcagttttagaatatatgtacttagagcactagaaacagatatatgtacagtaaaatagagatggcctggtttcctgcactgaggtagatagacgagctggcccttcagtggcagagaggtgaggtcagagaaggccattgaattggcctgaagacctaggcttgcctgccagtaaccatctccttagagtagaacttggaagctccatggaggagagaggggcaggctttagaactgggcacttctaggatggattgatccttgacttggccacttagtagttgtttgaccttggccaagtcatttaacctaggtttacttactagtaaaataaagtcaattatatctatcttgagaattaggtagaatatctctagaattcctgcttgtcaataaatggtagctattaccaatattatactcatagtcagggatgagaagccaagctttgttccccattggtgatattttcaccgttgattcctgagtttacgatctagtctaaaattatccagtgaaagagagtgtagaattttttcagatgagatgtgcttttgtccaacaggtcactcagtaatcacttattaaaacccttacaatatattaggtatcgtcctagatactggggatataaaattgaataagacaaactgtctttccaggaacacagtgtctaaacaggtcctaagaaagcctgagatttttgttgtccctaagctattctttgccctgttcattgatgccttagcagcagaagggagtacacttgcctccctgtggcattgaacttgattgatgagtagtccagaaatcctctccacatcccatcataattttatccaagaaataaaggatatcaaaatggcaattctagttaattctggccccacagctcatgctatttgagaaggcagcaaggtctgcattttctttttcttttctttctttctttctttctttctttctttctttctttgtttttattatactttaagttctgggttacatgtgcagaacgtgtaggtttgttacataggtatacacgtgccatggtggtttgctgcacccatcaacccatcacctacattaggtatttctcctaatattatccctcccctagtcccccaccccctacaggccccagtgtgtgatgttcccctccctgtgtccatgtgttcttattgttcaactcccacttatgagtgagaacatgcggtgtttggttttctgatcttgtgatagtttgctgagaatgatggtttccagcttcatccgtgtccctgcaaaggacatcaactcatccttttttatggctgcatagtgttccatggtgtatatgtgccacattttcttaatccagtctatcactgatggacatatgggttggttccatgtctttgctattgtgaatagtgcctcagtaaacatacatgtgcatgtgtctttattgtagaataatttctaatcctttgggtatacatccagtaatggaattgctgggtcaagtggtatttctagttctagatccttgaggaatcgccacactgtcttccaaatggttgaactaatttacactcccactaacagcgtaaaagcattcctatttctccacatcctctccagcatctgttgtttcctgacttttgaatgatcgccattctaactggcatgagatggtatctcattctggttttgatttgcatttctctcatgaccagtgatgatgagcatcttttcatatgtctgttggctgcataaatgtcttcatttgagaagtttctgttcatatccttagcccattttttgatggggttgtttgcttttttcttgtaaatttgtttaagttctttgtagattctggatattagccctttgtcagatgaatagattgcaaaaattttctcccattctgtaggttgcctgttcactctggtgataatttcttttgctgtgcagaaactcttcagtttaattagatccccgtttgtcaattttggcttttgttgccgtttgcttttggcgttttagacatgaagtctttgcccatgcctatgtcctgaatggtattgcccaggttttcttctaggatttttatggtcctaggtcttacatttaagtctttgatccatcttgagttgatttttgtataaggtgtaaggaaggggtccagttccagttttctgcatatggccagccagttttcccaacaccgtttattaaatagggaatcttccccatcgcttgtatgtgtcaggtttgtcaaagatcaggtggtggatgtgtggtgttatttctccgttctgttccatcagtctgtgtatctgttttggcaccagtaccatgctgttttggttactgtagccttgtaaagtttgtagtcaggtagcaagatgcctccagctttgtccttcttgcccaggattgtcttggatatgcgagctcttttttggttccatatgaggtttaaagtagttttttccaattctgtgaagaaagtcagtggtagctggatggggatagcattgaatctgtaaattactttgggcagtaaggccattttcacgatattgattcttcctatccatgagcatggaatgtttttccatttgtttctgtcctctcttatttccttgagcagtggtttgtagttctccttgaagaggtccttcatatcccttgtaagttgtgtccctacgtattttattctctttgtagcaattgtgaatgggagttcactcatgatttggctctctgtttgtctgttattgatgtataggaatgcttgtgatttttgcacattgattttgtatcctgagactttgctgaagttgcttatcagcttcaggagattttgggctgagacgatggggttttccaaatatacagtcatgtcgtctgcaaacaaagataattggacttcctctcttcctatttgaataccttttattgctttctcttgcctgattgccctggccagaacttccaacattatgttgaataggagtggtgagagaggtcatccttgtcttgtgccggttttcaaagggaatgcttccagtgtttgtccattcagtatgatattgtctgtgggtttgtcataaacagctcttattattttgagatacgttccatcgatacctagtttagcatgaaaggctgttgaattttgtccaaggccttttctgcatctattgagataatcatgtggtttttgtcattggttctgtttatgtgatggattatgtttattgatttgtgtatgttgaaccagccttgcattgcagggatgaagctgacttgatcatggtggatcagctttttgatgttctgctggattgggtttgccagtattttactgaggatttttgcactgatgttcatcggggatattggcctaaaattctctctttttgttgtgtctctgccaggctttggtatcaggatgatgctggcctcataaaatgagttagggaggattccctctttttctattgattgggatagtttcagaaggaatggtaccagctcctctttgtacttctggtagaatttggctgtgaatccgtctggtcctggactctttttggttggtagactattaattattgcctcaatttcagagcttattttggtctattcagagattcaacttcttcctggtttagtcttgggagggggtatgtgtccaggaatttatccatttcttctagattttctggtttatttgtgtagaggtttttatagtatcctctgatggtagtttgtgtttctgtgggatcagtggtgatatcccctttatcattttttattgcgtctatttgattcttctctcttttcttctttattagtcttgctggcagtctatctattttgttaatcttttcaaaaagccagttcctggattcattgattttttgaagggttttttgtgtctctatcttcttcagttctgctctgatcttagttatttcttgccttctgctagcttttgaatgtgtttgttcttgcttctccagttcttttaattgtgatgttagggtgtcgattttagatctctcttgctttctcttgtgggcatttaatgctataaatttccctctacacactgctttagctgtgtcccagagattctggtacattgtgtctttgttctcattggtttcaaagaacatctttatttctgccttcatttcgttatttatcaagtagtcattcaggagcaggttgttcagtttccacgtagctgtgcggttttgagtgagattcttaatcctgagttctaattttattgcactgtggtctgagagacagtttgatttctgttcgtttacatttgctgaggagtgttttacttccaattatgttgtcaattttagaataagtgcaatgtggtgctaaggagaatgtatattctgttgatttggggtggagaatactgtagatgtctattaggtccacttggtccagagctgagttcaagtcctggatatccttgttaattttctgtcttattgatctgtccagtattgacagtggggtgttaaagtctcccattattattgtgtgggagtctaagtttctttgtaagtctctaagaacttgctttatgaatctggtgctcgtgtactggatgcatatatatttaggatagttaactctttttgttgaattgatcccttcaccattacgtaatggccttctttgtctcttttgatctttgttggtttaaagtctgttttatcagagaccaggattgcaacctgtgctatttttttactttctatttgcttggtaggtcttcctccatccctttattttttttattttttatttttttgagaccgagtctggctctgttgcccaggctggagtgcagtggtgcaatctccgctcacagcaagctccgcctcccagggtcaccctattctcctgcctcagcctcctgagtagctgggactacaggtgcccgccaccatgcccagttaattttttgtatttttagtagagacggggtttcactgtgttagccaggatggtctcgatctcctgacttcgtgatctgcctgcatcggcctcccaaagtgctgggattacaggtgtgagccaccgcacccagcccatccctttattttgagcctatgtgtgtctttgcatgtgagatgggtctcctgaatacagcacactgatgggtctagactctttatccaatttgccaatctgtgtcttttaattggggcatttagcccatttacatttaaggttaatattgttatgtttgaatttgatcctgtcattatgatgttagctggttattttgcccgttagttgatgcagtttcttcctagcatcagtggtctttacaatttggcatgtttttgcagtggctgggactggttgttcctttccacgtttagtgcttccttcaggagctcttgtaaggcaggcctggtgatgacaaaatctctcagcatttgcttgtgtggaaaggattttatttctccttcacttatgaagcttagttcagctggatatgaaattttgggttgaaaattcttttctttaagaatgttgaatattgacccccactctcttctggctggtagggtatctgcagagagatccactgttagtctgatggcttccctttgtggttaacccaacctttctctctggctgcccttaacattttttcctccatttcaaccttcgtgaatctgacagttatgtgtcttggggttgctcttctcgggcaatctctttgtggtgtattctctgtatttcctgaatttgaatgttggcctctcttgctaggttggggaagttctcctggataatatcctgaagagtgtttttcaacttggttctattctccccatcactttcaggtacaccaatcaaacgtagatttggtcttttcacatagtctcatatttattggaggctttgttcatttcttttcactccttattctctaatcttgtcttctcactttatttcattaatttgatcttcaatcactgatatactttcttccgcttgatcgaagtggctattgaggcttgtgtatgcttcacggagttctcgtactgtagttttcagctccatcaggttatttaagctcttctctacactggttattctagttagccattcatctaaccttttttcaacgtttttagcttccttgaaatggattagatcatgctcctttagctcggagaagtttgttattactgaccttctgaagcctactctgtcaactcatcaaactcattctccgtccagttttgttcccttgctggcgaggagttgtgatcctttggaggagaagaggcattctggtttttggaattttcagcctttctgccttggtttctccccatctttgtggttttatttacctttggtctttgatgttggtgacctacagatggggtttgggtgtggatgtcctttttgttgatgttgatactattcctttctgtttgctcattttccttctaacagataggcccctcagctgcaggtctgttggagtttactggaggtccactccagggtctgcattttcaacaaatcacctgttgcttcttcccggcataacgcctgagctgactgggactgatgaagcagacctgttaccactcaccactggccaattttaaacttagtttcagacatttttgtttcctttttcctctctataattctcatgatgccaaaatgactacatatttggtctcagttgctatctcatagagctttgttgttgttgttgtttctactctagaaatacctagttttggctcaatggcttcccattggttgtacaacccagcaccattggagctctgatcccccataacctcagcccagctctttctatctcatgtctttcaacaaaatcagtcccagactgggtgtggtggctcatggctgtaatcccaacaatttgggtaggccaaggcgggaggattgcttaagcccaggagttcaagaccagcctgggcaacacagcaaaacctcatctccacaaatttttttttttttttaattagccagatgtggtggccacacacctatggtcccagctacttgggaggctgaggtgggagggtgtcttcagccttggaatttgaggctacaatgagctgtgatcacaccacctgcactccagcctgggtgacagaacaagaccctgtctcaaaaaaaaaaaaaaaaatcagtcctaattacatatatgtgaagaattattaggcctaaaacctggtctcctttgcaaagaagagagttaagtttattatacatgtatttgtctaaagtgtctgatttactttttttcctgttttaaactctctcaggaaatctttctctttattccaagaggaagtagctcttgtaataaaactatgatcaatcttcagtgaattttaaaaataagcattctatttctttaattgcctgtagtcacatctttctggtatatttttttcaaacaactagtccttacaatttcacatcacttccattgccatatcattcacataactgactcatcatttctaattgtaagccagcacacacaacatgcagatctgaagcaattttcctgatgacaggggcccagaagctcatattaatggaaagactgtaggatgtgaggttaaaaggcttgtgtatgagccccatgtttgtcatttaaccctcatcctgtttagagaaagaaagtgcacctcgctgccagtgctgatttaattttacataaacacgctctttgaggctgaagcaaatctgacagattttcaatgtgaaaataaaatagaggccgattgcagtggctcacgcctgtagttccagcactttgggaggccgaagtggggagattgcttgagcctaggagtttgagaccagcctggccaacattgcgaaatccatctccacaaaagatacaaaaaattagccaggcatgatggcgcacacctgtaggcccagccactcaggaggctgaggtgggagaattgtttgaacccaggaggcagaggttgcagtgagctgagatcacgccactgcactccaacctgaatgacacagtgagaccctgtctcaaataaataaaaataaataaatgaatataaaaactgttcttggagttgtttctaaatagaacatcaaaatcatctattttggaaaaatcagattcatcgaacgattttttggccaacaactgtttgagaatgatgttaacatcacacatagaaaggctgtgttttctaggatttgacattttcagcaatagagaaatactgtattttgtaaataggaataccactactaaaaccataatgctataaatagaatgatgtcttttgtttccaaagtcgatatactagagcgttgcgaaaataaaagcaagatatttcatgacaaacttatcctgaggtaaacaactgcagccgttagtgttgccaggcaaatattctcagggcaaacaggaaaagggttaatgcgcatctctctctagcaagtcatgtgacctctctaggcctccattgcatcagctgtaaggtaaaagccttggaatagttttcaggttatcaactgctttttaacaaaccaccccagaatttagtggcttttaaaacagctatttattttgctctcaattctgagttatgaatttgggaagggctcggcccagcagtttgtttgggatccctgtggcatcaggtgagatgctgggttagataattcacttccaagacagcttcttcactaaccgtcggtgccttttgctccttggcctctctctctctatctacccagcatcttaacctccagggcctttccctgtatcttgggtttctcacagcatggttttctgagagtagtcacttttttttacatggcagctggctttaaagtagcaagaagcaaaaggtgccaggccagttaagggccacatcagactggcacgtatcacctctactgtgtgcatttgttgaaagtggttacaggactcacccagagtcaaggctggagagacagacttcacctcttgatgggggaatagcaaagtcacattgcagatgagccagtaggatatgcctgtaaatagtaaactgtctctcttatgcatatgtatatggtcatcagtgaattataaattgtatcaatatgatggatctatagcacacaatttacaattgtaatgttttgtaaattccatatctcagttgatgctcacagaatgctttcattgatttttgccatactcttagatcagtagtagccaacctactattgcaaataaggactttatcttattcatggttaagtcaacttcggtggcattatcttcttccattccagtggactcttcataaataaaagtgaaagaattgtgaatcccaatcacaaactagaataatttgtttttcaagaggctcataataatgacattttattgactctacagtgtacaaagcactttcaaatatgctcttgattaattctcatgatattgtgaagaatttcctcctggttttccagataagaaaattggggtttggagtgaagtgactcactaagggtcacactgctaatgagggcatagccaagactagaatccctgccttctgactcccagtggaccgcttttcacttcctctgctgaaaccttacatttggagaagaaatttaaaatgaacatcaagacaggattctctgccactattcaaattaaaatacctcctttcggccgggcacggtggctcatgcctgtaatcccagcattttgggaggccgaggcgggcggatcacaaagtcaggagtttgagaccagcctggccaacatggtgaaacctcgtctctactaaaaatacaaaaaattagccaggcacggtggtgcatgcatgtaatcccagctgctcgggaggctgaggcaggagaatcacttgaacctgggaggcggaggttgcagtgagccaagatcgtaccactgcactccagcctgggtgacaagagtgaaactccgtctcaaaaaaaaaaaaaaaaaaaaacctcctttcaaggaagaacgttttatagatgttaattggcgagtggtatagagcagcctcactctttctccttctggttctaggcatcactttttgcagtaagcaaaagtatcctcactgttgatcggactagtgagacaaactggacagccatgtcacagaggactcaggctcacacatatttctctgcttgcttcttcatttccaaaagtcagtagcaagcattattgtcacagttcctagtcacaggttctccatagaaactacaggggctgaggaatatatctggggagaagagacaatctgtgacatggacttaaatatagcattgaaaggagtgttgagggaaaggctcgtgtattgcagaatgatggttagttatgagagagagctagagacaggcctcagggctttttttctgtctgttccctttcctaaaatgtattattttccaaccacaaagaagactttttatctcccagtgaagtcactccctgtgacttatcattcttagttttggctgaagagtccattttgcctagaggttacaggggtgtttttattagcacctttttaaaaacatgagtaaaacattctttatagagaagttaggaaataaaaataagcaaaaatttgaaaccacgaaccatctgtaatcctgccactatttgttaacagataactaatgttaacatttcagtctgaatggcgtaagcatcccctcaaataccaaaaattacgtgacacggattatgtgttctttaaatagcaatgcattctatttgatattttctttgggtagctttaaggattatgctgaaattataagttctatttctataaacttccaatattaaagaatatataagcaactgctttctctgtagctctctggcagctagtcaaagccatgttgttgtaggcaatattctatgtagaactttccataggaaaatggtattgcttctcagaaaatgtcatgacctgcactttccttgtggtcatcgtgggtgggggatgttccgtgtgactcatagaccagactcaaggatgagtttagcaaaggcccgctcccactccctcttgccaatggcacttgaaggaagtctatcatggttttagtttggctatagtatgatattatatttattacaccttaaaagaatgtctaagctcagtatggtggctcatgcctgtaatttcagcactttgagaaactgaggtgagaggatcacttgagcctagaagttcgagatcagcctgggcaacatcttgagactgtgtctctaccaaaaaaaatttaaaaattagctgagcatggtggcgcacacctgtaatccgagctactgggaatgctgagttgggaggatcacttgagcccaggagtttgaggctgcaatgagccatgatctcgccactccactccagcttggatgacagagcgagactctatctcttaaaaaaaaaaaaaaggtctgcttcattgatgctgtatatactggggcaatatatgacctaaataacagttctgtttatctattttttttcctgtttaggcagcaataaggaaagaactaaatgaatttaaaagcacagaaatggaagttcatgaagagagtcgacagtttacaaggtaggtgacaaaatgcagcttagaaattgaaaatgcttaagatgtgatcccatgttgagttggttaaaaaaagaaattgcttacaatggtaaattttatgataggtatatttcatcacaattaaaaaatgtttttaaacagtttagcttaaaaccatcttatgaacatttccgcttctctcacattcatccttgttggcttttaagaacctaatagtcaatgtgacagttttaaagatatgactagataagattgtaaatttctagaatttcataataaactcagctatctccttcaagaacactaaaactaatcatgctgaataagaatttctaaaattaaatcttttctttcaaggaagtctgaatcattccatggggctacattttggttcctttcttcgtttttttctgggtctgaagacatcatttattctgctcttgaacagacttagttgaagttgtatgcccagaatagatgctggcgagagtcagtgtgggcacatacataacactttggtttcacaatagacataacacaggattgaagctgacttttcagaagatgtaactttaggatgggaatcctgattttactggtgacgaaggagatcgctatcatcttaccatttttccctcagtccctttcggtttctttcacaggttacctaacccggtaacaaatattgatcccctaagctacagccatacatcctggtgccactgttcctgcagtcccggtgatgatggtactgtgtgctgggagcatgtcacaatataaaggaagttgctgtataacctccaactttaacagcaaacttccctgaaattgatgggggaggagtgaggtttgttatcatagacttgctccacagcttttcttcctatcttactgtcttgtgtgccagagaaactcccctttctttcagggttacagttggccttccatatctatgggttccccatctgtggagtcaactgaccacaatccaaaattttttttttttttttttttgagacagagtcttgctctgtcacccaggctggggtgcagtgatgcaatctcagcttactgcaacctccacctcccgggttcaagcgattctcctgtgtcagcctccaagtagctgggattacaggcatgtgccaccatacctggctaatttttgtattaatagcagagacagggtttcaccatgttggtccagctggtctcaaactcctaacctagagtgatccgcccacctcagcctctcagaatgctgggattacaggcataagccaccacacccagcccaaaatattttttaaaacaaatataaaataacaccacaacaataaaaataacacagagcataaaacgatactgtataatagctatttatacagcatttacattgtattaggtagtataagtaatctaaagattatttaaagtatacaagaggatgggtgtaggttgtatgtaaattctacaccattttctatcagggacttgaggaatccatggattttggtatctgaaggggtcctggaatgaatcccctgcagacaccaagagctgaatgtacttcttctttatttttttatttcctcctatatcatttgtttttatatacatgtagagcgttccaacatcctgaatggatttttatctatttgagggctttattctatcataatctactctgagaccaacaacatgtccctatcaagccagacatttttgtccccctcttttctcccttccacttctagggtcgggaaaaatgtatgctaaaatgtgacacctgtagttgctcttctgaagtaaagttgattattaaaaggtggaatattttgagtgacatcatgctggctggggcctccgggcaactgggaagatagagtgcttggtgcagttgggtcctgatccctgagctgcagtgactgcactcaacccatacattatcattcgggatagttttgcttctgcatagttttcctagaagttggagtatctgatagccttatcttcatttgatagcatgatataaagaacaaattacagtcaaaaggaatcaaattttaaaagtacatttttatggaagttctcattttatgaaaaataaatatttatactaaaagaggttctttctgttctgttgtactctatatgaagaagcacaataaaattggagtacagggagaagtaagggtcattttgtttttgtgggggtattttttgtttttttgtttgtttgtttgtttgtttttttagtagagatgaggtcttgctatgttgcccaggctggtcttgaagtcctgagctcaagcgatcctcccagctcagtctaccaaagtgttgtgattaaaggcatgagccactgcacctggcttcttttttatatatgtatttgtatgtacaaaaataatatattctaattaagcattcaagcaatacaaaattctattaagtataaatgaaaaaccttcactcctttcccaacctcatttctgttctcacaggtatccactagtaaaagcttgatgtagatccttttagatgtttttccatgcatttataaatgtgtgtatgtgtgtatatatatatatatattaaatatgtgtatgtacatgtatgcatttatatgtaccctctctcacacataaacacagcatctaagaaatctttctataataatatatatctcattcagctggatgcagtggctcaggcctgtaatcccggcacttggggaggccgaggtgggcagatcttttgagctcaggagttcgagaccagcctggacaacatagcaaaccctgtctctactaaaaatacaaaaattagctgagcgtagtggctcacagctgtagtcccagctacttggtaggctgaggtgggaggatcacttgatcccaggaggcagaggtggcagtgagcccagatcacaccactgcactccagcctaggcaacagaaagaaatcctgtctcgaaaaaaaaattatgtatatatttgtgtatatatatatttcatttgaatgactgacatttcatagataatatgccaaaaagttattgaacaattacactattgatggatgtttatggagttttcagtttttcattattaaaacaatgttgccttgactttctttatgcatatatctttgtgcacacatgccagtatttctgtggtagtcccataagtggatttgctaggtttctgggcatatacattttgcattttggaataaactattccattatcctccaaaaagagcacttagtttacagatctacagtttaagagcatgcctagtctactcactactcatgtggtcgagaggtttatattctaaaggatgaacaataataccccatttcattgatttctattagattgggcatcttaacatacctttattgatcacttattttttattatttgatttgactatccaaaacttctgaccagctgaggcaggaggattgcttagcccaggagttctctaccagcctggtcaacatagtgagaccccatctctagaaaaaaattttaaaaattagcttagcatggtggcacttgcatgtagtctcagctacttgggtggctgaggtgagagaatcgcctgagcccaggaaatggaggctgcagtgaggcatggctacaccactgcactccagcctgggtgacaaagtgagaccctgtctcaaaaaaaaaaaaaattatgtgatcaattttttgggtagttgtttgtcttttatatggattggtaacatcttcttagatatcatggatatcagccctttattgcctatgttgcaatattttttccaatttattgttaacttttaaactttttaatggtattttgtttaaatttttgtatattcaaatctatctgtattgttatgttttacttcattgttttgtgtcttatggacggaggccaagagtataaaactattatttttacctgttatctatgctttggagaggtgcatttatttgtgtgtatgattcagaaagtaaactaactttacttttttctaaatcagtagttgattctctcaatgccacttttttccctgtggatgtgaaattctcttttaatatacacatcggtcaatttctggattgcttattatgttctaatgagctgtttgtctatccatgtctatatcctactgtttaatttggatagatttgtagtgtacttttatatttgatggggcattttttcaccctcaaaattctattggctattttttttatttactcatctagagaaatttagtatatgcttcttgtatttcataaaagtctattgatatttttattgcttatgtaaatataaacagatgcaaatatataagctttcagggagagtaacagctaatatcaagggtaaattttaaaagttctccaaaacataaattgattaacactctttaatacctttccagataaggaaaaattaaatattcatatcaccaaaataaatatgccttgcttaagtattcttaaaccttggcagtaaagcaaatgttactgctatttttccattaacttatgacatcattcgagatatattccagtagggatatagtttgtctccaagacataaaaataatgcttatgattttcaagctgttttcagtaattcttttaaggggaaaaagttctggtaatcactactctttctaataaaaataatacaaaaacatgatccagttttacatttagcaaattgttcataaaaaaggtggtggtactcttagtaccagcctctcttggggaaaataaacaccttatgaatcattaccttgccctttcaatgcaacctagatacacagcagctctcctttcctcttattagcatgagacattgtctccttataccaagtaaggcttcccttcaaaacctcaatctgtgaactccttgcagatttggggtggttaataaatgggctgactcctcttctcgggcacctctttatctagaggccatttccaacccagtgatgtactggtgtacaatggaaggacccacttctgtatatagcttcctttgcttctctatctccggagagagacacaagctggtggccaagggcaggcatgggagggagacttctcacaactcacccttttgaaccttttgaatttttgaaacattatgaatgtattacctagtcaaaaacaaacatttaaaagaaaaaataaagaatccattctctaagtccttgtttctgtaaatgaagattacgtcgtggtggcttttcttgactaatgtgttggcactaatattaattgtgacacttccacgtcttgtgcactgagggggtacctctgatacttctgtcatggaatacattccatgacatatttggtctgtagtgatgaagaactgtggtgctctactctttcatctaattctcccagtttctcccagtattttccagatggtgccctggaattggaatggatgctagggcaagaaaggtagggacaaatggtccccacaagaagtcatcccgtggccctataggtaccaagccctaacctcagttgcttagaccttgctgcttgtctggccacattctgcattttctacccctcaacagtgcccactcagcccactgttcaaaaccaaaaagtccatttgagggtgatagatcattagatagtatcattgcattctcgaaggagaccaacatggcaaacaaaagccacttccttttccatagtaaatggaatttctacaatataaaataactctctaaattctaaagataaattgcatgaaaggtcaaattttacttaagttctaaactgtaaagtagttacagctgagcagtaagattttgagtaattttaattttcctttggatatttattctctgttttcccaacagagaaagtgttaacatgtatcagatttgttatcaagagagaatatcgctttttaaaaataaacttctcattttgtaaatgatgacatttttggagtatacaaagtagtttcatatttgtatcagcttgtaaattatttacttcttatattaaggagtcttactgaagactcatagaatcattgaattgaggctcttagagttaaaatgagccgcaagagatcattggcataatgtcaagtgggaaagtcaggatattgactaactgtagcagcagtatattttatttaaaattcagatgcagccgggtgcggtggctcacgcctgtaatcccagcactttgggaggctgaggtcggtggatcacgaggtcaggagattgagatcatcctggctaacacggtgaaaccccatctctactaaaaatacaaaaaattagctggcgtggtggtgggcgcctgtagtgccagctactccagaggctgaggcgggagaatgccgtgaacccgggaggcggagcttgcagtgagccgagatcgcgccactgcactccagcctgggcaacagagcgagactccgcctcaaaaaaaaaaaaaaaaaaaaaaaattcagatgcctggaaataaagattaggaaataacttcaaaaattcttagtgctttattatagagtggggttatagtaatctttttttcttttatctacttttcaaattttcttaatggtaagaagtttttcttcatgttgagaagtttcttaatgttgagaagttttctcatgttgagactgagatattcacatacagtgacccttgaacaacctgggtgttaggggcactgatccccactcacagtcaaaaatacacgtataacttttgattctcccaaaacgtaactactaaaacctactggtgactggaatccttactgataacatagtcaatcaacacatattttgtatgttacatgtgttatgtactatgttcttaccagtaaagtaggctacaggaaagaaaatgttactttaaaaatcataaggaggccaggcacagtggctcatgcctgtaatcccagtactttggggggccgtggccagaggatcacatgaggtcaggagttcgagacgagcttggccaacatggagaatccctgtctctactaacaatacaaaaattagctgggtgtggtggtacacatctgtaatcccagctacttggtaggctgaggcacaagaattgcttgaacctggaaggtggaggttgaagtaagctgagatcgcctgggcaacagagtgagaatctgtctcgaaaatagtaataataataaatcataaggaagagaaaacatatttactattcattaggtggaattggataatcataaaggtcttcatcctcatcgtcttcatgttgaataggctgaggagaaggagggggttggtcttgctgtttcaggggtggcagaggtgaaagaacgtccaattataagtggactcatgcagttcaaacccatgttattcagaggtcaactgtatatacgtatggacacatagacatacacactttttttttttttttttttttttttaagacggagtctcgctctgtcgcccaggctggagtgcagtggcgccatctctgctcactgcaagctccgcctcctcggttcacgccattctcctgcctcagcctcccaaatagctgggactacaggcgcccaccactacgcctggctaattttttgtatttttagtagagacggggtttcaccgtgttagccaggatggtcccaatctgctgacctcgtgatccgcccgcctcggcctcccaaagtgctgggattacaggcgtgagccaccgccgccggcccatataagtattttttaaagcaatgatctcattctatactttcttgaggtgttactatcctatgtgggtttacggttaaagtaaaccactcttttcagcttctagatatgcttatcaaaatatgacatcacaggaactatacttgaaactgcaatgaaaattaataaggggtcctccaccgaggaatggaaaggctgcttttgtagtggcactgcctttcatggatactccatttacttgctacctggacagaaattaaaagagttgcaaaatgctgctttaactactaccagagttgaaagcaaggctcagtattgggaatgataagagcccagccagtgtgtggtctagcctctcaggtagaacaaggagctgtaatttaagagagcctcttcctttgtttaacataagtatatgtacaggaggatcccctgagccccagagttccaggcagcagtgagctatgatccggccactgcactccagccgtatgacaaagccaaaccctgtctctttaaaataaataaataaataaataaaatttaaaaataataagtataggtggcgtgacaatgaaactcttttaaagaaaaggggaatgaattatttaggagttttatatctatcaagtagggaagtacaagaaagtaatattttacctttgtgagtaattatatattttatgttatgtgaataaatttacaggaagggctgggcgcagtggctcatgcctgtaatcccagcactttgggaggccgaggtaggtggatcacctgaggtcaggggttcaagaccagccttgccaacatggtgaaccctgtctctactaaaaatacaaaaattagccgggcatggtggtgcatgcctgtattcccagctactctggaggctaaggcaggagaatcacttgaacccgggaggtggaggctgcagtgaatcaagattgcaccactgcacactagcctaggcaaaagagcaagactctgtctcaagaaaaaaaaaaaaaaaagaatttataggaagatgaataattttttaaaattaaattataaaggaaccgcctttattgaaatcattatctttatctgaattccataacttaaaaatagcttttcccccattccctccctctcaacagtatgaaaataagaaaaaatgtattgcagttttaaaagaaagaagaaaatatgtatgactttagattggagtctcaggaaagttctgaaaagagggtggacaaaaggcttcagtatccttagggcacagtaaatctatttattcctccaccaacttgaagcctaaagccaaaactgtcatgctgtcacatagacaaacttctcaagacgtaaagctgaacttctcctaccttaaaatgaatgcaaactaccgagaaatagcaaaataccgagaaataacaaactgaagagtattttgcattttcagtacctctaaccacagcgttttagagctgaatttgaagataagctgagtaatttaaacaggataaaagtgtcattttcagattggatagagcaggaaaatatatggcttttgttttccttctggttgttactttttaccgaatctgggcaatctatctaaagaggggtcatagttctgacctctggctttgtgagcatattattgcacgcacggtatcaattggtcaccttcttttcctagccagcccttgaagctgtgttggtggcctgtgaccttccaatgcaatctagactgtggaactcactgtgtactgcgatccatgggcaaatggtgtgtgcaggaaaaaaaaaaaaatcttacactgtcctcagttatttttgaaaattaaatacagaatactttccaggataatattgggctttcaaagattatctcttctggctgggtgcggtggctcatgcctgtaatcccagcactttgggaggctgaggcgggaggatcgcttgaggccaggagttcaagaccagcctggtcaacatggcacaatgctgtctctacaaaaaatacaaaaattagccaagtgtggtggcgagtgcctgtattcccagctacttgggaggctgaggcaggagaatctcttgaatccaggaggcagggtttgcagtgagccgagatcatgccactgcactccagactgtgtgacagagtgagacggtgtcccccccaccccccaaaaaagaagattatctcttctggtccattgactactccctttgttatccaacccaaaatttcatttaccttcttcatcccacagacattaccaatggagagagaaaacatcaggtttccttatccttgccccttgaattcaagattagatgaacatctgaagattaggacactgtggaatgtttggtacgcaaagcccagcagatttggcgagggctaaataattgctaagttagatgagcttttaactaatttttagaaaagctgaaccttagaaagataggcctttggtagctcatggtgtgagggtcctggaggtacaatgcactgtgttgtcagggctccctgggttgctgctccctttctggagtatggacaatgctggtgtgccctgctcagagggagatgctgctgctagtttggggtatcactggatgggctcttcaagtcattgtgaaaagtttaagaatagactgtagcaatcaaagtgtgacctgagagggtggaacaggatttttctctggtcaaaattgatcagaacttgaatggataatgaaattgtggtatacatacacaatggaatactactcagccacaagaaagaatgaaattctgtcatttacaccagcatggatgaacctggaggatattatgttatgtgaaataaggcaggcacagaaagataaacaccacacattctcacttacacatagaagctaaaaagttgatctcattgaagtagagagtagactagtggttattagaagataaagagggtaggggaaaggagatagggtgcagttggttaacagatacagctagatgggtggaataagttctagtgttctatagcactgtagggggactatagttaataatttattgcatatgttcaaaaagctagaagagagaattttgaatgttcctgacacaaagaaatgataaatgtgtaggatgattgatttgctagtttgatcattacacattttatgccatcaaaatatcactctgtaccccataaatatgaacaattatgtgtcaattaaaaatataataaaataatcaataaaaaatttaaataaaatttgattaaaatggacagaggtagaaattcagatgatcaccttttctattccatgctacccagagaacaccagaaaatcaccccttcaaatagaagtacagatgaagacatgttttgatctcatactgaaatgtaggttaggaagacagtctggagcatagcgcgtccacttaccagctgtctctctctgccttgggcaaatgagttagcatccccatgcctcagtttccacatctgtacaaagatgatataggagtactttcatcgtaagattgttttggggattaaatgaggaaatagatgcatagcacttggacttgtaagctctggtaagtattatattaggattgttattattatctgtgtattagtccattctcatgctgttataaggacatacccgagactgggtaatttataaaggaaagagatttaattgactcacagttccatgtggctggggaggtctcaggaaacctgcaatcctggcagaaggcacctcttcacagggcagcaggagagagaatgagtgccgagtgcagggagaagcccaatcagatctcgtgagtactcactgtcacgagaacagcatgggggaaaccactcgcctgattcaattacctcccaccaggtccctcccacaacatgtggggattatgagattacaattcaaggtgaggtttcggagggaacacagccaaaccatatcaatttgcctttcacattgtatataaaatatttgatttaagaggttttcagttactctttgaaatatttttatagaacttccatattttgcttcaggttgtggttgactcttcctagaaaacattttggaatgtcctgtcaggtgggttattgtatattagtatacatttacttgtaattaagtttaggggcttctgattggactcctcagtcatatagaattatttatagagctaacaaataacttcctagatacccctgtgtatatgtgttcagtgacttatgcattcaacaaatagttattgagcacatccctagtgagccagattgtgttctggaccctgagagtttaggacctgtctcataaggtcctcaggtggttatgttccagtagagaagcaaactattaccaagtcaacaataaatacacatgagcatttcagatagtgctaaggactgtgaagaaaaggtaataggacaggggtgggtatagatccgatggccaagaaaggggtctgtatctgtctgagttctccagagaaacaaaaccaataagatatatgtatatagatatatgagaggggatttattagggcaattggctcacatgataatggatgctgagaagtcccagaacaggctgtcggcaacctggagaccctgagatgctggtagcctggctcagtccaaggctggaggcctgagagctcgaggcagtggggagtactggtgtaagttctggagtacaaagggtggggagcctggagttgttgttcaaggacaagagaggaagagcatgtatcccagctccagtagatagattgacatagtctccttttctctgtttttgtcctctctggctctctggcagattggctgtggccaccgacactgagggaagatcttccctacctagtccactcagactcacaagccagtccctgaaaacaccctcacagactgtattaggccattcttgactgctataaagaaatacctgagactaggtaatttataagaaaacaggtttaattggctcacagttctgcaggctgtacaggaagcatagcagcatctgcttctggggaggcctcagaaagcctccaatcacggcagaaagcgaagggggagcaggcacatcacatggcaagaatgggagaaagagtggaggagaagtgccccacacttttaaaccagacctcgtgagaagtcactcaccatcacaaagacagtaccaagccatagggatccacccccaggacccaaacacctcccagccccacctccagcattggggattatattccaacatgagatttggcagggacaaatatccaaactgtatcattttgaccctggctgctcccaaatctcatgtccttctcacatttcaaaatgctttcccaaaagtcccccaaagtcttaattcattccagcattaactcaaaagttcaaaatctcatctgaaaaaaggcaaatcctttccacctatgatcctgtaaaataaaaaacaagtaagttatttccaagatatggtggagatctatactgggtaaacattcccgttcccaaagggagaaatcagacaaaagaaggtggctacaggccccatgcaagttcaaaacccaacaaggcagttgttaaatcataaagctccaaaataatctcctctgactccatgtcccatgtcctgggtactctggtgtaagtgggcagctctacccctgtggatttgcaaggtgcagcccccaggctgatctcacaggctggcgttgaatgtctgtggcttttccaggcacagggtgcaagctgccagtggatctaccattctggggtctggaggacagtgacttccttttcacagttccactaggcaatgccccagcagagaccctttgtggaatccccaactcctcatttcccttccacactgccctagtagaggttctctgtgggggctgtgcccttccagtaggcttctgcctggacacccaggcttttccatgtatcccctgaaatctaggtggagtgtctgaagcttccatcacttttgcattctgtgcatctgcaggcttaacatcatgtagaagctgtcaaggctttcagcttgcaccctctgaagcagaagcctgagctgtatctggggccctttgcgccaaggctggagccaaagtggctgggatgcagggaacaatgtcctgaggctgcacgaggcagcagggcccttgacctggccctcgaaaaagtgaaagagtgatgttgcctctgtgtatcaaatgcaggcatggcggtcctcacatctgcccaaggttacagtcagggatagactaagaacagaactcaaagtggacacattcctgctttagtaataaattgcctaccagttttgtaaagcttggtatatcttatttttcttttgacttttgtcaaacacagaagtaatataagtccctcgtatccaactagcagctcctcagttatcaattcgtggcccatctcatttcacctgctcttattttttagtttttcattttgtaatgcttgtattcaacacagtgacgtttagtaagtactatcacgtgccggagattgtattcaatgagtatgtaaaaatggataagaaagtttccttcctcagcttctcatgatccaatagcaaaggcacatgtatccaaagattatataatgtaagcaataactggcataagccaaaggttatgggaacacaggaaagagagcaattagtgcttccctgagcagtggagaaaagagtttggagaactcacagagtgagactgcataaagcgcagatggtaagagagataaaggtagaagaaagagtaggccaggtgtggtggatcaaacctgtaatcgcagcacgctgggaggccgaggacagattgcttgagtgcaggagtttgagaacagcctgagcaacatagcaaaaccccatttctactaaaaatacaaatattagctgggcatggtggtgcatgcttgtagtttcagctacttggatgctgaggtgggagaatcacctgagcccaggaggttgaagctgcagtgagctgagatcgcaccactgcactccagcctgggcaataggagtgaaaccctgtccccctctggagctccccccaacccaccctgcaaaaagtaggtagaggaaagggcattagcgcaaaagcctttttggggcaagtgattgaaatggagagtatttggaagcagtgatagagatatagctagaaccatgagttgggccactttctgaaaagccttacttgctactccaggaactttaaattttattttgttggctttcttattttaattttgttaagggacagggtcttactatgtgcccagacttgtcttgaactcctggactcaaggctgtcctcccacctcaacctcccaagcagctgggattacaggtgtatgctaccatgcccagcttaaattttattttgtaggtaatggggaacaatacgatccttttgagaaagaactgggttgggcgcagtggctcgtacctgtaatcacagcactgtggaaggcaaaggtgggcaaatcgcttgagaccaggagttcaagaccagcctaggtaacatagcgagacccccatatctaattaaaaataaaaaaagattttaaaaaccccaagaactgaaatgatggaaccagtatttttaaggatagtgtgagcaacagtgaggagcatagatttgatggagagagcctgggacagggaaaccaattaggagactggctgaccagagcagatgagcattcgactgtagaagacagagtgaaatgctaggcagagttgcataaatgtggaattgcagaagtaggctgaagagcttgatcacttaaggctttatggagaagataacttttgaccttgatcttgaaaatgaaaacatagataggaaatgaagggaaggaattgcagtattagtgaacagcatgttcaaaagcaccgggctacaaaaatgcaaggaatgttcaggaactcacaaggagggaaaggaagccagctggctggctaacaagcataccgtaaaagtagtgccagcaaaagatggaactttaatgattccaagacaggcagttgaggcaggacttggtgactaataggaaatgctggatgagggagagaaatgaattgctaatctgaggtttctagaccaaaaatatttttaaagatagaatattaaataagacaaagtgcaaaggcaggttaacaaggaaagctttgtatagttgtggacatgcttagtatatacctgtggaacatctggggggaagcgccctgtgggcttttggaaattcaagtgtagaaagtagatttggagtcgtcagcaggagatgatgagaggctgaagctaatgaaaaagtgtctatttgttactgtgcttttataatacagacgaggtgtaccaaaatccctttgtgaaacatctccctctgcttgataaaggttagagcacgatgctcaagaatagtgatgttttctgtcttggttgctgtgtaacttgaatactataaccagcatcttttatataaggtttccttatatgcttatatgtaaacatatatataaggaaagcgtttatatatgctttccttaataatatttgtaacagtattttgttatgacagaaatttgtaaacagtaattcagttgggggatatctggggtaccttttcattgtaaacatgaccacgccttattcagctcactgcatgcagaatgtgctcctaggccacaggcttatagtttctatttcttactccaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaaaaaaaaaaaggacacagatcaaaaaaacacccaaaggcttaacagaacatggaaagttcccactaagttgtgtgtgaggaaatcctcatcttgtattttaagaatctgcagatggcatccatagatacagtacagtatttactgtcaatgcaaaagaatcagtgaggttaaagtagtggaagttttccctatgagcctacagtctgtattgtttacattaagaaactctctattattgtgttgctattttccatggagtcacaggcacactatgacttctgctcccaaatacatatgaccatatgtaaataccaccttgcatttcattgttcttcacaagtgctttgtgcccctttaattaaaaacacatgaaatgaataacaaaacaagacccaaatagagtttattttattctcagagtttggactacaattttctaagatgtttctggttcaagactgtcattttctatttcaaccgaaaagtaagcatttaacccggtgaataaatgtagatcctgccattcattggtattttaaagaaccacttgaaatcggatcattttatttaaaaataaaaaatgttaatgccagttggcctactataaaaagccaggaccatgttagaattaggaaaagtaaccagcattactgcacctcttgttagactctgtgcattaataaaacacacctagagtctgttgtcatttcactaataggataagacaaattttttgctttgaaaaaatttttctgcatgcccaggtgtctgtctctggctgaggttttgtctattttacagtgtttcaatccagccataaaaattaacttgtgattttttttttcccaaagtcatgcttttccttaattatatttttattttattattttagtgtcttgagaaaaataccaagagatataatgtttcttttaattgtctatgcttaatcatctttaaacactttttaaatttctaaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacatttagaaaaaattttctaagttagagacaagtttaaaagtaaaaaaaaaaaaaaattagccactgctagtctactgtttaggtaatcggaatcaccaattattttattagaatgatggcttgagtaaaaagctgtggaaagaattaaaggattatgagctaagctgtattttgcagaatatggttctattttagtagagcagagatgagacatatccccaccggccacccagccagaggtctcctacctgggggccctaaagggatgcagaggtctggcccaccctccgtgcataggcacctctgtccaccaccagcgtttcagcaatccaaccagtaagcatatgctgtataggaaaaataaaagtgtgtgggaattggatttcttttgttgtaacacaattccaggtttttggctatttaaagtttgacattaggctgacatcgaggaagtaagtgggttttcctgagttcccaagatatgattaaggaagaaaacaaacccatctccaggaagatcccaggcaggaaagaactagacagatgtagaaaccaaagtgaccattttagtttttttattggagaataaaacattaatattagggtattaagaagatgctcagcaagcttgatcagaatcttcatggtcattaccaatcagtctgacaaaatagttctctggtagtcagcattcatttaaggcagcttgcctgataatttcctgtgttatgtgaagtgtcttgcactttcacatgttagctataattccttaaattacttaactgaaatctgtaatagagaaccattttggcatttgaacagctattttacatggagaaaaagcaaacacatctgtttgctttacccagaaaaactgactttctggtttcatcttcatattgtttagtagcataatgagagtagtcctttatctttctctaatgttagtaaatatattctgttagtaggaagttctgaaattgaagggaaaatatatttaaggaaataaaggaattcaatacacccttcaaaagtcaccaaatactgaaaataagagatgagtccttaaaacctgagtcaaaaaaggtccagttttacagcctgcaattaattcagggctgcgttggcattaaaaaagaaaatatatatatatatatatatatatatatatatatatatatatatgtatattatatatacagtagcttacacttaaaagaggaaaaatttgcattaacattgcatattctgatatgtaccatattaacacataacaggcattttatttatgcttcatagaatcagacagacacaactttcaaaaatcttactgtattcacaatagaaaagggtagtcttgtctaccacagaggagtatgtccacacttaataatgaaaactttcttcctttcctgcccaaaaatttcttcagtctgttattatttttaagtgccccttgctgcaaatttcaaacagagcaagaaatcttcctcagagtaggtggtatgaaattaaactagtacaatatatatgaattcatgtcatttacccctgagtatggtagaattgttaaagcattcttaaattccaattatatgaagcctatcattactaggaaaagtatattctttgggataagaattaatttcttcacactattagagcatgttgtgagtagtaaggaactacttagatgcaatttatttacagaattgtcccttgacctcttgaaatggctagatctttcactactgtgtaggtagtctctacttactggtaggatagattacattgctttactggacaaagcagaatgaacttatataactaaaatatgtcctatattggctgggtgcggtggcttacacctgtaataccagcactttgggaggccaaggtgggtggatcagttgaggtcaggagttcgagaccagcctggccaacatggtgaaaccctgtctctactgaaaatacaaaaaaaaaaaagtatctgggcatggtggcttgtgcctgtaatcccagctacttgggaggctgaggcagggaaatcgcttaaacccgggaggtggaggttgcagtgggcccagatcgtgccactccactccagcctgggagacagagcaagactccatctcaaaataataataatagtaataatgaataaaataaaataaaatatgtcctccagggaaaagcaatgacagagtaatcaccaaattaataggaacatctttctagagaaagtacatgcccagttagttcaaacccaggtttcaaagaagtagcactgggctctactgtaaaggcaggcagtgaccaagaggtggtggggagagaggtagagtaccctcaaatcattcccattttcacttccaatttcccttttgtaatcattaagcttaagctatgtatggaaatgcaaagcaccattagcatttctagaaagcagctggaaccttacccaccaatgcttttttgaagacagtatcatcccaaatttaaaaatcctattgtatatgttgtaaaatttctggcaaagaaatggaggatcctgtggcagctattcccacctaaagccaaccctataaggatgggtcattttttagccatgctaggatttactgcacacacaaaaaatgtcatttagcttgtcacattgctagcacagctgcacatatgagcaaagcactgttggtctgtgtttctcagtgggggtactcttggcatttggagctggataggtctttgctgtacagaatcatcccatgcattgccagatgtttaatatcccaggcccctgctgactaaatgtcagtagcattctcagtcattgtaaacaccaagaataaaaagcattcccccaggttcaaatgccctccctgggaggttggtatcacctcccctgaatgccactgtctactgcattttgaggacacagggagaaaaagtgcctatcctcaaacattgtctctgctgccttgcatttctttgggccctgaatggtttttctcccttcatttttcgagcctttctctcagtgcagctgttcttcagggaggaggttactgggcagccttggccattcagtgggcatggggacttggcctagtccctatatatatatacttaaagtccctatatatacttaaaggagagatcatacatgaagaaagcttttttttttttttttttttttgccttacaacttttctttagaaccacattattggtcataatccttgttactgtcatgaggattgttgcatgggttaaacacaaacacagactagcaatgcacttgaacaaacctggtggtctttggaaataaatcaccattagatttcacctggttatgctgcatcccataagttccaaatgaatcacctgcttatcctattaacgaagcatttaattcacacacaaatgcttgaatttcccctgtataaatgtagtcatgcgattcaacttttctaataagatttgtgaatgctgcatcatgatgaaaatgtggattaactgtgggttgcatgcctgttgttcatacttcagtgatggtcacacacaaaacaagatgagttttacttaggtgaaacattattaaactgtactaacaatacagaaacatattctctttgtcgctttttatcaccaaaactgaatggcaaatatgtcttgacattacttggatgaactgtggctagcaaaatggaattaacttagccactataattttttaaaacattaaagtttctaaattgtttttggggccgagtaacgcagagtcaataaaggtggttatattgtaagcttttagatggtgcttaagaattcttatctttttaaatagcagtattttttttttaagaataaattgtaaggagcaaataaggcagaatgccactctaccctcaggtcaattttatggtatatgaaaatgccagtaatatttgtgccacttgccaactcgggggaggaggggcttttcccttactggatacttttgttatagtttgactatgtcattatgttgtttagagagcctccacaatgagaagttgccactgcagggctaactcgccttcagaaataatcagaatgattcaagggtcaaaccactttcatcccttaaaatatagggactaatatttctttttcttttttttaaaaaaaacatttcttctgtggcttagaaatgtgccagtgtgttcaaaacatttacaccaatttcaccagatttaggacctattaaaaattcaaacaagtttcttttttttttttttttttctgtgtaacagggatttttaaataacggactatatgcattcttttgttatttcacacttcagttaaagtgataacaatggtaaactgtgatcattatcagactgactgaatgctttctgatttccagtgagtgatctagttctacgtattacacaggtgtaatatctgtgagtgtaaataactggaactgtacactgattaacatgacagtttctcttttgttgttcttatctgtactgtattatagtatgtgggtataaatatctacaagtatacacacatatgtacttgtattccactattgtaacctgaaagaaagactatgtattcccttttttaattccgtactggtatttgtgttatttaaaaagcaaaattctgctctatttagttgtataatattagaggatactttgctgtgcacaattccaagtgccttagaacattgtttagctttcctaagtatatataaatgcatatatgtataaaattgggaaaagttacctcaataaaatcattgggaaatccccagttttagtttgttccagtttctcttatatttggatagtgctcagcctttttaaatgaaaaaagaaaaaagagtaagacaacttccctaattgcctgttatttcagcttcacctaagtttttaacacctctttgtatgtaaggtcttgagacatgtaaggcctggtactttttatttaaaatgtctgtctaaagaattactgctcttaaaagaaacttccagtattttttttaacttgctatctttttatgtctgaggtatttgatattgatgtttttattgccattattatatgtaaacataaaagatagtccatttagagtttataatatagaaaataaacagacttcctcatta

SEQ ID NO: 796 - DNA, 223007 bp, Homo sapiens; identical to SEQ ID NO: 795

SEQ ID NO: 797 - DNA, 87056 bp, Homo sapiens
agctgcataaggactgcccggggctgcgcgccgggaacctcgcggggctggcgggcgccgcaccccctccctggccgcctgcgccccggggaggccgcccgcgcgcgacgggaccggcagcatgagcagcggctacagcagcctggaggaggacgccgaggacttcttcttcaccgccaggacctccttcttcaggagagcgccccagggcaagccccgctccggccaacaagtgagtggcgcgcggcgggcgctgcagcccgcgccccagagttccggggaacccgccagcccgcgccccctgcctccacgtgtctctgcggggcgctcgggggatgctcgccgggaaggaggagcgggccgagaagtggcttctgccttttcgggtcccgggaacgtgcctggagcttgtgcgtgtaggcgagggaaggcggaggaagggcggggaggctgagggccggcttctgccttccgcgccagatggcctctgcagctccgcctcgggctgccgcctgcggggagcagccccggagccagcaggcgtccccgggccactcccccaggtttccccttcgcgtccccgctgggtcgacggtcgggttcgcgcgcctgtccttcctgttagtcagcttactcatctgtggcccccagagtggcttgggtcaacgtgtaatagctaggggtggccgggtgacctgacctcccctcttcctggcccgggcgacctggtggagtgggggtccaagggcaccgtgggcctcgccaccataggctctcactaaatctccgttgcgggactcagggttgtgcgttttctgtaaagctaggttttttggtgcccagatgttttgcaaacaagctcctatgctaaatactagccagcgacagctaaccttttcgccggtttcttccttttttggaggcagcatgccgtgggaagcacgagttgggaaaagatgggaagggaacttgtgccagtttcgccagctgtagccgtgttttttgggaggccttcccgaaacggggcacgtcggctggactgaggagcccggtgctagagcccgcggcctcctggcactaggagccgcaccaggggagccgggccaacccggccacgctcacatcagattacagaagattgtaatggcacaaatttgttgcttttagaaaacaggcgttcgccaaacatttctattaataccggactgagacctagagactagaagcaagaagaatcgttcaggggccggatgataacttcttttggtggatgtgggagggtgcaatctgtcagggtggtcttgccagacctcttaagtttagccactttctgaagtaaaattctttctaaaattcggaagttctagtcttttcaggctcttaagtcccaaaccaggaggaggagaggagacggtgaagggtaagctgaagtcaagtgcccttattcagtaaccgcagttaatctcaagtcccggtgccatagttgtccgtcttgtattgtttctaaggcttaaggccccactatttacgagtcactttgagtgggatctcttactttcagcagagtgtgttctgagagcatgagattgctgtgaagtttggaagttggaaacgccctctcctcccccatgcccaccctccctgggttgtagaaaaattgcatttgcttatgctttttccatttttgctttctctttcttggcctctctcttccccttctccgttttgcattttctcctttcatttatgttgctttcaccacttgacatgaaaaggaactcatggtagtttgaagtttattccagaggtgtctgctaatctcctgaaaactggctggttcttggattctccaggggtgagatgccacaagggccaaactattcaggtttgaattgtatgagaatcctttagtgctttaaagagtaaagacatcagtttttttctaggtttatatgcatttagcgtttctttttttttttttttttttgagatggagtctcactgtgttacccaggctggagtgcagtcgtgtgatctcactgcaacctcagcttccctggttcaagcgattcccttgcctcagcttcccgagtagctgagattacaggcatgcaccaccacatctggctcatttttgtatttttagtagagatgggatttaaccatgttggccaggctggtctcgaactcctggcctcaggtaatctgcccgccttggcctcccaaagtgcagggattacagatgtgagccaccgcccccggcacatttattgtttctatgttgtatgcaatcatttatgtatcatctagcatatatattatactcagggtagtattatttagcatttagaattagtctaacattaatatgtattttgaaatatcgtgttggaaatcaggacaggaagacatagttcgtggttgaagagcttcatatgtgtatttgaagctttattgcctgcatatttttcccttctaacataacacatgtaaggtgctgagttgtagaagttatttgccaggcagagaaagtgttctaaactacgaattttagtgagcattgtggtttatttaaagaagtgatatgaatgttttaaattcctggtaagattggtgaattagggaagtaaaacatcataaatataaagcaaaacactcttaatgtagaatgttccttttatctaacgttagataagcctttttcttcattttcatgctgatgattataagaataagataagcacttctgacatacatcatagtagtgaaatttatcctttctctagagagatggaaagagaggtattgctagaaggatctattagagatacagtgattttttttttttttggatgctgtaccacctggtggaaaagtgagaaaaatgaggtttctagatttcttgaaaatatccggagaaaacaagatgtttgtggtaaatgcagaatggggagaaaggggtgagggagcgggtggactggaaatttctttcttctcttgccaggcaagggaacatagtgcaacttctttctatccccaacagtaacaaaaaccttataaagaaaatgttttcattttttttcttactttaaaccccattcttaacaacaagaacaacaacaaaaatggaaaagggttaaaaaacctgtctaggccacgtgtggtagctcatgcctgtaattccagcactttgggaggctgagatgggaggattgcttgagcccaggagtttgagaccagcctggacaacatggtgaaaccctgtctctacaaaaaaaatgcaaaaattagtcaggcatggtggtgctcgcctgtagtcccagctactcgggagactgaggtgggagcattgcttaaggccgggaggcagaggttgcagtgagctgtgatcgcaccactgcactccagcctgggcaacagagcgagaccctgtctcaaaaacaaaactgtctaaaagatataaagggaacgaacatatgacgttttgtggcagtttgaatgtcatgtttattgtatccgcagggtctcgatcagtacctgatatacagtagttgctcagtgaatgcaagctgaatgaatgaatgttttcctgatttgatagtaactgggtctttaccatttctttttttttttttttttgagatggagtttcactcttgttgcccaggctggagtgcaatggcgtgatctcggctcactgcaacctccgtctcccgcgtgcaaacgattctcctgcctcagcctcccgagtagctgggatcacaggcacctgccaccatatccagctaaattttgtagtagagacggggtctcaccatgttggccaggctggtcttgaattcctgacctcaggtgatctgcccgcctcggcctcccaaagtgctgggattacaggcgtgagccaccgcacctggcccctgatctttaccattttcaaatgtactgtatcttatggtgctcccaaaaactgtatgaaacattaacttaatgaaagggggaggtattatttagtgattgtataaggcccacacctagatagcaagaaggctggaactcaggttttcagactcaaattacactctctattttgttactttttagctataaaaataattttatggctccatattccctttgcaaataaggacacctaaaatttaagagtttcttaaaatttcttttcttttcttttttttttttttttgagatagattcttactgtgtcacccagactggagtgcagtggcaggatcttggctcactgcaacctccatctcccaggatcaattgattctcatacctcagcctcctgagtagttgggattacaggcacccgctgccaggcctggcttttttttttgtattttagtctagatggggttttgccatgttggccaggctggtcttgaacttctgaccttaagtgatctgccctccttggcctcccaaagtgctgggattataggcatgagccaccgcgcctggctgtttcttaaaatttcaactccctgacctgcatatagtcatgacagtgtttataatttgtatttgtggattcacgtatttgtggattcgctgtgtttcaaaggatccacctaatcattgttttcagcaaaaccaaaaatgtggacagttgtgtaatttattatttgccttcttgatttcccaccaaaatcaaactacctgtaaatacaggacacattcagatttccaaagaatagaaatggtctaaagttataatctgtcagagtgtgtcttacctcttagctaagctacctctcctcctgagcctttggtagttcatgggaataaggaaatgagacagtatttttgctttagaagtagggtagtcaagaagtcttgagaaacgtgaaattgtcttctgaacaacccacactttaaaaaaaattgcgctgaagaattttacttcagtaagtaagtctattagactccccatagcaggcctcaacttcaccctttcggttttctctttcttattcaaatatttttgtgcctcaattatttggttgtgtcttattgctagaatcaacagtaatgagctgcactcttttattagtgtttccattagaagtttagagctagatcactggggtaaaagaatagtggtttatgacataataggtattttgactctactagcctttttctttttttttttttgagacggagtttcgcttttgtcacccaggctggagtgcagtggtgtgatctcggctctgcaacatctgcctcctgggttcaaatgattctcctgcctcagcctcccgagtagctgggattacaggctcccgccacagtgcctggctaattttttgtatttttagtagagacgggctttcaccatgttgggcaaactggtctcaaactcctgacctcaggtgatccacccacctcggcctcccacagtgctaggattacaggtgtgagccaccactcctggcctatactagctttttaaatgctgatttttaattcccgtattatggggcataaacattttcaccagacattttgcctagggcaaggtgatttacacatcttttctgcatgtctgatatgttctgttcttacacgatattaatccattggaattttgtgtttgtgtgagcaagattcacaaaggcatattcctttaaatgaatttcagaagaaaaagtttccagtcctataaagcctcatatttgagtagtatactccttatcccatttcttcttctggccaactcacaagatttggaattatttggaaagcagtgacacaaaacatttttgaaaagaaaggctaaaaatatccaataatgtggttattctttttagacttcctttggcagtcagtgcatgtcatacggttaacattctttttctgggagaaaaaaaaactgagtctgaccaaatactttctagtgtggcctgatcaccaactcttagccctgggcattagccctcgcattttccacccccaagtctccaagcataagtagctgtctttcaataaaggccccagtttgaaacgtgtatttcactcctaatttggccaaaggccattggctagcagtccctcttcagaggggatggtgaaaagacagtaggatatatgataaatgcatgcaaaggagcttctcttctatatgacaagtcttggctaacttagcctctttgcatcttcctctgtttgaagagctacacacatttgccttgtaggaagtttttattctcatggcaagcaggcattacctctattacaaggccccgcttattgttcaccctgtgatgtaagagcttttaggactccaacaatattagccttctctttaattcctttcaggccccatcgccatctcagaaccatggcctggagttgccgccctccattctccttaacatgtcgactcagaaaagtcttaaagcccgctgttctttcccttcatagcaaaaattataatttatcattatattttgtttaatgaggacagagactagcattttttacctactacataatataaatgcttggcacttaaggtgcttgaacaaatgaaagcctgctcattttggatggatgtcccagtatttggtactgttagttttcctttatacacaaatgtacacaatgtctccccctttccaaactagaccataagccttcacagtatcttacaggtagtagtgatttaaaatgggatgatattggtaatatctgtgattactggttaagcataactcactttatatactttccccttgttttaagaaaactcatcatttattcattaatatatttagttgacaatttattgtgtgcctcctatgtgccagatactgttctaacctctggggttagggtggtgaacaatacacagtccctggcctcttttggcaatgtttttaaaaagcttacccaataggcaaatgaaaatatctctctaatttttccctaaagagcttgctcctttagtgtatttgaggaaactttgaaatgtagtttttcaggaacacacctattttgtagtgtggtaaagctatacattgattgattgattggttgagacggagtcttgctctgtcacccaggctggagtacaatgatgcgatctccactcaccgcaacctctgcctcctgggttcaagcaattcccctgcctcagcctccccagtagctgggattacaggtgcgtgccaccacatggggctaattttttatatttttagtagggatggggtttcaccatattggccaggctggtcttgaactcctgaccttgtgatctgcccgcctcggcctcccaaagtgctgggattacaggaatgagctaccgtgcccggccctatacatctgtttagatgggaatgttgacgtggaagtgtatcacttcctgttttacgtccctgtgtaaaacaatcacatttccttattgatgactgtcttccaacagaaacgtaatcatcttcaaggttagaaaatgttttttaaataacttcaaccagcgttaaccaaactggttaattcaccaaaatgttaaccaaaattaaccaaatcaaatttggtttattttccaggtctcttttttcttttcttttttcatttttaaagagatgggatcttgctatgttgcccaagctaaaatgcaattgttattcacaggcatgataatagtgccctatagcctcgaactcctgggcccacatgatcctcctgccttagcctcctgagtattccaggtttttcttaatagtttaaacaggtagttctggtttggctatcagtagtgttgtcaaatagcttttgtttgcttaattttatttttattttttttgagacaagtcttgatctgttgcccaggctggagtgcagtggcgtgatctcggctcactgcaacctccacctcctgggttcaagcaattctcctgcctcagcctcccaagtagctgggattacaggggcatgccaccatccccggctaatttttgtatttttaaagtagagacggggttataccatgttggccagactggtctcaaactcctgacctcatgatctgccctccttggcctcccaaagtgctgggattacaggcgtgagccaccacgcccggccttttgtttttgtttttgttttttttaaatggagagggccagataatgctctaggaaggatgtcagaacccataaaaaatgatgagtatttgaaatatatgtaaaaacttaagtaacaaatcagaaaatatattctgagatagaagtgaccattctaaaactgtgctgtacaatacagtagtcactagctacatgtagtttttaagcaatcgaaacgtggctagtctgattgagattgctgtgaaaaatacacactggattttgaagattagaaatgtaccctaaaacttaaagtataataataaaaaaaaagaaagaatgtaaaatatgataattaaaaaattgcaattacatgttgaaatgataatattcgataatatttgagttaagtaaatttaatgttacttattttttagcatggctatggaaaacttaaaattatgcatgtggctcgcatgatatttttgttgaacaatgctgtttgctgaagcagggctggcagcccttgccagaggtttgaatctccattgtcttggtggctgcagatggatggatgtgggggtaccagcctggtgtgttgggaagatttttctttgtgaaggggaacttgccctttactgttggggatagtttcttctcagcctatccagggacacacataccagcattttggggttgtgaaacttttgtgtggggaacttcccttttttttttccacatgagccaataagataaaactgacctaatggcattctcggtgcaactctgccttcagtttaaggacagaagagggctcatgtttcatagagtattaaaggagcaagcttaatattttgcattttgtggactgtaattgctaactgctgctacatgattcagtcagctaagaataatttactaattatatattgcctcacttggttctttttccagatgctaaacaaggtgagataattagaggaggaaaaagggtgagtttgggaattggagaccagaaggatggatttagaagatcttggagttaacggacttagaatatagtcagcaaagagttcacttaaaattagtgcaggttgccaggcgtggtggctcacgcctgtaatcccagcacattgggaggccaaggcgggcggatcacgaggtcgggagttcaagactaacctggccaatatagtgaaaccccgtctctactaaaaatacaaaaattaggcaggcatggtggtgcatgcctgtactcccagctactcggtaggctgagacaggagaatcgcttgaacctgggaggtggaggttgtggtgagccgagattgcgccactgcactccagcttgggcaacagagtgagactttatatcaaaaaaaaaaaaaaaagaaattagtgcaggttgactgtgtgtgtgtgtgtgtgtgtgtagttttctgaattcatttttcaagtattgaatattcacaatgatgctagactaagtgctagagatttggtggtgaacgaaacagattgaaacctgccttcatggggggcgtatataggttcgtctgactagtctagataagtgaatttgtgtagtaattgtttttttgtaactggcttagtttacttagcttgatgtcatcaagatttattcatgttggagtatgtgtcagaatttccttccttttaaaggctgaataatatatccattgtatgtatatatcactttttgtttatccattgattcttccatagacattaggattgcttccaccttttggctcatgtgaataatgatgctgtgaacaggggtgtacaaatatctcttaaagacccctcttaaaactttttgcgatatatacccataagtaacagttgctatagaatcatatggtaattctgtttttaattttttgaggaatactatactgacaaatttgaatccttatttaaacccaggattatggaatactgctgcttgatttcagctgtcattttgttgtctacattgtattttattgaattggcgttattcccaaatattggaaaatgtggaggtttctaatttttgctactgtaaatagcactaataaataccttgagcatgaaaccttttccattatggattaattttataggatagttgtacaaaaatggaattttactaattatgagggtgtgactttttatgattctagttatatattgccaatttatgtctatttttaagtttcattacacccttacttccattggatatagtcattaaaatagagaaaaaaaacttcaataactaaaggcaccttattgctatttaatttacattcctttattattattttttaaattattattttttgaggtggagttttactcgtcacccaggctggagtgtaatggcgcgatcttggcttactgcaacctccgcctcccaggttcaagagattctcctgcctcagcctcccaagtagctgggattacaggcgcctgccactacgccctgctaatttttgtatttttagtagagatggggtttcaccatgttggccaggctggtctcaaactcctgacctcaggtggtccacccacctcggcctcccaaagtgctgagattacagacgtgaggcactgcgcctggcacattcctttaattaactgtgaatttaatactttttaaatacttctgagtaaatctcccttgtgtgagaattgtccatgcatgacctttgcccatttgtctattaggtaggcaaaatcttgagagagcactgcttgagtctgtgcatttttagcttggtagatggttctgcttttttgaggtcagctgaacttcagggttttttttgacttacactgtttgtaccaaaaggatattacatattcaggctttcatttttttaagatggagtttcggtcatgttgcccaggctggagagcaatggtgcgaacttggctcactgcaacctccgcctcccaggttcaagtgattctcctgcttcatcctcccaagtagctgggattatgggcatgcgccactatgcgcggctaatttttgtatttttagtagagacaggattgatcaggctggatggtctcgaactcctgatctccggtaatctacccgcctgggcctcccaaagtgctgggattataggcgtgagccaccgtgcccggcccaggcattttgaaatacttcagaatgtgtttcaggctgacatcactgaaactcagaaaaatacttattactcctgtagttacaacatgggaaaggcattgctaagaaagcatcaccataaataaacccgtgggattcagaaggtggggagttgggtgatgtgttttctactaaccatgtgttttaaaaaaaagggtgactagaagttcctgtttatctttgaatttcaataaatttagggcttgttttccaaccactctggtagaatttagaagaacctaacttatttatttttatctttttgacagtcttgctctgtcaccaggctggagtgcagtggcgcgatcttggctcactgcaatctctgcctcccagattcaagctattttcctgcctcagcctcctgagtagttgggattacaggcatgcaccaccatgtccagctatttttttttttttttttgtatttttagtagagtcagggtttcaccatgttggtcaggctggtgtcaaactcctgagctcgttatccgcctgccttggcctcccaaagtgttgggattacaggtgtgagccaccgtgcctggccagtcctaacttattttgtaagtatactaggtattgaaaaaaggatggtaggacaaactgctggaaaccttacccaccaaagataatttatactgtttacttataggcttactgtcttttgttgaaaaattgcgatgagaaaggaatcggcattggcatctattaggttggtgcaaaagtaattgcggtttttgccattactttcagtagcaaaaatctcaattacttttgcaccaacttaatactttcaggcttgttgaagcctaagtagaaaattgttgcttaatctcttttattctgattaactcctactttaaattttttctttcagaatctttttatcaagtgaatcttttaaaaagatgtgaagagttacttctgactttatgattgatagattatgagccctccttaatccccaatttcttaattcaaacaagcttactgtgaaaattttcttttttctttctttttttttttgagatggagtcttgctctgttgcccaggctgtagtacagtggcacgatcttggctcactgcaacctccatctcctgagttcaagtgattcttcagtctcagcctccccagtagctgggaatacaggcgcataccaccatgcccagctaatttttgtatttttagtagagacggggtttcaccatgttggtcaggctggtctcgaacccctgacctcaggtgatccgcctgcctcggcctccctgagtgctgagattataagcatgagccaccgcgcccggccaccgtgaaaattttctacaaatgcttgtttcgaggaatcttttttgatattttgccagcaaagtcataggagcaaaatttttttaaatgaaaatagaaaacaacatagttaaatatatcacgtaggaggaaaagtaccagtaccaaaattaactttagcatttcttagtgttttacagttaacagggcattccaagggaattaaaattcagttgattttattggactttaatttcagaggaactctgagatgagaaatttaactagcacgtttatccgtttaggccttaagcagatgcaggtttcatgacatgccagaggtaaatttaggggtacttgactgtagtgagtaatttcccagctatgggaaaatgtaaatattatgtagatggtataaagaaacaatattacgtttgtccatttaaggtctgtttctgtttgttcagacaggcttgtggattgcttttcttgccagtgttcctttaggtggaaggtacagccctttcagatatttcagaattttattttcttttatttttttgagatggagtctcactctgtcacccaggctggagtgcagtggcacgatctcggctcactgcagcttctgcttcccaggttcaagaaattctcatgcctcagcttcccgagtagctgggattgccagcacccgccaccatgcctggctaatttttatttttatttttttagtagagagagagtttcaccgtgttggccagactggcctcaaacttctggcctcaaccgatctgcccgcctctgcctcccaaagtgttgggattacaggggtgagccaccatgtccggccatatttctgttttagaattgctttcttgcttttcctctgaccagatttggtcacgtgaaactgtcaattagcatgaatgaggtgctgctgccatgcaggggtttgatccttggctgtcatgttgatggtctctgtatccaaattagtatttgtgaaatttgggggaagagaatttgggcttattgtgtagcggaacgagtacgtttcataaaggcaaacctagcaccgatatcaacaaatccacttacaatccattcctaaaggaggaagctctgttacagttttaaaattaacattacaatgcatcttgcttgtttgaggtgagggcttaaaactcagtaatgaaaaagagggagaactataggctaaaagggtgtgtgttcttaattgattaattgcaagcagctatgtagggcaccctgtgtttaaatcagtgctagctgtattatcttgagcaagtcattgtacctctttgtttttttaatttatttttattttttacatttttaagagacagggtctcactatgttgctcagtttggtcttgaactcctgggctcaagtgatcctcctgccttggcctcccaaagcgctggtattacaggtatgggccatcacgcctggcaaatcgttgtacctctttgagcctcagtttcctcatttgtaaactagtaggatgcctggaagttcataagcattaataaatgttagcaatagttattatttcttgagacggagtcttgctctgttgcccaggctggagtgcagtggcgcgatctaggctcactgcaagctctgcctcctgggttatgccattctcctgcctcagcatcccgagtagctggaactacaggcgcctaccaccacccccgggtaatttttttttttttttgtatttttagtagagatggggtttgactgtgttagccaggatggtctcgatctcctgacttcgcgatctgcccgcctcggcctcccaaagtgctgggattacaggcgtgagccaccgcgcctggccagcaatagttatttttaaaagatcctcctacatgtgattatatgccccttttcatttgagggtagtagaccatatggagaactgacagtggttgagagatttgaagggaactaatagtccagccaaagagcgaaaaatggcaggaaattggaaattaggtctgtctcattggctttattaaccaaaatgaattgggaatctcaatgtaattgatcaggaaggagctccagtcattcctggaggattaatttattattattattattattttttagctgcataccatatcactgtggtgcctttgtttttggaatggagctgttgcctgctgaccacgcctgggggcacctaatcacaagtctttcccaacttctttttcctttaaagcaagccactccagttgaaagagaatgattagacatatgaaagtgtggttttgtttgcccaagagtttatgtataagttaacacattgtacacttttttttttttttaaacttcctctttctctcttatctgcctctgatcacgggatcctggttagttttgctcagggcagctcgcttgacctggtgacaaattccgcttcttcctggggctttcctttttcctccagaaagtcttgtgctcatggtttaggaacttagtcactgtcgtctttctggttttcatgagatcaaatcaaataaggtaatacgtgcaaactgtataacgtgctgcaaaggcagactctgctgctgtccttagagtccagttccctggccgtggctgggttcccagccctctgttctctctccacagagtgactgtctcggctctgagggtttcagcgatactggatgcttccacatttaggaaataggcctgcttatgctccagtgcaggcattaaagctcaatgagtcatgtgatctgcttggccgactcttcagagttcgtttgtactcagtaaaattagtatgagtcttggaacccggtgggaaacctcttcctagtcctacaggccggatgcgccttctgagttttcatattatctctccacccccaacctccccctcctttggttgtatgtttctcacaatgaattggttgttggaaactggctttgtaataattccaaatgccactgtgaagatttttaatagcctttaaaatttttaattggctgagctgtagtgttattgatatatttttgtataaatgttattattaacaagttaattcatataaagggcttggaactatacctggcatataagtacatgtttaataaagattaacttatttctgccgggtgtggtggctcacgcctgtaatcccaacactttgggaggccgaggtgggcagatcacttgaggtcaggagtttgagaccaacctgggccaacatggtgaaaccctgtctttactaaaaatacaaaaattagcctgatgtgcttgcttgaacttaggaggcggaggttgcagtgagccgacatcatgccactgcactccagcctgggcaacagagtgagactcttgtctcaaaaaaaaaaaaaaaaagaaaaaaaaagaaaaagattaacagtatttctaatggtattagaattgttttattttattttttgtttttgagacagggtctcgctgtgtcacccaggctggagtgcagtggtgggatcatgcctcactgtagctagccttgaactcctggactcaagtgatcctcccacctcaacctcctgagtagctgggactagaggtgcattctaccatgcctggctaattttaaaaaatgtttttgtagaaatggggtcttgctgtgttgcccaggctggtctggaactcctgggctcaagtgatcctcctgccttggcctcccaaagtgttaggattacaggtgtatgccaccatgctcatccagcattcttaattaaaataatttggtaggagattttatgaaggcagtatgttcagtagaaaggtttggggatccagaattgggagactattttaattttggatctgttatttactagctctgggagcttgagcaggttccttacttaagttccttgagtaacagtttcttgatctttaaaacattatagaggggttaaatcagataatgtatgtggaatgtattcctagattatagattattacataattgtaagtgtggtagcaatcacaggtgtgtttagagactactaaaaaatggttttctcttttaatcttgtctgatgtaaattaatgacacattctcagtcgactgtagtattgacacttgataaacagtttttgaaaatgaatttattctccatctcttctatgtctgcttttatctgcaaagtcgtgatttgtgtttggggacttgaacaattgatagctaagcatcaactttaaattgctttatgaattgatgattgtgtttatgaagcactggtgatttgggggaagatgacattttagcttactgttggatgcatcagggaacttgagttaatttagctttaagccttccagattatcctgcctatgagcttcacaagggcagaccacatctctagttttcaccatgatattttcagtgctatcttggtgcctggcacagaggacagagggagtcccaattatatttgttaattgaccacctggttttcatctgatcagacttgtgtcagaattataatcaaggaaaagttgggcaaaggcactaaaatgagtttcttttggtttcagagggagtaataataaaacaacagtaatagcttatgtattcatgtggaaataggacatttaggtgaaaagtacgttgggccaggggtatggagatctagctcctaggactggtcctttattaaatagcagagataactttgggagagttacttaaccatttttggcttcagtttcttcctcaaaggccctgtccagctgtgtggcaaatggttagtttattctggagcagaattactgattggagggaaagtaacagcaataggatttgagagggcttcacaaatgttttgagatgccaaatgaattagtttagaaacagctatattaggtcatatctgcttggatagggagaacccaagtgagttgagtcatgggtgtttgagaaatgaatagaatatgtagaattatttcttttccaaaagagggaatgtcttgggaaagaaatcaaagggaacctgggtgatatctttgattcatcccctatctagtgccaacaagaacaagtttctttctttcttttcctttttctaagaatggatttcatgtaagccaaaagaacacttgattgttctgaacttgtatatattgcaggagttataaatataatatcaagaactatttaataagagcccaccagcagttccacgttcctcaaaaccaggacaggatgaatgtatgagaatcatcttcttactgagaatggtaggacagaagggatagtttagccactatacttcctggaagaatcagtacttgagggttgctgcagctttttgggattgaaggagtatgttcatttcctttggaagattaattttttccttttttttgacatggagtctctctctgtcgcccaggctggagtgcagtggcacgatcttggctcactgcaaccccacctcccaggttcaagcaattctgcctgcctcagcctcccgagtagctgggattacaggcatgcaccaccacacttgcctaatttttgtattattagtaaagatggggttctgccatgttggccatgctggtcttgaactcgtgacctaaggtgatctgcctgccttggcctcccaaagtgctgggattacaggtgtgagccactacacccggcctgattaatttcttttacttgcttcaagtgtctcctttattccagcctacacatagaggtaaatattcctaggaaactttcagcaagttaaatcctattataaaatgccagagtcagttgtctaatttttattttattttattattattatttttttgagacagggtcttgctttgtcacccaggctggagtgcagtggcgtgaacacagctcaccacagccttcacctcccaggctcaagtgatcgttccagttcagcctccttagtagctgggatcacaggtgcagaccaccacacccgactaattttcttttttttttttttaagacaaggtctcactctgtcgtccaggctggagtacagtggcgtgactttggctcactgcaacctctgcctatgggttcaagcaatcctcccacctcagcctcccgagtagctaggactacaggtacgtgccaccacacccagctaatttttcgtatttttttttttgtagagatggggtttcacagcattgcccaggctggtctcaaacacctgggctcaagccgtctgtctgccttgacctcccaaagtgctgggattataggcatgagccactgcgcccgtcccactgctattcttccagctagaaggactatacttaaatgcataattatacaaccttttgatatgttatgaaaatcataaaaaattatttttctagcaactcctgcccttttcattaaacagatcctagtagtcctgaaattctgtggtggatttttatatgtaatgtgataatatgaagaaatagctgattttggtagctgctcacatattatgtttgttttaattggaaaagttggcctatgaaaatgagtgttgtataaaaatggtttatgtggaccaggcgcggtggctcatgcctgtaatcccagcactttgggaggccgaggtgggtggatcacctgaggtcaggagtttgagaccagcctggccaacgtgatgaaaccccatctctactaaaaatacaaaaattagctgggcatggtgtgtgcgcctgtaatcccagctactcgggaggctgaggcaggagaatcacttgaacctgggaggtggaggttgcagtgagctgagattgtgccactactccagcctgggtgacagagcaagactccatctcaaaaaaaaaaaaaaaagaaaaagaaaaaaagaacaagaaagaaaaatggtttatgtgaactaaaaggttgtttgcattttgtggcaaataacagcaccaaattcccagatcctaaatgtttcagttatgaaatatttgaagtacctctgaatttacacataggcattccactcatgtaagcactcattgattttaagatttttcattcatcaaaagggaaaatgtgggctgccatatgtataatttttgtcatccaaaaaagagatataaagttaaaaattagcaaggccatggtgggtcatgcctgtaatcccagcactttgggaggctgaggcaggaggattgtttaagcccaggagtttgagaccagactgggcaacagagcgagacattgtctttactgaaaaaagagaaattatccaaatatggtggtttgtgcctgtagtcccagctatttgggaggctgaggcaagaggtttgcttgagcttagcagtttgaggctgcagtgagctatggtcacaccactgcactgtagcctgaatgacagagacagaccctatctcaaaaacaaaacgaaatttaaaaaaagggtgcttagaaatcctgaactgttctttttactcccaggacatgtgatcatatgcctactcaggaatgagttatagctagttctcagtagatgtttagttattaaaatggaatgaaggcatgaatgtggggatgaagtagaggaggggctgggttggagatactggttaattgggaggcattagtaacactgaatgtgggcagagaggtggtgagaaagaggagtcaaggaagagttgtaggtttctggtttgggagccttggaagatggtgctagcaagcagccactcaccaagaaatcaagtaagaagaaagatcaggtttaggagggaagacacattcaggcaatcaatatatggcatacaccaggcagtcaataaattttgagtgagtaaatctgggcatgtgtgttttgagatgtctgtgggctatcaaagtttctggagtttcttatcaagaaggtagacctggtctgcagagagagcttcaggattcgttgaagtcatgggcttagatgaactatgtgtgtaaagcaaaaaaggtgtctttagacagaagcatggaggataccacagaagcatgggggcaccagcaggtaagaagtgggcagagaagggcatgtccatggaggaaccaaggagtggtcagagaagctggagaaaaagaaaagggtggttgtcctgggatcggaggttgggaccacctcaagaacaagggcttggccatgggacaagtgcttcagaaaagccaagaaggcctggggtggaactgtgtggcagtctctggagaccttgaggagagccactccagtgaactggaggcgtacagtcacactgcagtgggtggtgagtgaatagtgcagaggaagcaggagagtgagtagaggtgctcttccgtgaggcttgtctggcaaggagaggatggtgtagtaaaatgaggagcctacaagggcgagggaagtggtaagggtgttgtcatcgtatgtaatgtatgtatgtatgtatgtatgtatgtatgtatgtatgtatgtatgtatgttgagacatagtcttgctctgtcgcccaggctggagtgcagtggtgcaatctctgctcactgcaacctctgtctcccgggttcaagattctcctgcctcagcctcccaagtagctgggattacaggcacctgctaccacacccagttaatttttgtatttttagtagagatggagttttgccatgttggccaggctggtctcgtctcaacctcctgacctcaggttatccgcccacctcggcctcccaaagtgctgggattacaggggagagccaccatacccggcctgttttttatttatttttagatgagaggacttcaatggaaagaagactgagtgtcaggggagtgaggatcattgaaagagatgcctcccttcgcactggaagggatgatatttggattctaagtagaaggctgcttagaaagaagacgtctctcccatcgttgagtggaggagaagttcaatctagaaatgtgtatataatacaagagggggtgactaggcctttcagttggtggcaggtggatattgatggaggaggtgggtatgcacatgtgggagtggtgcatgaagagaagcccacacaggcaggcaccgggccagaagaggggagtgctggggtatttgggaccaagtggtggtatggctgcagcaaaggttgccacgccaaaggtgtggtgaaaaactacgctggaaaggagggagggttggcaggctctgaaaggccgtgcttgccagcctgaggattgaatattttgtgagtaaggaggagccacttagggagaaataaagtggtcagacctatgattttaaaactgacagcagagtttagagggcaagaggggtagggatattgtttggaaggtgattgcggtaacctgggtgaaggtaattagggctagaaataggatagttgcagtgggagagagaaggactccagaaattgagttgtcacattggcacctgatcgaccagggtgaggggaggcaaggaaggagacgagagaaaagaaggaggtatggaaggtggctgggtgggaggatggccatgccactgtggaatggggagcacgggaggaagaggaacaggtttagtgaggtaggggaacaactcggttttagggcctatacgcaacatttgtgtagcatccagctgcagccagaattaagggtctgaagctcaggacagacctcagatctcatggaagcatgagatcatcatccttgaattggaagtggttgagatttatttgaaataacaagagaaaaataaatcttgatgtggatatggactggaagagtaaacttcacagaccatttgagtgtatttttaactttcttagaaaaaaagtctttgaagaccagaatgtggtggtgctccacaaatagctcaaaattagcacatctagaataagctagaaaataaatctaagcagtttcaatagaaatgctgttatcttgatctggctctatttgttttttttcctatcaggttaaaatctgtttcttcaatcattttgtttattccttttgataagagacttcagaggactgacagggactagctggttatgtttttgaaaagtctttgaagatgaaacatatgttttgagtgtggtgacactgcattaattattctctggttttgacaccagtggatactgatacggtttggatgtgtgttgccttcaaatcttatgttgaaacgtgatccacaatgttggagttggggcctagtgggaggtattggattatggggatggatccctcatgaatggcttagtaccacctccttggtgatatgtgagttcttactctgttcacgtgagagctggttgtttaaaaagagcctggcacctcctcctctctctcttgttccctctcctgccatgtgaccacctgcttccccttttcctttcacctcctgaggtcctcctgaggtcctcaccaggagcagatgttggtgccatgtttcctgtgcagccaacagaactgtgagccaaaataaacctcttttctttataaattacctagcctcagatactcttttatagcaatgaagaaaagacaaacacagaaaattggtaccaggagaggggcatcgcaataaagatacctgaaaatgtggaactggctttggcactgggtaataggcagagattagaagagtttggaggggtcagaagaagacaggaagacaagggaaagttttggaacttcttagagactgattaaatttgaccaaaatgctgatagaaatatggaccaagtggggtggctcacgcctatagtcagcactttgggaggctgaggtgggaggattgcttgagctcaggagtttgagaccaccctggacaaagtggcaaaactgtatctctacaaaaaatacaaaaattagctgggcatggtgacatgtccctgtagtcccagctactggggaggctgaggtgggaagatggcttgagcctgggaggcagagtttgcagtgagccagtatgagtcactgcactccagcctgggtgacagccagaccctgtatcaagcaaacaaacaagaattgtgtgagctgaactagttgagatgtctatggtgttggctgttgtttctgctgttaatcattagttctcttaaactaggagatgaacaaggttaacctttttcttgcaaattgacacagagggtctgctgctgtgagctttatcttcaacatcatcttgtcctttttttttttttcctactttgaaaaaaaaattcattttttcatagaaatgagttcttactatgttatccaggctggtcttgaactcctgagctcaagtgatcctcctcagcctcccaactgggattacatgtgtgagccactgcacccggcacttcttgaagggttatccacttgaaaactgctgatttttggggggcattgtccccacaaacttttcaaaaagcaacagtgatttcaccattctgcccaagcttcaccataaatttgatgtttgtttttgcttcaattttagcagaattctagccctgcgtggtgacaggcacctgtattctcggctactccggaggctgaagcatgagaatcgcttgaatttggcaggcaaagtttacagtgagccgagatggcaccattgcactccagcctgcacgacacagcgagacaccatctcataaaaaaaaaaaaaaaaaaaaaaaaaaaattagcagaatttatgttgctctgataggggctcttttcaaactgatgtttatccttcttagtgcctcaaactaggttttgctcagacatgttatgacaagttagtacaagtttattttggtgcaaaaaatttttcaaatccatgcatagtttcttctttttcttttcttttcttttcttttttttttttttttgagacaagatctatctctgtcatccaggctgaaatacagtggtgcagtcttggctcactgcaacctctgtcacccttttcccacctcagcctcctgagtagctaggactacaggtacataccactacacctggctaatttttgtattttttggagagatagggttttgacatgtttccaaggctggtctcaagctcctgagttcaagcaatccatctgcttcagcctcccaaaatgctgggattacaggcatgagccaccatgcctggccgtagttttttcataatattcattttccttgaaatttttgatgacccctcgtatctgtattcctgttttatagtatcacacatttattacgtgcctgtctaatacccattgctgtggttttctctgggaattcaaagaggagtaagctagtagctctgccttctagcacatgggctagtggaaagtcataaagagccatttaatgaccactgtcaatgtctgtgtaagggcagtgaagagcacgctgctgttgataaggatggctcacatttatggtacacttgcaataccttttacccatactgattcatctcattctcacaccaactctgtgatgtggtacagttattagaagaggcacagagaggttaaatagtagctggtaattagattaaccaacgttagaaactgggtggtctggtgtgagagcacaggcttttaaaaagcggtaagaagaggggaagctgcagcctagttagggtgactgttgtgttattgaagatgaggggatgaggactttgtgcatgtgtgtggagcctgggctgtgagggtcaagggacaatgggaagggacattaaaaggttatggttaaagtaagcctagacggactagtttgaagtcaaatagtagaaggtgaggatagagagggggatgggaaccagattatgaaaataggcagtatctcttttttatgtcaagtgttaccctgaaattccgaaactatatttcttatgaacatactgattacattcattgttatttaaaaatatgcatgtacaatatgggtggaaatgataatgattgtaatgagagtggctcacaattccaaagaagttgggggtttctgtgggtttattataacttacggttttttttttttctgatatggagtctcactctgttgcccaggttagagtgcagtggtgcgatctctgcttacttcaacccccgcttgccaggttcaagcaatcctccccgctcagcctcccaaggctcccattgcaagcatgcaccaccacgcctggctaatttttatatttttattagagacagggttttgccatgttgccaggctggtcttggattcccgacctcaggctatctgtccaccttggcctcccaaattgctgggattacaggcatgagccactgcacctggccagtttattataatttaaaaagcagtctgttattagtaggcttcggaaatttgtttcagggagtggtaaggaaggagttctagaaagtggttgtatattgctgcatgcttgttttcctctcagatcacaaagaaaatgtaaaggacctgggtgagttccaaaaattaaagtagccgggcgcggtggctcacgcctgtaatcccagcactttgggaggccgaggtgggtggatcacctgaggtcaggggttcgaaaccatcctggccaacatggcgaaacccctgtctctactaaaaatacaaaattagccgggcatggtggtgcatgcctgtaatcccagccacttgggagggtgaggcaggagaatcatttgaacctgggaggtggaggttgcagtgagcgaaatcgcgccattgcactccagcctgggcaacaagagcaaaactccgtctcaaaaaaaaaaaaaaaaaaagtaagttacacacacccttactggcacactgggattccttaaatgcttgcagtattattgagtatggacaatgcacagaactttgtactagatacagttaggttattccatgagagtcttgcttcctccctacatatattcccaagtttatatggggagaccaatataatatgatgcaatttgcaaacagtaacagctgtgtaaatgagtataaagcaatccagaggaggttaaaataaatacatttaaggaagcccacagtgataccttgatttattcttttgtgcaactgttgttgagcagcaggcgccttgggggctgaatagaaaagggcatacctcctgaaggtaggagaagcttggatttgggttttgaaaggatagaagttcaaactgactgagtgggtgtcttttatttttctgtagaaaaagcattggtgtgtgtttgaaaagtttagattgtctcaaaagcataatgagttttatagacttctagggattgtctccagagataggtgggtagtatgagtagtttctttcttttttttttttttttttgagacagattcttgctctgttgcccaggcccaggctggagtgcagtggcgtgatctcggctcactgcaacctctgactgctgggttccagcaattctcatgcctcagcctcccgagtagctgggatggcaggcgtgtgccaccatgcctggctagtttttatatttttagtagagacagggtttcaccatgttggccaggctggtcttgagctgctggcctcaagcgatccacccacctcagcctcccaaagtgctgggattacagacatgagccaccatgcccagccccttgagtagttcctttctagaaacactccaaagtgtgtgtatgtgactgggctggttctaaaattaggatgttgctttgtgccctttttctatagttatcagattttttttttttttttaaagacagagtcttgctctgtcgccaggctggagtgcagtggcacaatcttggctgactgcaacctccgcctcctgggttcaagtgattctcctgcctcagcctccggagtagctgggattacaggcatgtgccaccacgcccagctaatttttgtatttttagtagagatggggtttcaccatgttggccaggatggtctccatctcttgacctcgtgatctgcccacctcagctgcccaaagtgttgggattataggcatgagcctacgcccccggcctagttatcatatatctctactgaagaatgcaagattataatagaaaggaattatttttgaactattatgttgtaaatattaatttattgaagtaggtcaaatgctaggaaaggattctttttactattaaagtaattcaggcatacggtaattctataaaagtagtatgggccgggcgccgtggctcatgcctgtaatcccagcacttcgggaggccgaggcgggcggatcacaaggtcaggagatcgagaccatcctggctaatacggtgaaaccctgtctctactaaaaatacaaacaattagctgggcgtggtggcgggcgcctgtagtcccagctactcgggaggctgaggcaggagaatggcgtgaacccaggaggcggagcttgcggtgagccgagatcgcgccactgcactgcagcctgggcgacagagtgagactccgtctcaaaaaaaaaaaaaaaaagtaatatgaataccttttagtcaccatccagtttaaaagaaaacattgcatcatagttgaagcccttgggtctcaattgctggccccatttgttcttctccctgtcgtttcccccagttcattttgatcattgccatccatctactttatacttttattaaggatgtgtggtgtcatattgtgtgttttcttctataggttgtttctgttgttgaaccttgattttgagattgacttttgttctagttccttcttctgagctgctgaacacgccatagtgtgcccattttactgttgatggacatttaattgttctttcctcccatttttctctattatgaatgatactgcaataaacatctttatggatctccttttgcatgtgtgagagacattgtgtagttataatccaaggcctggaactgcttagtcatagggaaggggctgtgtcttcatgttcataggctactgccatacgcagattcttcagttctctctttgaaatgggaagctctgaggattaagaaattatttttttaaacctgtatgctgattttttttgaagctgtaatggcgctttgcatacttgtggtttagggggtaaatggaatatacacaataagaaatatttactgtgttaatggttcataacttgtgacttatgtaaagttccatctaatttaaataataaataataatactggctgcatagtaatacctaggaccacaatgagagactccgtaaaaaagaaattcctaaactgtattttttttttttgtatatctgtgcccacctgtaatttgacttacagtgaatgtggcttatttgggcaggggagacttttgaacaggtgataacatttttgcgtggccttaaaatttctataatttatttgaaactctttttaaaccatcatgtctcaaagtgatcaagtagaaaggatcaggtgccttaattacgaagaatggcataaatcatgacaaggtctttttgaagtcacctggaatgctccctttgggtgaaagaaggttctgttctcttatcatattcttcctgctcaagttgcccaggtgtagtttgtggtttccaagatacctgttggactggctttaggctgataatattggttccttcatatttttttcacattgtttttagaaattttatgtaactgcattcttcaataaggctctaaaacaattttcctattatggtatagttgcttctccaaacacttaactacctactgggaggaatcaataagagagccacttctggtggatcttggccacaaggtctgtgatgtgtcgttatattgcagagatcttttgaggaaatgcaacgtgaaagatctccttgacattctatgatgaagaaattaaaggtaaactgcatttatgcagatttaatgtaggtagataactgacctgtttaattcatgtgaggcctcagagggtcttttatattctctgctttccagctagtttgacctaagtcaaaccttttctccccagtggaccatgttacttttattttaatcagttgatttttttaaggctttattgagtataattgatataccagaaacctgtacatatttaatatatacagtttgatgagtttggacatatgtacacaccagtgataccaccacactcaaggtcataaacatctgttgcctccaaattttcctgtgtcacttttttttgtggtaagaacacttaacatgagattgaccctctcaacacaaaagtgtacagtaccgtatcattaactataggcattatgttgtacacagatctcgagggcttattcatcttgtgtaactataactttattcccattgaacaacttctcatttccctctctacctataccctggcaactacctttctattttcagcttttataagttggattattttagataaaccacataaaagtggaattatgcagtatttgtccttctgtgactgattttatttcacttagaatattgtcctcaaggttcatccatgttgttgcaaatggtaggatttccttttcattttattttattttttgagacagggtctcactctgttacccatgctggagtgcagtggtgcagtcatggctcactgcagcctcaacctcccgggcccaagtgatcctcccacctcagcctcctgaatagctgggactagaggcatgtgccactattcccagctaattattattatttgtagagacagggtcctcactatgttgctcaggctggtctcgaactcctgggttcaagcagtcctccctcctcgacctcccaaagtgctgggaggtctcactcccagcctaggatgagcctcactccctcactcagcctaggattttctttttaaaggtgaaataatattctaatgtatatatacattgcatttttaatagtcttatttcatgacattaaataagatatacttatttaacgtcaatcatcgtttggatcgtttccatgtgacttagagctttaaaacaggtgatgttaaagttgaaaataaaggcctgtaatcccagcactttgggaggctgagggaggcagatcccttgagctcaggagttggagaccagcctgggcaacatgatgaaaccctgtctccactaaatatacaaaaactagctgggcgtggtggtgtgtgcctgtaatcccagcaactcaggaggctgaggtgggaggatctcttgagcccaagaggtggaggttgcagtgagccgagaccgtaccactgccttccagcctgggtgacagagtgagaccctgtctcacaggcgcacacacacacacgcgcgcgcgcgcgttgaaaacaaatgagaaaccctatggacgtgggggactagacctgtacagttgtcaagcctggttttgagaaagtaactgactccagctgggggtggtggctcatgcctgtaatcccagcactttgggaggccaaggccaggaggattacttgagctcaggagtttgagaccagccaggcaatatggtgagaccccatctctctctctctttttttttttttttttaagttactgactcctagggggcatttaagcggttgaatatcagcatttctttagctatttagcacctcccttgtgactttaaagtacctagtgattttttttttttggatggagtttcgcccttgttgcccaggctagagtgcagtagtgtgatctcggctcactgcaacctctgcctcccgggttcaagcgattcttctgcctcagcctcccgagtagctgggataacaggcatgtgccaccacgcccggctaattttgtatctttagtagagacggggtttctccatgttggtcaggctggtctcgaactcccgacctcaggtgatccgcctatcttggcctcccaaagtgctgagattacaggcgtgagccaccgtgctcggcctgtgattctgatttctatatatggagccatctaattataattatttgttgcaaattatcttttctactgcattaagtttccttatgggctgattaaaatgttctggttgacagctcacctggttatttaaattgtttgctttatcttctggcttagcaattgtacttctaaaaaactatcttaaggaaaaaagtcaaggatatatgaaaatatttcttatgagaaggttcatcaagggccgggcccggtttctcatgcctgtaatcccagcactttgggaggccgaggcaggcagatcacctaaggtcaggagttcaagacaagcctggccaaaatggtgaaaccctgtctctactaaaaatacaaaaattagctgggcatggtggcgggtgcctgtagtctcagctactcaggaggctgaggcaggagaatcgcttgaatcctggaagcagaggttgcagtaagccaagatcatgccactgcactccagcctgggcgacagaacgagactccatctcaaaaaaaaaaaaaaaaaaaaaaaaaaaaagattcatcaaaactttgtaattaatacaaagttttgtaattaattaatacaaagttaattaatacaaattaatacaaagttttgtaattaatacaaagttttgtaatacaaaactttgtaatagtgagaagtttggaaacagtagatattcaattatttaaaattatttgtagagtgcagtggtttaaaagtatagcttctggattcagactaagtgaattctgatagttgtgctgccacttagaactttatgactttgggcaagtttctttctttctttttttttttttttcttgagatggagtctcactctgttgcccaagctggaatgcagtggtacgatctcagctcactgcaacctccgcctctggggttcaagtgattctcgtgcctcagcctcagctgggactacaggcacatggcaccacacctggctaatgtattttagtagagacagggcttcaccatgttgcccagggtggtcttgaactcctgagctcaggtgattccgcccctccccacccgcctcaccctcccaaagtgctgggatcaccggtgtgagccatcacgcctggcccgggcaagtttcttaatgcaattgttaattgtagcttaacagctgtccttggattatttgagtatgaaagaagttattaataccttgtaaaatgcttagaacatgtctggtccatagtaaagctccataaagatttagctattgttactgttaaagtgttagatgcacagatactcacaacatttttcaaatggaaaagaattttaaaacagcatgtatagaagccggtgaggtggcaagcacctgtagtccagctgcatgggagactaaggcagaacgaccgcttgagccgaggaaggagtttggggctgtagtatgggatgattgttcttgtgaatagccactgcattccagcctgggcaacctagtgagaccccgtctcttaaaaaaaaaataaaaccccaaaacaaaaataaaccaaaaaccccaacaaaacagcatgtataatgtatcattaaatataagaataggaaaaaaaaaccggaatgatctactctgggtgataggacaatctcttttggcttctgtgttttttctgtcctacaactcttctgttttataactgaaaaaaatgttttgcatgtgaattttagactggggtctttgggtaaaagcacctagagattactggcaggttaattctaaaaagggcaatttgttttttcactttatctcagagtttcatttgtttcccagtgattgactaattattttaacaaagtaaagcttcattgttgtgtgtatgcaattgaatcgaaaatatacttttcatacaaagacaacttcctaaaggtaagtgtaaacttgtatgtagtttgttaatcttattgtggtattttgtttttcttaaacacagtttcctgttcttttgcttttgcatgtcaacattgctgaaaataaatattttgctctgcagggatagtaagccagatggagtggtatttataatttgaggaaatagcttaaactttgtcatcagtttaaattgcattaaaaaacctgaagcacattgattagagttgtttaaggtagagaaccagaaatattctaaatatcctatgcctaacctgtcaaaactgttcctgaaatatatagagagggaaagagtacctgaggagctcaggaagagtgatggcctagagcgtagcttgaattgagcagcagaggtttctctggagtgtcctgtattatcttaggcaaatttgtagtcttcttaatagtatctgtttacatatcaatatgttttctgtccaggcaaggtggctcatgtctataatcccagaactttaggaggccgagatgggcagatcacttaagcccaggagttggagaccagcctgggcaacatggagaaaccccatctccgcaaaaaaatacaaaaattagctgggcgtggttgcacatgcctgtagttccagctacccgggaggctaaggtgggaagatcacctgagcccaggaggttgaggctgcagtgagctgtgtttgcatcactacactccagcctgggcagcagagaccctgtctccaaccaaaaacaaacaaacaaacaaaaatatatataatgtatatgtatatgtgtggttttcctgtcaatttttaagtagaatgtcctcagatacatatgccatgtttatcctgttacttccaggatacctgggaatacccagaggtttgtgtctatgttagtgtgagaagccctaacacatttttgtgtagagacagcaaaacctgtctctacaaaataaaaaataaaaaaattagcttagcatggtgccgtgtgccagtagtcccagctactgtggagaatcacttgagcctgggaggttgaggctgcagtgagccatgatcacgccactgcactccagccttggtgacagcctgaggactttcttatggattaaggtgggaattatttatggtttgcatgctgagagagattttctgaattttttcaacaaatattgaacacctgccaggttgtgaatttttgtggagtggatcaaaaggactgaaggaaatgaacaaataattttggcaaaccattattaagtaatgaatatgtattgtattcattaattaatgtattaagtgatgaatatgtattgaatatgtgtatcatcacagtaactctatgagggaggttctattatcaccctcatttataggataaagtacatgagagatgaatttatccttaagaaatattttcactttggtgaggcatggcagctcatattttcactttggcgaggcatgacactttgggaggctgaggtgggaggatggtttgaagccatgagtttgagaccagcctgggcaacatagtgagaccctgtctctatctttttaaattataaaattttaaaaataaagaaatttttttttattttgagaagtttgtgtgctttaggtgtgtattctgtttcattaagccaaagtttgtattactagccttctatcctgtcttcccatccttaccaaaaaaagagaaaaagaaaaatagttttactcctgaggttaagaatggggcatgttgtatcaatgtttatttgtgtagatattcttttgaatttttaaaaattggggtatcacttatatacaataaaatgcacaaatcttaattgtacaatctaatgagtctctatgtttaactaccacccagatgtagaaatgcagtacatttctgttacccaggaaggttcctatgtgactgttcacaatcagtaatctccccagcccttggctagaaccactagtctgacttttatcaccctgagttaatgttgccgcatcttgaacttcatataagtaaaatcatgcagtatgcactcttgcagctgacatcttttgcccaagtcagtgccacacattgagattcatccatgttattgcatatatcagtaattcttcattgttgtaaaatattacattgtttgaatatatcattatttatccattctcttgatgaacatttggattgtcaatcagctgctttgatcattcttgtagaacgtgtcctttggtggacataacccttcatttttcttggctatatatatacctaagagtggaattactgcattgtagagtaggtgtatcattggctttagtagatattaccagttttctaactgtgttagactgacgtacatgcccactagcaatggatgagagttctgttttctccacatccttgctaacagtctctttagttgttccatttttaattgtgtcttcaagtaggaagcaccctcacttacaggagaaaggaactcccaaggaagtttctgattagtgcaagttgggtgggatgaagatgaataaccaatacatagcctaaagctttgctcagcatcttattcagatgtagtatttatttcaatgacaaccaaaaataatttctgaatggaccctccctacccatcaactgtaagttaacattgtccaaattctagtctaattatgcttatgttcttcttctcccctcttatattcatgctgaaatattaaaaaatcactgcaaattcctatggaaaacctcatacttcaaaagggatcagtgtttggtttctctctccattttttttttttttctgttgaaatagagtgaaagacccaggaataatatgcctgtgtgtacattttgcagatctggtaataataacaactgtagcggttactgagggcctcctctgggtcaggctctgtgagaagtgatttgtattccttagttcatttactttctatcatgacccaataaagtatatgtatctttgctatccccattttatagatgaagaagctaaagctttgagaggttaagtaatttgcccaagtttatctagctagtaagtgcagaagctagaattttaatctaggtctgtctaactacaaaggatggaattaggcccctttcttatgattattaataaaaatgatctctatgtagttaggatttactaacccaatttcttttatcttttaaactgagaatccctccacctcctggcaccccagttctggtaaaagataaatgaaacccatagttgtttttctcagcaagggttttatttatttatttatttattttattttttttaagacagagcctcactctgtcaccaagactggagtgccgtggcacgatcatggctcactgcaggctcagcctcccaggctcaagtgatcttcctgagcagctgggattgcaggcacacaccaccatgctcggctaatttttttttctttttttttttttggtgagacggggtcttgcactgttgcccaggctggagtgcaatggcatgatcttggctcactgcaacctccgcctcccgatttcaagtgattctcctgtctcagtctccagagtagctgggattacaggcatccaccaccacgcccggctaattttttgtattttttagtagagacggggtttcaccatgttggccaggctggtctcgaattcctgacctcatgatttgcccacctcggcctcccaaagtgctgggattacaggcatgaaccaccgcgcccggccccggccttgtatttttttttatagagacagggttttgccctgttgcccaggatggtctccaactcctgggctcaagcagtcctcccatctcagcctcccaaagtgctggggttacaggcatgagccactgtccccagcctcccaaggttgtttttaggccctttgaggcttataaaatagaataaatgagaaataggtccaaccttcaagagcactgtgtatagcacccaagattagaaatgcatatgttcagccatgacatctatggaaagtacagaggacaggtcctgaggaagtgctggggctgttggtggtaccagcctttgtgtagcagaagatgtttgagctgtgctttgcaaagtggctggatcatagacatgtgaacactaggagttgggccagtgggtggagatagaatttgtgcctcaaattgcagatacttctgtttggtgggtacatgtgtgacaggcataaacttagtgagtaggtggccccagatttggaccaggtcagggagactcttgaatgtcaggccttgtggccttttgaggcatttcccgctggacgattagttgggcagtggtgtggcagcatgtggaggtggagaggctgatggagaacttgcagtaggatgtccatcatgtgggactgaaggctagctgggaggtatatctgggctggagaaaatggacatgggactcacaaaactggttgtaggagctatgggaatagacagaggctcccggctagagctctagggcatagtgggttaaccagcggtgggtgtggtgtcagaatcactcataaagctttttttttttttgagatggagcacgttcctggctcactgcaacctccacctcctggattcaagcgattatcctgcctcagcctcccaagtagctgggactacaggcatgcgccacaacacccagctaatttttgtatttttagtagagacggggtttcatcatgttagccaggatggtctcgatctcttgaccttgtgatccgcctgcctcgacctcccaaagtgctgggattacaaggatgagccaccaagcccggccaagcttcttgtttttacattgattttttttttttttttttttagagataggggctcgatctgttacccaggctggagtgcagtagtacagtgttggcttactgtaacctccaacttctggactcaggtgatcctcacccctcagcctaccgagtagctaggactataggtgtgtgccaccatgcccggctaatgatttaaaaaatgttttgtagagacagggtctcattatgttgcccagctggtctcaaactcatggcctcaagcgatcctcctgccttggcctctcagggtgctgggattaaagtaaaggaatgagtccagctactcatacagctcttgaaaaccctctggcttggtctgaccctggagcttctaattggtgttcttggggtctcagcagccatctgggtttttttttttctttttttgggatggagtctcgctctgtcgcccaggctggagtgcagtggcgcgatctcggctcactgcaagctccgcctcccgggttcactccattctcctgcctcagcctctggagtagctgggactacaggcacccgccaccacacccggctaatttttcgtatttttagtagagacagggtttcaccgtgttagccaggatggtctcaatctcctgaccttgtgatccgtctgccttggcctccgaaagtgttgggattacaggcatgagccactgcgcctggccagccatctggatttttaaaagcaccttggcttctagtgcatattctctgcccactctgcaggtaagaagcagtgaggaaaatggtcctagggtacccggttaggacatagtcatatctctgagttctcagggaactcaggaaaaatcatgccgtctcgatagccaagttatcagtgtcaaatgtctcgaaaagatcttgtttccaaagtcgtcatgcttaacacttccaaaacaaagagtgtgccaacttctttgggcaagccatttgtgggcaattttgaggatcagaaaagctctttggtgaaataaactaaacggtctccctgaatagctttcacagtgtgggccttgcagggagcacaaggccagcccaccctatacatgatattctttacgattataaagacactttttactgtttctcccagttttcctttttcccacactaacatccccagtatgctcttgtgtagttttcagagcctttgttatgattccctctgaactgttgctctttgccagtattgcttttcaaataaggcaaccccaaatttacgcaccagcattgtttagtgggaccatttatttgtctcttgtcatgtagatgatacacgcatgtatttgcaggggcagggacaggggatccccagtataaactttaaatgtgcctttaattctatcttggattcaccctgtttgagcctgtgatctggcttaccctcccagatgtcattggccaatttgataaacaaattcgattatctccatgccaaagaggaagcagtgcctcaaggcaagcctgaagcagcgctgccatgacaggaccttgacaggtccttgataggacctttgtgctgtgctcagtgatgacctcagtgatagttgtcctcagccaggaggtgtttctttttttttccttttttttttttttttttttttttgagacagagtcttgcactgttacctgggctggagtgcaatggtgcaagtctgggttcactgcaacctctgcctcccaggttcacgggattcttctgcctcagccttctaagtagctgggattacaggtgcgcgccaccacacccagctaattttttgtatttttagtagagacggggtttcactatgttggccagactggtctcgaactcctgaccttgtgatctgcccgccttggacttccaaagtgctgggattacaggcgtgagccaccgcgcctggccgagttgtttatttctaaaggatttttaggagtcttaaaaaaagtcttttcctgtaccttaaacaatggtttcactaaagggaattgctgtcttagatgtttcgtgttgaatcttacacatttttgcctaagctgtatcatcctcattggaaaacccttgcaccgagtatttacttttagtcacactttgctataaactttatgacttgtgcatgcgcgattgtatggctggctctttgccttttgcctctactgtgaccaacactgatttcttacaggcttgtaaagtggtttccaagatctgtttgctgtgtgtgcttggctgcatttgatataaatagatttgagattagtgtttgaaagtgccatatgaccatatacagagctgacttactaaggatatgttactgcatttcagacacatctagtaatagaaaaatcagtgtcttaatgggctgtgcctctctcgtgtcccctcttttaaaaaaaaatttagttacaactaaatgtcaggaaattttgtagcttacctagtttaagtcccaagatatgtggagagacaataaaaatgataatgacaatggtgcctggagatgcgtatgttaacatatgttaagaagttatttttaaggttgcccacttaatgtttttgtttttatttttgagatgaagtctcactctgttgcccagactggagtgcagtggcttgatactggctcactgcaacctccaacctcccgggttcaagtgattctcttgcctcagcctcccatgtagctgggattacaggcgcctgccaccacacccgggtgatttttgaatttttagtagaggcagtgtttcaccatgttggccaggctggtcttgaactcctgacctcaagtgattcaccctcctcggcctcccagagtgctgggattacaggcataagccaccatgcctggctggttgttgttgtttttgtttgttgagacatggtctcactgttacccaggatggagtgcaggggtgcagtcacagctcactgcaacctcgacttcccaggctcaggtgatccttcaccctcaatctcctgagtagctgggaccacatgtgcacgccaccacacctggctaattcttgcatttttctgtagacatggggtttcaccatgttgcccaggctgttctcagactgggctcaagcaatcctcctgccttggcctcccaaagtgctgggataacagacatgagccacctcgcccagctccatttaatgtttaattgtaggcttggtgactcttatgtattaattactagatattcttatttggaattattagacgtgctaaggcaataattttgaaatttacaacagactagttggtgttaaggtgttataatagattaccatattttgcaatatattggttatttccttgttgaatagagatgaggaaggatggtattttggctctaaattagagggctgaggttctaatggcaaaattaacattgtagttttacattgcttgaataatgtaatcttcttaatagatattatacttaattttgctttaaagacaatgttcattgataaactttctgtatctttcagtgtgttctgtagcacagtgctttcttcatggccatcgcaggtgtttgggctttttttttaaacacgtctgaggactgcaaaggtgtttttttctccccctccccctccccccctcctctttcttacttagactgttgttgtccaggctgacctcaaactccagagagcctcatgcctcagcctcctgagtagcttggaccaggcttggctcgaggactgtgattttatagacattgtttccatcctgtagaggaaacagatgggttaatttaattgttcagctggtgcttgagcacactctgggagtgtccaatccagagatgaatgaggattcttgctcttaattcagtgttgttttttgcttcatcttgcttctaagagagttccttgaatatatgatggaattatgtagtggttactgcagtaatcacactcttattattttctaattatgtggaacttgggaaatgttgattttgtttcagtatatgatttgcagtataattctatttacatgtaaaatcttgtctgtgttagtttgccttgacaaagcaccacaaacaaggcagcttaaacaacagaaatgtgttgtctcacagctctgggggctataagttctggattaagatgttggcagggtggcttccttctgagggttaggagggaaggatctgtcccaggcctctctcattggtttatacatgattgtcttcacccagtatctttacgtcatcttctctctgtacatgtctgtgtccgaatttccccttctcttttgagatagggtctcactgtgtcacccaggttggagtacagtggtgtgatcatgaatcgttgcagccttgatcttccaggctcaactgatcttcctgcctcagcctcctgaggtagctgggactataggcatgtgccaccaggccttgctaatttttttatgttttaaaatttttgtggagatggggatctcactgtattgccctggctggtctcaaattcctgacctcaagtaatcctcccacttcagcctcccaaaatgctgggattacaggcatgactgacccatcacacctggcctaatatccccttttcttagggacatcagttatattgcattaggaaccatgctgatagccttaacattttaacttgatgacctctataaagaccctgtctccagagaagatcacattctgagttattgggagttaggacttcaacatatgatttttgggaggacacaaatcaatattcagcagtatctttttttttttttgagactgagtcttgccttgttacccaggctggagtgcattggcgcaaacatggctcattggagcagccttcacctcctgggcccaagtgatcctcctgcctcagcttccctagtagctggcactcccatgtcaattaaaattttctgtagagatggaatcttaccgtgttgcttaggctggtcttgaattcttgggccttagcaattctcctgccttggcctcccaaagtgctgggattacagcgtgggccactgcgctcagcccttaacggtgtctttaacagctctccagtagtgtatctagagagcactgcctgcgggatggtggccatgggacccagcttggaggctggccctcaagaatcaccgggttggtggtgggctgttagtggatccccttctccatggggcacaggcaagtctggtttggaaaaggatgatgttgcttcagtgtcagtttgccagtttttcctctgttctccccactctgattctgactagaattaatttggtagcactgagaagagtcatttctactttggcacagtaatcttgcccataatctgactaatttttatttttatttttttgagacagagtcttgctctgtcacccaggctggaatgcagtggtgcaatctcggctcactgcaacctctgtctcctaggttcaagagattcttctgcctcagcctcctgagtagctgggattacaggcatgcaccaccacgcccagctaattttttttttcttttgctatttttagtacagatggggttttgccatgttgtccaggctggtctcgaactcctgacctcaagtgatccgcccgccttggcctcccaaagtgctaggtttaaaggcatgaaccactgccccggccccataatctgccaaattttagttaaaactctgtattccacttagaactaattcaccgtggctgggcacggtggcttctgcctgcaatctcagcattttgggaggctgaggtgggtggatcgcttgaacccaggggtttgagaccagcttgggcaatatagtgagaccgtgtttctttgcgggggggggggggtggggggaagccagcctggccaacatggtgaaacctcatctctactaaaaatacaaaaattagccacgtgtggtggcacacacctgtaatcccagctactcaggaggccttggcatgaggatcccttgaacctgggaggcggaagttgcagtgagccgagatcatgccactgcactccagcctgggttgacggaacgagactctgtcaaaataaaataaataaaataaaatacaatgtaaaataaaataaaatagaatgaattcactgataaagttgacttctctcatctccaagtaaatgatttcattttctcctttgttccttgcatgtatgctgtgatttactgactatcaagaactcattacaccagtacgtatcccaagacaaatcagctccaaagtggagtgagtgcaaggggagagctttaattcaaaactgctttatggaggaagtacaggttttcctctaagctgcactgttatagatctgtagaagttttaaatccatgtaatgctcatcagtttttagtttagtatttagctgtctgtgatgataagtaaataatttacctttttgaaggcctgtgatatactgtgtcttcattgcttcatttaagaggatgcaacatcaggattttcaaaaatacacataacgaagtgttgtgtaatcgtctgtacatggtttctttgataagagagaggcaggaatctgcgtaaagcaggtgtacagacatagtttgcccatgagacagcaagaagagccctgatgtcctaaaggagagccctctcctgaaatgcataacatacatatatatttttttttcctttttttcaaaaaatagagacagggtctcagtatgttgcccaggctgtctcaaactcctggccttaagtgatcctcctgcctcggcctcccaaattattgggattacaggtgtgaaccaccatgcctggtcttgaaatgcatatcttagtcactgttacttcttttaaattgttttaattgtataagataaaaaccaaaacaaacaaaaaaaatgctaccatttcaggagcatacatctagtcttaaaaatatcataaatttgggccgggtgcagtagctcacgcctgtaattccagcactttgggaggccgaggcgggcggatcacgtgaggtcaggagttcgagaccagcctggctaacatggtgaaaccctgtctctactaaaaatatgaaaattagccgggcgtgattgtgggtgcctgtaatcctggctacttgggaggctaaggcaggaaaattgcttaaacccaggagatggaggttgcagtgagctgacacagtgccactgtactccagcttgggcaacagagtgagactttgtctcagaaaaaaaaaaaaaaaaaattataaatcctttttattcccctaacttggatctcaggttaattgggatatgcctaataacaaaatttctgaacatgaggtttactagaaagaattattttttagattatttgtgatatatgtatatatgcatttgatagtagtggatgtgtttattggactcttaagtacttgctatgtactgtgggacatgtaggagtatatgaatatttgtcagctagattataaagcttaaaaacatattattgggcaggagtgggctatggggctgtgactactagtgggcctggggtttctttgtgggttgatgaaaatagagatggttgtgcaactttgtgaatatagtaaaaccatttaattgtatacttatgggtgaattttatgttatgtgagttatatctcagtgatgcttaaaaaatgctgttaatgaatttgcagtgctgaaaagattccaaagttgtgattctctacctttttctgttctccagatctcccaaagcagttgcagtgaaagataaagaacatcaaacactcttatcttctggtggtggggaaatgctgagtggccctgactttgtgcagtgaaagttgtttacacaagcctgagtctataaactcagagataaaaaaaatcacaccaggctgaagccccatcaggcaaaaacctaccagagaaatgggcctgcccgtctgatggaatatctgggatttcctgatgttggtcccttaatttgtggaccattttaggctgtcattaaagtagcagtctaaagtaagagaaaaattctgacatggaataatgtggatgaatcttgaggacattacatgaaataagccagtcactaaaaggacaaatactgtatgattacaattgcatgaagtgcctagagtagccacattcatagagacaaagtagaatggtagtcacagggaaatagggagtcagtgtttaatagtatagtttcttttttttttttttttcagacagagtcttactctgtcgcccaggctggagtgcaatggtgctatcttggctcactacagcctccatcaaccaggttcaagcgattttctcctgcctcaacctcccttgtagctgggactacaggcccacgccaccacgtctggctaatttttgtatttttagtagagttggggtttcgccacgtgggccaggatggtctcgaactcctgacctcaagtgatctgcccacccgcaaagtgctgggattacaggggtgagccaccacgctgggcgatacagagtttcagctggggaaggtgaaaaagttctggagatggatggtagtgatggttccacaatattgtgaatgaactcagtgtcaaataactatatactgaaaaatgattcaaatggtaaattttatgttgtgtttaatcacaataaagtaaatttttaaaaagtaagagtagtaaaatcactttgatgaaaagaaagggtgggaccagggtatttggattgtctaccaggccaggcacccttttcagtggtcttgcctctgtgcctgccttctgagtgtgaggaggatgatgaggatgcccagggcaggtctctgcctgctcccttcgttctggtccttccaccagtcacccatggagcatctcttgtgtttcagaaatgccagtgccttggcacaggagcaggataaaactgtgcccccaaggcacttttaatccagaggaaggttggcaaagatacatttgcttgaaaaatattgtcagggccaggtgtgttggttcacacctataatcctagcacttcccagtactttgggaggctgaggcaggaggatcacttgagctcaaggagttcaagaccagcctgggcgagacctcatctctacaaaacttcaaaaaaaattagccagacatggtggtgcaggctgaggtgggaggatcattttagcccaggaagttgaggctgcagtgagcgttgattgtgccactgcactccagcctgggtgacagagcgagaccctgtctctaaaaaataaataaattgtcaggttgcgttatgctcccctgtggtagaagtgtgggtggtgttatttaggtagtacttggagagtgcccgtcagatgtctggaaacctaatttaaagtagtaaaatcaacacgtgggtgagacttgatacccacagacatatttttttttaaagctagagtgtctctaaaagaatgagacttgtttatagcctaaaaattctccatggaatgaagatcctcctggtgccaaaggaactgtgtgcttttggtgaggagcccatcagcatgaggttttccactgactacggtttcccaaggcaacttaagagacatagtcaaggccttaaggaattgatgggccagccatggaggagactcaaatacaaacacaatgtttttgcgctttgtaagcatggttatggagcactgtctaaactagtgaaagtaaatttaataagaaggaattacggcaggcacagtggctcatgcctgtaaccccagcactttggaaggctgaggcgggcggatcgcttgaggctgagagttcaagaccagcctggacaacatagtgaaaccctgtctctactaaaaatacaaaattatccaagtatggtggcatacacctgtagccctagccacttgggaggctgaggcatgagaattgcttgaacccaggaagtggaggttgcagtgaactgaaagtgaaactctatctcaaaaagaagaatgaattatgctgggcatgatggctcacgcctgtaatcccaacactttgggaggctgaggcaggaggatcacttgagctcaaggaatttaagaccagcttgggcaacatagcgagacccctgtctctacagaaaataaaaaattagccaggtgtggtgatgtacacctgtagtcccagctactcaggaagcagaggcaggaggatatcttgagcccaagagtttattaaggctgcagtgaaccatgattgtgccactgcactccagcctgagcaacagaaaaaagaacaaattgtggaagagacatgttaaagtccagtgggtcagtgaccaagagcccagagactctagtttcaaacatacacattccatggtcctgcctgtgtttttagacagatcattctcagaggcagccttcatctgttaaataaattctttacttggtgggaggaggtgagagagaggtggagtcagaggtgaagtgtggggataaggatgtgatatttttagcacagtttgagatataaagtaatttcctgataagattattcttctcctaaatggaacctgtactgtcctcattctcttactaatgacaaggtcagagcaaaccgacaaacatggaagaacagggttcctagccctggtggtgaattccgaggcggtctgagcatactccaaaaagttggctttaggatacagaggggtccatttttgtggactgctttattttggttcaagggttgtctgtgaattttacaataaatcagagtctttgttttcctattgctgagggaggggagggagaggtttgcaacagtctattaatagaatatagcataatttgaaaggaaatgtagaaaaatcaaatgctaataataataatattgctgggcatggtggctcatgcctgtaatcccagcactttgggaggctgaggtgggcagatctcttgagatcaggagtttgagaccatcctggccaacatggtgaaaccccatctctactaataatacaaaaattagctggatgtggtggtgcatgcctgtaatcccagctagtcgggaggctgaggcaggagaatcactcgaacctgggaagcggaggttgcagtgagctgagatggcgccactacactccagcctgggtgacaaagcgagacttcatctaatacgtgtgtgtgtgtgtgtgtgtgtgtgtgtgtgtatgtatgtgtatatgtgtgcgtgtatatatatgtgtgtgtgtgtatgtgtatatatatgtgtgtgtatgtatatatatatgtgtgtgtgtatgtatatatatatacacatacacgcacacatatggcacgcactatgttgcccaggctgatctcaaactcatgggctcaagtgatccgcccgcctctgcctcaaaaagtgctaggattacaagtgtgagctactgtgcccatcctgaaatgctaataattattaacctaatgttgctggaaacaaattctttgttttttcaagaagagaaaaagtagataataatggtactgaaagtggtatttctttttactttctcacaattccatcatcattaaccatttacattcaggagccactatactaggcactctaaaggcacctttaaagagctgtctcattgtatgtaagggtgtgtacactgagaagtctgtattgcccagtatttatgagaaagctgctgcttgcacctggcttggtgctatgagggacaaatacaactttgtgtttcataaggaagattaatactttgacataattctaatttcttggcctttaaggagaaggtcacaaaatctttctttaaaaaaaggtagtgactatcatttgctttttctctgtaaaagcagggacatttctttttaacgtattttttcccagtggctaaaataatgtatactcaatgcagaagacttggaaattggaaaaaatggaggagcttttgaaaaaaaatttctttcaggatgactgttggttttgctttgagtcagaagcaagctttgttctgctgacttgtctcgtgcttagtagtcctttcctgcctcctcttgtgatcccttgaatttggaggatttggcggggagtcacatggccctctctccccatcaacttcccatcttcccactggagcacacgagctttcctccgaatctgtgagacttgagctcagtggttcatgttaatataatagaacacccctttcttgtgaacgtgtgctctcagggtttgtttccaagttgaggcttgacatgtcagaaggtgttttgtggaaggaaagagccctagtgctggaggcattgggttcagatcctggcctcactcaaatggtagccgtagccgtgagtaagttaaactcggcttgctcgtatgtaagtggtaataacaatgcttagatacaatgatctgatttacctggtacatagcaggttcttgggctgggcatggtggctgatgcctgtaatcccagcactttgggaggccaaggcgggaggatcacttgagcccaaaagtttgagaccaggctgtctctacaaaaaattaaaaaactagctgggcacagtgtggcgcctgtagtcctagctattcaggaggctgagatgggaggatcacttgagcccaggaatttgaggcagctgtaagctgtgattgccactgcactccagcttgggcgacaaagtgagaccctgtctctaaaaaaaaggggcgcagggggttctttccatgaatgtgatgctcacacaaccctgtttgttcctttcattcaaaaatgtatattgaagtcctagctagctgcttgggaggctgagatgggaggatcatttgaacccaggtgtttaagtgcagcctgggtaacataacaagaccccatctctctttttctttttctttttttttttttttttttttttgagacagggtctcatgtgttgctcaggctggagtgcagtggcttgatcttggcctactgcagcctccacctcctgggttcaaacaattttcctgcctcagcctcctgagttgctgggattacaggtgccaccaccacgcctggctaatttttatatttttagtagagatagggcttcaccctgttggccaggcggttctcgaactcttgacttaaggtgatctgcccacctcggcctcccaaagtactggaattacaggcatgagccactatgcccagcccccatctcttaaaaaaaaaaaaaaagtgtattaagcaccagctgtgtgccaagccttgctctagatgctggagacaaaaatggagagagagagaaaaaaaaatccctgcctttgtggagctcagattcttgttggggaagtaggtaataagataaatgctgggtgtggtggctaacacctgtaatcctggcactttgggaggcagaggcaggtggatttcttgagtctaggaatttgagaccagcctggtcaacatggtgaaaccccgtatctacaaaaaaaaaaaaaaaattagccaggcctggtggcgcttgcctgtagtcccagctactcaggaggctaaggtgggaggatcatttgagcctaagaggttgaggctgctgtgagctgtgattgtaccactgcactccagcctgggtgacagattgagaccctgtctcaaacaaagaaacaaaaacaagataaatgcctagatatctgttagattagtggtcagttgcaagaagtaaataaaagaggttgaggctgctgtgagctgtgattgtaccactgcactccagcctgggtgacagattgagaccctgtctcaaacaaagaaacaaaaacaagataaatgcctagatatatgttagattagtggtcagttgcaagaagtaaataaagcttccatggtctctgcgtgtgtatatgtgtgttgagaaggaatattgggaataatgagtgattgtagctgcatcttgtttccgtgtgaaatgtgtctttaagctcctgctggggtccagaccccatcccgtgttgaaatgggactccctggttgtttctggggcatggtgtctgtggaagaaggtggattctggatcttgcctggctgggaatgagggctccagcagcaaggcttagggtttgaaggggaaatagtgtgtgtgttttaaggggctcagggggagatgtctttggatatacatgaagagtgcttagaatagtgctaagcactcaataaattttagctattaacatatataatgtactgtgccttttgttataaaacgcagacctttaaatagaaactagaagggccacgttcttggaaaaaatgttcagtgttagaagcagtaattatgtattaataattatgtaagtgccaaatttggagcatgcacataatgttgatctctctctacccctcaccctttcattcccttaggccattttggaggaatacattttaaggcgggaacctcggatgtgttacgtaacaaaggccttcttgtgttactgtctagtggatcagtaggcaaaaggaagaaacacattctcaaagcatggtcagattccttaaaatgtacttagataagggggaaaagggtaagaaatctagtaaaggtgtggtgcatgctaattgatggggaagacaaaaaaagaatataatgatttccgaaactctgaccatatctaggttagtgacaaaatttgagtttgggaaaaatatacatatcagggatgcaagcttattctatgcagtttacacctgcaattgttattgttatttttttttttttgagatgaagtcttgctctgtcacccaggctggagtgcagtggtgtaatctccgcttcccaggttccagtgatcctcccacctcaacctcccgagtagctgggactacaggcacatgccaccatgcccggctaatttttgtatttttactagagatggggtttcaccatgttagccaggctggccttgaactcctgacctcaggtgatctgcccacctcggcctctcaaagtgctgggattacaggtgtgagccaccacccccggccatcctgcaatttctttaccacgttttagccttgccttttttttttttttttttttttgcctcaacagagaattctttattatgtccaaaagagcacaacaaaaacatcccaacaatacataaacctatatataaaatatagaatatctccaaatttttactttctatggcagcacgccaatatatacaagagaacatattgatggggcaaagggaaaactgatttgggcaatgacttaattagtcaggcattaacattcagagacctggtaaacagcaactttagtcagaaaagcaatatgagaagagttcctgtgaagctgggatttacatacttcattctccgttcctggtcatttcatccacaacttgactgttgtcaatcatggttctttgcctttggagtggtactatgaaggtacagagaatagagaatgcccatctcagtaccaaaatttcaccatgaaaaatcataatagaaataacaaagcttaaaaaaatgctgcatttcagaagtatttaccctaataatttttaagaaagcttaccataaatacttctaggttagtgacaaaatttgagtttgggaaaaatatacatatcagggatgcaagcttattctgtgcagtttacacctgcataggccacccatctcggcctccctaagtgctgggattacaggcgtgagccaccacgcctggccctggtatatgttttaagtcaaccagttctccttaagtacttgtttcaacatcatgttattgtgtactacagaagcaatctctcagttatgaaaaataaaatcagtttcagggctcacaaagtaaaaagggaaattctttcccaatctccccttcccccaccacctggctttttttgtttaaaaaattaaattcaaatgtataagaccaagcaccggcactttccaaaaaacaaaaatgaagccaaatcacaaaattactcaatagttatagaagacagctctgattttggggggtcatctctggttgcctcagtacaagcattgatctttggctgctagccttgctttttagtttaaggaatatggatcctattattggtattaaaaattatacttctaaaactattgaaggctattactaattatttcagttctctatatagtattcgtacctcagtttaatagtgcttactaagtcatttaaataataggtctctgttgaaaaatattagaattgtacccttccacctctaaaaagtcagagttcaggatgaaaaggtatgaagtcctctgttggtcatagtattttgtgggctaaatcattgtctaaaatcagaaagacagcgcagtggaaggttctaggagttgcatggatctgggttagaatctcagtgcctctcgcaaccaattgtttaaaatgtgggcagattagtccctccatttccattttctcttttgtgaaataattattattttgcaaggctcatgtgacaaagtggattagtatgtgtgtctagcataatgtagatgctaaaattaaatgattgacttggcaccagtcagagtttattcacttttaatattgattttgaaagtctccagtcagattgcttaattgatacacattaatttttactgttagatttttaacttattattaaacaccaagtttgataataaatactattagtgaggtaggaggtggaacttgactccagaccagattgaagactggctgaaacagggaagaggtgaaagcacctctccataagacacgcccaccagtgccatgtcagtttaccattgccatggtaacacctggaaattaccacccctttccatggcaacaacctggaagttaccaccctttttctagaggtttctgattaacctgccctcttaatttgcatgtaattaaaaatgggcataaatatgactgcagaactgcccttgagctgctgttatggagcagtcacagagcttaacactgccacgtcagtaaagcagtttccttctaccgcagggtcgctcttcagctctttcctaagtgcagttgagaatcttcctgggctgagccccagtttgggagcttgcctgcccttcatcaatagcagtagtaatagtaatgatgatggtagccagccagatatagtgaagtgttctatgtgttctcagttactctgaacaagggccctcaaagggcaggtatttttatgttctttttgctgacaagaaactgaggcttagtgagactgagatttagaaagtaatgaaaggaaaaagttatgttaaatgatcacttttttatggagccatgcttttttgtgcttaatttattgcctattgctcatatgtgttttacattgttcagtgttttctcaagataagcaatgagaagtaacagctgtagtcaactttcttccccaagtactaagtaaataaggtggttaggtgtagaatggaattagctatggaatgctgattgtttattttctatgtaggatgaaagaaattaggcatgaagaaggaagataattttctacttgctatagatttgaaatagttttctttcttttgctttttttttgtttgacctactgaggagttcagagtggttaactgaaacagactctaaaaataccctttggtagcgtgctcactgaagtattttctgtttgtctaaaattagcagatttgagcagatttgagcagtgtactctggttttccaaagccttccattaggtgacttcttattctggtgtactttgttatctttctggataacacgtttgatgggtgttaaaaggtaaagccaggaatggctttactttctaacagaatactttacaaagcagtttccagcttagatacttcctcctacagggaaccttcccaaggtgtttccttggcagtgctcccttccttatcccgccactgtcccacatgtcccacctaggccttgaagggcagaacctgtgctctgttcactgttgtattccagtgcctgacacaactatttgcacagtatttaggtgctgaacaaatatttattgaatgccaaaattggttcatttactaagcagaaagaaaggaaaatattttttgttggcagtgtctgcaaagagatttgtcttttcccatgaaaattgagaagtggggacagaaaagcaagaaagtgggagcaaaagtaattgagatccacagtggctcaggagtgttgaccggtgcagggtgtggtagaagcccgttaatgggtaggggagccagatacggaggctcagctgggctgggggcaggtctgcaagaaatgggggggtgtggagaaggttaccagccgttaccagagttttcctctgcattgggaatttctaaggtgtgtttttgtttttaaaacaatatctgtactttcaaaaatatggtttctttgctgcaaggggaacacatttattttgtgaaagtaagtgtacctagttaacagtttccatttattaatttctggaatagtgttttggttacttggaatgtgtgtgtgtattttctttctttctttctttttgagacagagtctcgctctgtcacccaggctggagtgcagtggcgccatctcggcttactgtagcctctgcctcccaggttcaagcgattctcccgcctcagcctcccaaagtactgggattacaggtgtgagccactgcgcccggcctattttctttctattacaagtcccttgcgggaaagatggtcgtagctcctattctaaatgaacagaagttctgtcttagaaattttcccattttacaagtgttcaaagaggaccaaatttcatcctctttccctgcctgtgtcctggaatcagctgagaagaaagacaggagtaaggtggtcttcaattcagccagtcttcaattgttggagaccaaaatttacctttatgctgatcagggttagagctgctatgcagaacatggcttatctctgcgggcaagtggccttcctgaggctcatctccagagctgtgcagcagaatgttgccctcaaaagaggacagagggcaggactggctatgcatgcatgctcactcccttcttccagattcactgagcctgttttccttctgaattaagaggtaagaaagtaacacctggaaagatgtactttcccaaggtcacgcagatagctggcaacaggtttttctcctgggctctagaggcctttggtctgagtagaaagggcatggttatggggttggccaggccttgtgttcaccacattctgcttctgtgctcttagctttcatttctgcatctataccatggggttaaaatttctaccctcgggattcctgggagggttacctaaggtgtaactgttgaatgacctgaaccagtgctttgcactcagaatcagcaatgtaaatatcactcagccagcctggggcactttcctctatcaaaccttaccaatccttttcttcttcttcttctttttttttttttctcttcaattgaaacagggtctcactgtcttgcccaggctgaggtggaatgtggcacaatctccgttcactgtagcttccacttcacaggctcaatcaattctccagccttagcctccaagtagctataggcacgtgccatcacacctggctagtttttgtattttttgtagagatgggttttcaccatgttgcctaggctggtctcaaactcctgagctcaaagcgatctgcctgacttaggcttcgaaaatgctgggattacaggtgtgagccaccatgtccagcctcgttgttctttcttttaatcaccctggcttggcacctcagaaaacatggtgattggagtttagctttcagcagggtgggacttggatgttgactgttttaattttgatttttttttttttttttttgaaacggagtctcactctgtcgcccaggctggagtgcagtggcgcgatctcggctcactgcaagctctgccttccgggttcacgccattctcctgcctcagcgttgtgagtagctgggactacaggcgcctgccaccgcacccagctaattttttgtatttttagtagagatggggtttcaccgtggtctcgatctcctgacctcgtgatctgcccgcctcggcctcccaaagtgctgggattacaggtgtgagctaccgcacccagcccaattttgattttttaggaggaaaaaaaattgttcctaaggaagtcaagtcctaaattgaaagactttcatatattacacaaaccctagaaaaacttgggttacacctgggattgattttgaagtagggcgttgaactatgtgtcctgtttaacctcgaggagcaaatggctttccattctaaacattctcatttcttctctgggacattctttaggtgcttgtttgagtttctgttttgttaggcacattagaggactctatatgaacaagttcctaggggaggaaattggtgacttagatgaaagggtgaaaaaggtgaaaccttcacattattgtgtaagggattgtcccagaatgtgtgaaatttgatgtagtccttcttggcttcgttttttcctcagatgttctggatgaaacagttccccctgtcacacgtggagataaggatgtggctctaggcagggcatatcctgtgtttaagactgtgttgactcttcttttacagtgtctgccacttgtttcctgcctaggtctttagttttgagtgaagtacagctgtgaagtcctagacttgtaatgctaaggcgttcattatgttaaattcagtttctctttttcttttctctgcttcacatcagccttgtactttagcacgtttccagtccagccttggtagctgggctgctgttctccttgacccgtccctttgcaagcagcagaccacggccagggttgggagtccggctgggccactgaccgcagtgctgaggaaaggtggagcgggaggccctttcctcccagcctcgggcttcctgtgcaagccactgaggaggaaaaggagctggagggtgtgtgaaccctcaggttatacaagcagcacttctatgcaacaaagaaaatgtaaattgctgtaaattaccaaaaaaaaaaaaaaaaaaaaaattgctggcaatctgctttccagggcagatggagggtagcttttatttatacattggtcagctgattgagtaatgtttaaaaaccacctttacttctggcacttcttggcagtatcagttttttttttttaatggatagagaagcttttttattttacagataataactgcatatctttacctgagggagctcaggttcgctctatctagcagcttccacgtgtcatctctgtatgtgcagttggtgcctgcattaaggaggacggacagccttgtggcgttggtgcctctgttttgtgtctaaagctatttatttgggggtggctgccccaggagcagcacatcaaagtggtgttcagttatgctggccaagtgctgaattgcattgtgtttatttttatttccaaggttattttattttttacacatgaaagcctttttccctcctagattttactgtttttttttttttcctgattaacaaagatgtacagactgaggagaagtttttgaaaattttgtaaaaatgttgaaatttttatgcagaaagagaaacaaagtgggggcccatcccaaatctcaccaatcaggcagaaactatttgtcatactggatacggtttctctctctctctttttttttttttttttgtgggggggatcttttcattaaaaaactcttctgtaggtatcttaacagcacttgcatggtccttaggagatgaaggtgtttcgccatttctggagtgctgcacatgtagttttcttctttttaaattgtcagtggccctggccagattactaattccctactaagttgccagttgtgctagtaccccaccctccaaaatccatattgaccttctgtatcaaaatggctaagtcgtcagaaaccagcagtgggcaaacgttagggtctcagctttcctcctttctttcacttgcttggcttcattggctttgaatcggatagacccgggtaggaacctcacctagcccctccactaactttgtgtcctccggcaaaataaatctccctaagcctctatttcctatatgcaaaatagggatgatagtattacccaattccagggttattgtaagaattcagaggcaagttgtgaagggtgtggcatggtgtctggaatgggtgatgatacagttccctaaggggagctgctgccacctctgtgctggggactctccctttgccccatcccaagaatttgggttggctaatcctgccctgtctggttttggatgagggaccaggaaagaaagggaggcaggataggggaggtgtttttgagaaaaaccttctttttccctctgcaagtatttgtttcaggcagtacgtgaaccctcgaagactgatcggggctggtcctgggtcaccccagcagggttcagtgaagtgggccaggggcactggaccctcggctttctccctgcagggggatctgcctccctggcctcgcctcttgtgatcttctatgcatgttcactccttactcactctgagccttctgactctgaccagcctgtgttcctggcattcttttgatgatgtaagtgtttcacaccctatctgcaaccaagcaggaggacggagaggacttctgcagcaaagagtacctctagaaattgcttttgtgaggttctttgaggtgctaatcacctaacttttatttgaattgctctgacttatcatttaataactccggaggactttttacttccttggcaggaggaggaaggtgattcctcagataaaaccaaaacctagagctgcacttctgaaggaaattgctgctcaggtagggctggatgtgtaggtgttctccatgggcccatgccgtgcctgtaccagcgtcctgaattgacggcagcagaggggtatctttcttcattcttcattatttattgcctgaggcagaatgaatacttgtacacttgggatttcagccatgccttttaagggctgtgaacagacttatcaaagagccatcttgagtggcctgtagggcggaagggagaatacaggacaagaaagtggatggaattaatgggaacaagagtgacataaaatagtttaaccccctgtggccctcttcagacttttacatttgtctatttttatttatttaaaattttttaacttttgtgggtacgtaggtgtatatatttatggggtacataagattttttgatacaggcatataataatcatatcagagtaatatcaccccaagcatttatcatttgtattacaaacaatccatatatattcttttagttattttattttgttatcttatttatttatttattttgagacggagtcttgctctgtcacccgggctggagtgcagtggcacaatctcagctcactggaacccccgcctcctgagttcaagcgattctcctgcctcagcctcctgtgtagctgggattacaggccggtgccaccatgcccagctaattattgtatttttagtagaaatggggtttcaccatgttggccaggctgatcttgaactcctaacctcagatgttccacccacctcggcctcccaaagtgctgggattacaggtgtgagctatcgcacccagcctattatttatttttgagagataggatcttgctctgttgcccaggctgagtcatgctcactgtatactctaccttctgggctcaggcaatcctcccacctcagcttcccaagtagctggaaccacaggtgcacagccgccactcctggctaatatttttattttttgttcagacggtggggaggctcttgctgtgttgcccaagctgatcctgaactcctgggctcaagcgatcctcctccctccgccttccaaagtgctgagattacaggtatgaaccactatggctagcctggtctacagaaatgtctaattttcttcagactttgttctcccttcaaattaggtttcatctggcagagtggctactccatttgtttgcaagcctctgcccttgatgttcagattcctgctgctggtggagccggctgagtttcccagatgggctccacctgcctcctcctcggttgctgcagcattcattgcttcgtgcttcctgtctggctcgcctccaaatgagcctgttcatttcctttctccggaaactgtccttatcactgaggttcaaaagttccataaaggatatggcagtcttgagacttgacctccaaactttgaccttaataaaaactggttttttaaacccagccaacctgaatgagtggactatggcttttgattgctgttagctgaaggagatgtatggctgctgggtgacgccttgaacagtgagatgttatatataatcttgaatttggggtggtgcttgtgtcaccactcggaattatgttgtcagtctcacttccctcctggcttcttggcaatcgtctttattaatgttttcaattttcttactatccagtgaacttactttgtatttattgtttggggtagtgttgtagatggtattactatttgaaaacttactgttgaaagggaccgtagtccagtggcctcttttaataatcagggaaaactgagtccatgaagacacgcctgcctttgaaaacctaagaatccactgctttttctgttgagacagaccccacagagatctccgagaggacggctgcagcaagagtgctgactcccatgcagccgcattccttttctaattgtcaaagctgattagtggatttggatgtgcgtggctcggagtcctctaataatctttcctttcttacatagctcacctagaatttgaggaaaattaaaccagttgtgaaatatatcacgtttcagaaatgaacggcatcttaattgattccctttgagaacacatcagactgggatttctgagtgtaatctggtatgccttgaggtggggacctcatgctggggcactcagaggagactggtccacctccaagtttgttttctggctccaaacaaatgagtggctgtttgactgttggcacactacccagttttaaaagtacaaccatatagggtatggagggctggtaaccagggggtttaaaaagtgaggtcatggaaggcccagatgaagctcttttaatgtgtatcacaactgcaattaatcttattaacatgctgggcctgttcctgctttcgctgccccaggtgtgtgagagtatttagggggcatgctttgaaggattcttgttctttgatgatgcacatggataacagaagtacatcaaactttgtatctggcattaaaagggcttttgtttgcctctgtagattcattcagttttgagaagagagcaaaaagcttcatgccaattgataagatgtacaaaagagggtggattgcaaatgcagtcttgcagcagtgagctctatgaccagatcagaatcagctgaacaggaatggagccctcttctatatccaacactaaggtagttccagcacagtattctgggagtgaaagatgtaaaaaagcagccaggcacagtggcttatgcctgtaatcccaacactttgggaggccgaggtaggaggatcgcttgagcctgggaggcggaggttgcagtgagccgatgtggccccactgcacctcagcctgggcgacagagtgagaccctgtctcaaacaaacaaaagtgtaaaagcactgttgtgtatttgggaagcaaaagtatgcacaggaaacaacaaggcatagaaggtgttgtggatcctaaacctgaattgatgagggtagcatgggggttctgagggcagggaggtaactgagggctgttgtggttaggacggcttcctgggtggggtgggccttgaacgcaggtgaggagcaggatggggtgcaagtggtgctcttagcttgtgctgactgggtagggcagtacgtagtgagaggtaaagttgggggagtatagtagcagcgggtggtacacttcggttttctgtgtgcactctttctctcttgctctcttgtttttctttcttacaagtatgtttaaggaaggctagtatagtactccagccttgtaaggttgccgcttcattttattttttagactatgtgttagaagttgtctaaaatacccacctagccccccccccccccgccaccccggcttcttgcttaacaagtaacctcaaggaccaagaaagaggttaaagtttcaagttcaacagatggggattgcgtgtgctaataatcctctaatgaatagaatctgctcacttcaatgaaaaataagaaaaaagaaatatttgttcctttataatgtactcatttgctcatagttaatgaatatcacataagattaaaagtcgcttaaggttttcttgctatgtcctttaactggtttattttttaattttttaaattttaaatagagatggggtttcgcaatgttgcccaggttggtctcgaactcctgggctcaagtgatcctcccatctcggcctcccaaagtgctaggattacaggcatgagccactgtgcccggcctggtttcttaactgcaggatttcttagagtctttaactttctaaggaacactgggaatctctaagaggagtgaaggaggaggaagaacaggagggccttttctgtccacagcacattttggaggattggtgttccatggaacactctttggaaagcatggccccccgctgttctgcaaagctgtgtgccttgcccttgttcattccagttgccctctgtttttccacttacttttcctaccctgagataacagtgatgcatctattgctacaaggaggattaggggatggggagaggctgttaagtccctctctaaccttttcctgctgttcaaagcatgaacaaagtgaacatcttatatggctgcactaaaaaagttgcccgcttacaagctgaactcaggcaaaatgaactcctgaatcctcacataaacggaaatagagccccaccctgtatcctgccatttaaaaaaaaaaaaatcctctcatctggcagggggaaaaaaatcccagccctagagtggccaggatgaatcagcatgccagggccatacaccaagataagcattgagtctctagatgtggcaccatggcagattatcaacactggtgccgtgagaacactgcagcaagcagcacactgtacttttaaggacaagaacagcagcaccaaacaccccagaaacaactgttctgattctttccttcaggagtagaatttttttttttttttttttttttgagacggagtttcgctcttgttgcccaggctggagtgcagtggtgtaacctccacctccagggttcaagcgattctcctgcctcagcctcctgagtagcttacaggtctgagggactacaggcatgtgccaccacactgggctaattttttgtatttttagtagaaacagggtttctccatgttggtcaggctggtcttgaactcttgacctcaggtgatccacctgccttggcctcccaaagtgctgagattacaggtgtgagccactgtgcccagcttttttttttttttttttttttttgatggaatcttgctctgtcgcccaggcttgagtgcagtggcacaattttggctcactgcaacctctgcctcctgggttcaagtgattctcctgcctcagactcacaagtagctaggattacaggctcacgtcaccacacctggctaattttgtattttcaatagagatggggtttcaccatgttggccacgctggtctcaaactcctgactgcaggtgatctatccaccttgggctcccaaaatgctgggattacaggcgtgagccattgcacctggccactttttttttttttttagacagtgtcttgctgtgttgcccaggctggagtgcagtggcacgatcttggctcactgtaacctccatctcctgggctcaagtgatcctcctgcctcagcctcccaagtagctgtgactacaagcgcacaccacgatgcccagctaattttctatttttagtagagacgaggtctccctgtgttgcccaggctggtattgaactcctgggctcgaaggatccacctgccttggcctcctaaagtgctgggattacaggaatgagccactgtgcctggcctggagtattgctctagaacatcctgtttcacatcgttttatgtggggtttttccttcctcattcttcatttacacctctgtctattatagtctgtatttgcaatgtttactacagtaattagatggagcttaaaattcagttctcatttccagggctcagaagccacatgttgctcctggctgctctgatggacagcacggtcacaggacatttcctccactgcagaaaatactgctggatagccctgatgtatatcaacaatgctgatcattatttgagaaaacgttctgggctccctcaatacctctgcctactttattattttaaaacaattttttgtaggtgcataccatcatacccagctatttctatttttttgtttgtttttttagagacagggtgtgctgtgttgcccaggctggccttgaactcctgggctcaggtgacccttccgcctcagcttcccaaagtgctgggattataggcgtgagacaccatgcttggtgactctgcttactttaatatcttagaagttttggtactgaaagtgaagaacattggacagacatcaaacgtaaatacaaaactgtcccaggtggctcttctcatacatttcactagggttgagcaggacatgctccccacctggaagaccctcctagggctttgtaggtttagctctgtgtgacagttctctttgtattcatcacagggcggtctccactttgtatacctaaaagacttctgagaacagtatttttccctattagtcatactttaaaatctagtttaggagcatctaacttcacatgctgaaattttcttttgaaatttcctttgaaacccccacactgcttgctctgtagctcatggaaatcacttacttcataccatgcttcattgcaaacctgctttggtttgcttataagtccctccatgaattcagtggaaatgtctctcccagagaatgtttttctcttaaggtctggtccatggtactttatttgatgtccttattagaagacatctagaggagtcaagacctagactcagttcagtttgagctaggcttgaattccatttgcaacatgggatgggcccactgctccaataaatgtgatgttttacatgtgaaaggtgcttgatgttttgctctatgcaattcctaggctagaacctgttctgtctgttattgcactgggtattgcagtctgttggtcatcagcaggtgactgcctattgccaaaagagacgatgagatgaaaagtaggaattcatgatttcagaatctagcctcacttggagaaagcacctgttggcctgggaagttcacccttctctgctgacacaggctggaccccacacctgaccaggtgtcagagcacctgtgagagctctgggacctcctagtggcagtgtgatggtaccacttactgagtgtcatgccactggcatcaggcactgtgcatatattgtcccccactcaatcagagcatctgtgctattaatatttgctcttttttgtttgtttgtttgtttttggtaaaaggtctttattttttaaagagatccgtaataccaaaaaaaaaaaaaaaaaccaaacaaaaacccaaaaacctcttgtggggctggggtggggagtaaggtaaactaggctgtcagccaagcaaaggcagaaaggtggggtccacaactgtctctcacagctttaagtgcttggcaccaataggcactcaataaatagttgttgaataatggcttatattatatcttcataacagttgtgtagatattcttttgcacattttacagtaatgagaaaactgaggcccagagaggttaagtaacttgcctctggtcacgcagctagaatgtggcagagctgtgtgattttagacctaagtatgtctaaatcatagtccacaggccgtcactaagctaaagtagaggaaatgatagggccacattcaccttctctcttttgaacagtcactcgttttttgaagcgggggtggggacagagttgctgtgttgtccagactggagtgcaatggcacgatctcagctcactgcaacctctgcctcccaggttcaagtgattctcctgcctcagcctgctgagtagctaggattacaggtgtgccaccacacccagctaatttttgtattttttgtagagatggggtttcaccatgttggccaggttggtctcgaactcctgacctcgtgatccacccaccttggcctcccaaagtgttgggattacgggcgtgagccaccgctcccagcctgaacagtcactcttaattgcactatgtttatttgggcattttgttatgtttttatgtttttaattttgatataatttcacagttatagaaaaattaaccaaaagagtataaacaattctcagaccctttactgagatttgttgggacatattcttagaaagtctgagttgtgagcctgtgggattgggccgcacttcttgagtagagcctgggtcatgctacccgagaactcctgggtgcctgtgaggttgggtgtgtcccatctgagaaagttcgctactgaaaaacagtgacgtaaccccacccaggaactgaagtgagcctgagagcagctctccagggcttgctggctggaaacaatgagggaagagtctaggatttatgaaatatttttttgtggaagaactcttcctctgagaaactgctggagggtttggggaatacaaaacaaaactgacttatgaaaagatgacttgtaactcaccaagcagacgctctcaggcgtggcatgatgccctcactggctgccaagaacaataactgacacattatccacagacggctgcgccccatgccatttcctctcctgccatcacaatgaaagaccagggttgacacttggtattgtatctattccacgtccgctgcaccattttcttttaacccttctttcttgctctcacccctttacctgttggagctactatgcccctcctgggtttcgttttcttctcttcctttttcctgggcatacagctgcgttcctagaaattgtggttctgattcataatcattgtatgtggaggaaggggcaggattctactctgtgaggggacgggagggtcttttttaaaggggtaaacaattggaaagtttttagagttaagggtctttctctgatgctaaatgaaaccactgtcctctgttccaaggcctgagcttatatcttctttgctatgagacccagagaaacagtgcttgggggccattttggaagcagcttgtcctttgaccttccccactccacttgtgcagacaccacgccccgtgaggacgggcgtggtgtctgctgctgagcctgactgccccacacttaggcaggtacctggcacatggcagaagctcagcaaatatttgctgaatgatgaggccttggtgtatgattgctacatttttggcttaaaaagtacagcatcagggcccttggggttttacctgcttttctgggatatactttccagctgatctttgtttttttttgtttttgtttttgagacagagtctcgctctgtcgcccaggctggagtgcaatggcgtgatctcggcttactgcgatctccgcctcccggtttcaagcgattctcctacctcagcctcccaagtagctgggactacaggtgcttgccgccatgcccagctaatttttgtatttttaatagagacaaggccaccatgttggccaggctggtctcaaactcctgatctcaggtgatccgcccgcctcggcctcccaaagtgctgggattacaggtgtgagccaccgcgcccagccagtttccttagtttttaatctctgagaaggaaagataattgttacgtaaggatgtctcagttatctatgtgtggatgatccagggaaaatttctctttccagactggcttactctttggattttcctcaagcttctcggtctgcctgtgcgaaggggcctaaggctgggtgttaagtcccatagcatgagcaaaacctgtaatttagggttaaccagctttacttaactcccattaccccttttccttctcctcattcttagaattctcacgtgagtggtagtaagcccctaggatgtatgtatgctgctgtgtatgtgcttagccatttcctgtgtatttaatggtgaacctttggtgattcctcacatggaacccttttgcccttggtcacacttgtgaaagcacctccacatctttgcaatcagatcagcctaggccaggaagcaccttagaggaggtgattgactctagttccttgtttggtagagaatgagggaacaggctcagaaaggttaagcccaaggcacagggttagttggtgacagacccaggactggggcccaagtcttgcaggtgtggtgcactttctgcaacacccctttgccctgccaacttcccatcccacatccatgagattttaagtcccttattgtacactttttagtatatgctttgaagagtctttggacagttaaaactgaatgtacaagccaagactacctcattttcttcttcagctatgactggtacccagctaattgtggattggtaagagcaagacaatcagagatatgatacatgtttaaaacttcattggggctcagtgcagtggctcatacctgtaatctcagcactttaggagactaaggtgggaggactgcttgagcccaggagttcgagagcagcctgggcaacatagccagacgtcatctgtacaaaaaattagctaggcgcagtggtgcttgtctgtagtcccagctattcaggagactgaggtgggaggaatgtttgaactcaggaagtcaaggctgcagtgagccgtgatcacgcccctaaacactagcctgggtgataaagtgagaccctgtctcagacaaaacaaaacactttcttggaagtagtctctggagcttttgaaagtttattttaatccacagcttttcccccaccaaacactaataccaaaaataagattactttggggttttaccttggcaaataggatgctcccaagggactttgaagcctacccctgaagctagggaatgaacacattatcttgtgctggtatttatccagtattacccaatatactgacccattagacttcaccaggatggtgctgacattgaaaagtcacggagataggccgggcgccacgagataggtggctcacgcctgtaatcccagcactttgggaggccgaggcgggcggatcacaaggtcaggagatcgagaccatcctggctaatacggtgaaaccccgtctctactaaaaatacaattagccgggcgtggtggcgggcgcctgtagtcccagctactcgggaggctgaggcaggagaatggcgtgaacccaggaggcggaggttgcagtgagcccagatccggccactgcactccagcctgggtgacagagcaagactccgtctcaaaaaaaaaaaaaaaagaaaagtcaccgagataatttgtagtcagcacacccctcttagggtctaaagtcaaagatcttgaggcttcaatggatcaagagccttttcttactctacgtggtattgacgcaagttctgtagtagcccctcctgctgtatttacgacactagcttccagtgggcagatggaaaccagtgcctgcctggagactatccagctgtgagaatgatgtgatgtgtctggcagaaagaggcgtgtttacaaaggctttattttgcaggagtaaatcattggattttaactgttcttcctctctttgtgttgaatctgattatgcagcttttctgtaagtttttaaatgtttacccacaccagacctttggggactgattggatttagtgggagcaccctagaagacctggattaaagtggaacttggtctctcaactagttgggttgtccttggacaaactgcttgacctctgtaaatcttctgtccttatctgtaacgtaggggtgctaattagcattaattagctcattgttgggaggattaaatgagaacacccctgtggaattacttagagctcccagtaaaggttggagttagggaggattagcaggctttcatttgcttccacattttttttcagcagtttaatttactgaaactggcataataatgcctccttgattaggttgttgggagaagtaaaggcaatacaagtttggtgcctggtatacttcatcagggtgacaaaatgctgtcatttggtcatttgtgatcatgtctgctactgcataatgtcatgcactggtgggactctttagacagctaattattggtaaattcttcacagtgagaagaggatttaaccgatatttctccctctagagtgtggggaggtagagaagtgggtgagactggaagggtgggaaggagaagtctggctacttgtatcttggcctggggatttgtttggaagatgaattatcctctggtagttgtgtacagtttacaggtcagtgattagtatgagtccgtgaatagtgccagttaatactgattaactgctgtactttttgccaataaatattgtaaagctataaagacaacagagttaatacaagttgctaaagagaaacttgtggtaaatgtctttaaatgttgtttaaaatagaaatggccaatctagcaggcatgctgaggaaatgatgtttttgcagaagggaaatttagcaatgacagttttgcagaatatattggtaatgaagtgttacttgtagctgctgacaaattagttttcttaaaaaatatatcccctaggaagactgtagtatgaaagaatgagaaccgtaattggtggatgagcctggagagtttgaaggtaagagagaaagagaagcagcgagggagagaaggagagagagagagagagagagtgagtgtgtgtgtgtgtgtgtgtgtgtttcaaggtaacatgcaagaacaataaggttcttcttgtgtggttgtaatttttttttttttttttttgagacagggtcgcactctgtcacccaggctagagcatagtggcataattatggctcactacagcctcgacctctgggctgaggtgatgctcccacctcagcctcctaactagctgcgactacaggtgtgcaccactgtgcccagctaatttttgtattttttgtagagatagagtttcctcatgttgcccagcctggtcacaatctccagggcttaagctctgccgtccttggcctctcaaagtcctgggattgcaggcttccaccaccgtgcccggcccttgtgtggaatttttaaaaaatcctgacttatctgtttgtttgtttgtttgttttttttttttgagacagagttttgctcttgttgcccaggctggagtgcaatggcgtgatctcagcttaccacaacctctgcctctcacgttcaaagtgattctcctgcctcagcctcccaagtagctgggtttacaagcgtgcgccaccatgcccagctaatttcgtaattttagtagagacagggtttctccattttggtcagggtggtattgaactcccaacctcaggtgatccgcccacctcagcctcccaaagtgctgggattacaggcgtgagccactgcgcccggcctatccgcacttttttttatgattgctcacatgtgacatgtcttgtttttcttctaggatgttgagaaagagaaggaaacccacagttacctcagcaaagaggagatcaaagagaaagttcataaatacaacttagcagtcacagacaagttgaagatgaccttggtaagcactcaaaatactatttaggttgacacctgtcaaaagacaaatataaattgttggtactacaatctatagttctaaatatctgaatagcatttgtagaagtgtagtagtcaaggtatacagaacaggaaagtggaatatttctgtggctttccatttaaatctgtattgtgaagtagctttgtctcaaaaatcagttgctgggttaaccttaaaaaagtgaaacacttataattttattttaaaagattttgtgacccacccctccctcctcaaaggatttttagcatcattgcctaacatacagaaatggtgactcagattctaagaagacctcaggtaaggttttttgttttgttttgttttgaaacaaggttttgctctgtcacctgggctggagagcagtggcacgatcaccgctcactgcagcctcgacctccgggctcaagtaatcctcccacctcagcctcccgagtagctgggaccacaggtgcttgccaccatgcccagctaatttttgtattttttgtagagacggggttttgccatatcacccaggctcatctcaaattccttggctcaagggatctgcccagcttggcctcccaaagtgctgggattacaggtatcagaagcccctaagtttttgtcttgtacaaaataaatatggaagtgtcagggaaaggattttgagcccatggattggaatatagaggtatataataggatagttttctctgccggtcgttagtgtaagacaaggtacttaatactcagtttcttccacgtcgctgtcgcaggcttccacagcattgtgccacactgaagcatgcagggagtcggcgtacaggagggagaagcctcagggcctggggatagggaaacgagctgacagcggagctagagtattcatgttcctctaaacttagctggcatctaggtctcgcctacccattgggtggcccgccttcttcatggcacttgtcagcccttggcgccagtttccagggcacttggatccccgtctctcagtctgtttactgtgaactgacagagtttggtaaaggacaaggtgattggtttaaaacaggccctaccgaatcggtgattcttggggaggagctttcagatagaaacccttgtggtaaaggacccctccctggtagaactcctccaaaaagaggggagaggagcagagaatcccaagataactcttcatcattccagcagcaagatttctttttcaaacacattttttcatcaaaggagaaatccacttgctatgttttttttttttcctttcctgatagagactaaaacagatacaaattatccatgtcattttaaagataaaaattttaggctgggcacagtggctcacacctgtaatctcagcattttgggaggctgaggcgggtggatcacttgaagtcaagagttcgacggtggctcacgcctgtaatccagcactttgggaggccgaggtgggcagatcacgaggtcaggagatcgagaccatcctggctaacacagtgaaaccctgtctctactaaaaatacaaaaattagccaggcgtggtggcgggcgcctgtagtcccagctacgcgggaggctgaggcagaagaatggcgtgaacccaggaggcagagcttgcagtgaggcaagatcgtgccactgcactccagcctaggcgacagagcaagactccatctcaaaaaaaagagttcaaggccagcctagtcaacatggcaaaaccccatctctcctaaaaatagaaaaattagccaggcatggtggcgggtgcctgcagtcccagctactcaggaggctgaggcaggaggatcacttgaactcaggaagttgaggctgcagtgagctgtgttcgtgccactgcactccagcctgggtgagagagtgagaccctgtctcaaaaaagaacaaactagagaattaggattgaaaattgatcttgtgggaaggaagaaaaataacacaccataaagatagttttaaatgttctactttaactgtggcatttatatgtaacacttgacagtttaataaaacagtacaataaatcttttctaaatatactgtttttgtttgtttttgagatgcagtctctgtcgcccaggctgaagtgtaatggcgtaatctcgtaatctcggctcactgcaacctccacctctgggttcaagagattctcctgcctcagcctcccgagtagctgggattataggcacctgccaccacacccagctaatttttttttatttttatttttagtagagacgggatttcaccctgttggccaggctggtctcgaactcctgacctccagtggtctgctcgcctcggcctcccaaagtgctgagattacagacatgagccactgcgcctggccccaaatatactgaatacaaaaataaaaataaaaagtgaagaccaaactgttattactgtttttggcaactaagaaatagtaattctaccatcagtgaaggtagttgtttttaagatctgtactgtgaagtatagtggtttgaatttgtttttttttgttttgttttgtttttgttttttgtttttttttttgagacagaatcttgctctgtcgcccaggctggagtgcaatggcgtgatcttggctcattgcaacctccaccttctggtttcaagcgattgaatttttttttaaaatgctgcttaagagacccgaaatgcattctatgctgtatggcatatatgctgcattaaaaagtttaagcagagttagtaattcagtgcatatgaatatagccactaggaatgaaaatagcctgttttcttactgtccccttgttgttgacttcagtatttcagagccctaattgtgaccttccttttgtgtataatagtcaccagttgaggatgttgtttcctttgagcctgtagcctagacatatcccccaagctttaataagttttgtggtttggctagcatctgctccgttggattgtaacctcgcaaatggaccctgaccttttgccagtagcttcagaggcatgagtctggggccggcagtcagccacagcatcaggaggcttcttcagtgtccacatctgccctgcagaccttgcctctggaagcactttgcctggtgtgttaaccgccctctgaggtcattcctttgggggcaatctttagtgaagttctgccacaaacctcaagagaagagaacaaaggagtgtttcaccttcccgttttgttttgatatgcttcttccctaaagtgccaccatccacccagctaagtgtgtgcttctctccctgcttcagaattcaaatgggatttacactggcttcattaaagtacagatggaactctgcaaacctccacagacttctccaaattctggaaaactctctcccagtagcaatggctgtatgaatacacttcatatcagcagcacaaacactgtcggggaagtgatcgaggccctgctcaaaaagtttctcgtgactgagagccctgccaagtttgcactttataagcgttgtcacagggaagaccaaggtacgctgccagcttaaaaggaaaatggtctgtgcttctacttgcatctgctgttctcattagcagagggaagactggtgggtctcatccatgtcagttgtgtcagagcctggagtccgatgctggaagccatggtgatcttagcatgcacttagtgcttcctggctgtccatatttttgagttggacagttgagggtctgaggagcttggaagcatccatatgtgattggcagttacgagtattttgtggtgttggtggggggatggggcgggggctgtttttggtggttgttaggagtggctttgattttagttttctttaggacacaaaagagtgcctctgtgtttgaagttttcaatagcacattccacatttgatgtgcatcagtacgtggagtggtttggtggatgtgtgctgagatcttgcgactggggaggcacatgtgcatcacagcacatttcagcgtactgatggaaacggcccagccctgggctctcctgttgccttagcttgtctcacttggtgttacgccgggacattttggtactctgtcccccagaggctcatcaaatgagtgaataacattttgatctagggtctgactaaaacttcatatccacattcaggggatagaaagagaacattaaatattaaattactgcgtgaaacagaatgagatattccaggtcaggcagtgaccagaaattgataacattggtggacagtagtgattcagtgactcactacatgcgatttgaaatcggggtgtgtgtgtgtgtgtgtgtgtgtgtacaataaactatttaagctttctttggtttttctcggtaaagcctaatgtagctatagaagaaaatatattaaccttgacatgatagtaatgttcttcagttacacaggatgaaacccagctcattgctgagtatgcatacatctttttaaaaacaaaccatggggctagaccctgtggaatacaaagatgaacaggccagggttcctaccttcagaggtcacaagcttagtattgtgggggcttatatctatagggaaattggcacctgcgatgcagtgcatctggaagtgccacaataatgtagagaagctcgatggcatttttatctgccagtttctttgcctgctcacctggactttagctgtacaatctgaaagtaatcgtgacttgttgaaatattacccccatggctggcaaatcctttaacatgattggcaatgtcactgtatgtgtgtgtctagcatgagacatatatagctgtgcttgaagctaccggagcttatattctgattgcttggtttgtagctgctaattcgctaattctttttttttttttgagacggagtctcgttctgtcacccaggctggaggtgcagtggcgcaatcttggctcactgcaagctccacctcccgggttcacgccattctcctgcctcagcctcccgagtagctgggacttacaggcgcccgccaccacgtctggctaatttttttgtgtttttagtagagacgggatttcactgtgttagctaggatggtctcgatctcctgaccttgtgatccgcccgcctcagcctcccaaagtgctgggattgcaggtgtgagccaccgcgcctggcctcgctaattcttaattaatctgtagagagatttgcttttagaactcttgtttttatgttctttggatggtatatacatttttttttaaatttgttttttgtttgtttgtttgagacggagtcttgctctgttgcccaggctggtgtgcagtggcacaatctcggctcactgcaacctccgcctcctgggttccagtgattctcctgcctcagcctcccaagtagctacaattacaagtgcccaccaccatgcccagctaacttttgtatttttagtagagacagagtttcaccatgttggtggccaggctggtctcaaactcctgaccccaggcaatctgcctgtctcggcctcccaaagtgctgggattacaggtatgagccaccacgcctggccttggtttttgagacagcgtcttactctgtcacctaggctggagtaccatggcatgatcatagctcattgtaaccttgaactcctgggctcaagtgatgctcttgcctcagcctcctaagtagctaggactataggcgggccccattatgcctggctagttagaaaaaaaaattttttttttttggagaccagggtcctgctatgttgccctggctggtctcgaactccaggcctcaagtgatcctcctgcctcagcctttaagtgttgggattacaggtgcgagccactatgcctggcctatttttattgtttttaaaggagtagtggacccttttttaggtttcttatcttgccttttttttttcatttaaaaaaaattttatttattttttgagacagagtttcactcttgttgcccaggcaggagcgcaatggcacgatctcggctcactccaacctccacctcccaggtttgagtgattctcctgcctcggcctcccaagtagctgggattacaggtgcccgccaccacgcccggctgattttttgtatttttagtagagacagggttttgccatgttggccaggctggtctcaaactgctggcctcaggtgacccgcccacctcggcctcccaaagtattgggattacaggcatgagccaccatgcctggctcttaccttgttttctaaaaggaagagcagagctaactataagcatattttgggactaatatctattaaaatttattcttgaaaataatttccttcttaatcaaggcacagtttatatttgaacagaaacagaatagattttattccactgtgggctactggtattaaataataagatgagccgactggcgacttagaggctggggtaacttggatggttaccttgatctggaggaggggatcacaatggggaagtggtctcaggaatggctgaatactctgtaacatgctgcttgtttctttacccagtctacgcctgcaagctctcagaccgggaacatccactctacctgcgtttggtagcagggcccagaacagacacacttagttttgttcttcgtgaacatgaaattggagaggtaagttattgttcactattgctttaaactatacagaacagctggccctattttattgcagtagcctagtgacttggctattgatgggggatgggaagagaagagagttggagggcagggggatgggaagagaagagagttggagggcagggagagggagagggattttgaattgtcagaaatgaacccaaagttagcctatgatgtcattctctcacaaccttatattattagtctgtcattttcagaggtgggagaaaataaagtttttttacttgatctccatccagagagtcattttcaccccttcccacctccaaaatactccagtccagctgaactttgaaagttgacactcaccatgtgtttgctactaacaaaagtctccaggctaattcccttctaaagggatataaaaggaaattcgatctctttaccatggaaggcatttagctttctagcatcttttttttcccccttgcccagtcaactgattaagaaattatgtttccatgtgcatcatttgccatgttgtctccagggaggattgtatttagccagttcagtagaagaaaaaaagcacttgagcctgccctctagatcaagtgtcagctttaaatgacacttgagcaaatcccaagctcctgtcccagtcttctgtctggaacaggaaatggtgtgaaatgtcctacatggtgcaattgagaatagggtttctaggttaaaagttaggaaacggctctgtttcctactgtttgttagattagtagcatgaccttggataagtcttctaatcttttagccctcagttttaaaatctgttaagtgggactaaacactttacaaggtgggctttgagtcacaattagaaatgtatacatgtaagtgaagggagttttaggaagacagtggttttacatgtttttgaagtttcttttgattctggtgttttgaagcttttcaagacattcagactcattttggggagaaggcagggtgcagaaatctgacttggctttgcagatggtgaccattccctctgccagcttaagccagacacattagcatagtctactcagtgttttatttttcttgtacttagtgttttaagtagcaactagaactacattgggcaagaattttattaacttggttattttattgtattttaattataattagagatagggtctcactacgttgcccaagctggtctcaaactcctgggctcaagcaatcctcccacctcagcctcccaaagtgctgggattacaggcatgagccactgcacctggccttaacttagttttgaaattgacttgacattgggttttattgttccagactgctgtactggacctctgtatggtgttcttatttctcagttatttaaggaaaactgaactgaggaagaaatttccatagctgttagggggtgggagggatatttatatgatgtctttattttggagacttcaacataggtgaaagataatctgttaaaattttaaaaattaacagaatattctaacgtagaagttttgctctcctactccatgttgctcttttttttttttttttttttaaataaccagcctaaactgttctccaggaattcttctaccactgagcccatttggtggatttacttatttttcactctttgtttgtatttggttatcttgaatcttttctctacaccatcagacagcagttctccaccaggatccagggccccctttgggagaggaggatgtgtttggaaaaaacctcgtagatgatgctagataccctccttgacattcactgcttctattttttaaaatctgttttaatttttttttttttctttttaaagagactaggtcttgcactgtcacccaggctggagtacagtggcgcaatcatggctcactgcagcctcaatctcccgggctcaagcaatcctcctacctcagcctcccaagtaactgggactacaggaatgtactgccacagccagataatttttaaattttttgtagcgacctggtgtcactattttgcccaggctggtctcgaacttctggtcttgaacttctgggctcaaatgatcctcctgcctaagcattccaaagtgctaggattataggcatgagccacaatgcccagcctaaaaacttattttgtgcctgctaaataagtactaggagctgttagggaaacaaggctcagagcctcaaggcaagagataaactccaaatagcgagaagtacggcagctgtggtgtaggtaaggtgcaggtgagatagatattaagcaaataattgtaatttaaaaatcttggttgtgatcaggggctctgtgaaggcttttgatacacttagccttgggtgggaagagaggagaggaagttgtggaaagctgcttagagaaagtggcatttaagctgagatggggaggatgagtagttcatagccaggcaaagtggaggaggggagaatgcgtgccacttgggcagagagtgaagctcggtgagagagagatggggccggagagtttagagtctttcagacagcatcagcaactaagggaagccattggatggttctaagcaggggagagtcttggccagatgagcattttacaaaggatgttctgtttggggaacagatgggggagcataagagccgagtgaggaggccaggtaggaagctgttccagcgatgcaggaatagatgatagtagctagcaccaaggggccgtaccgagggagaaaaggctgaatggagaactgtttgggggtgataagactgattatgcgaggtaagaaagtcagttacaatgaggactcgaggttaagatgaaaggactgtcgaattgtttttaatgctgttgggggtcaaatcaggtaaggaatgaaagtgtccaatagacttagggatatggaggtctctggcttttagggagatcgtcttgaacagtgggaggagagggtaggaaggtgattggtgtgagctgaggtgggagtgggagtggagggagcccttaggctggcaacaccccagctcttgcagaccacaccttctgcggcatggggctgggaggggagggcagccgcacctctgggagctcctggtcagcattcctaagtctaactgagtattaaacatctggcatttttctttctgtgtttcctgacagtgggaagccttcagccttccagaactacagaatttcttgcgcatcttggacaaggaagaagatgaacagctgcagaacctgaagaggcgctacacagcctacaggcagaagctggaagaagccctccgtgaggtgtggaagcctgattaaagcggggctccctgcccgtgaggcccggtgcaggaccgatgtacaaaacagcagcaagtgcctctcttctcagagggctgctgtcttgccccactatgctagggtcttcgcctttctatctgtagattttgttccccaaacctggtcacacagcatcctgcaccttagcgtcccatgtaagggactctgcaagcttgttgttcagcaccgcagtgttacctcttggcaagctgtgaacctgtcgcctcatcaggagcattcgagggtgcttggaagcatgaactctgggggtgtttttttttttggttattttaattatgtgatgatgctgttaagcttacagatatgcagttgattttttaaaaagcttaactaggaatctttctgaatacttgtcctattttgaaactacctgtctggttttttgtttggttttgttttctttttttaatgtcagaggaatctatccatgtgaatcgaaaggcacaggaatctaggaactctgaggaatttattgtgaaggattttgttagggggttgacagagaaagcaaagtgtaagtttggaagaaggcatgtgcggtggtggcgagtgctgcgggctatggaaggtgacttggcttttcagttaggggtagtggagaaaggggtagttgcttgtaaacgagttaaaagcattcagtgtggaggtgttaaacccattttaggatcgcttggtttcctggtgggtagaatatgggaacagagccagaggcaggagctaaaccaaaaggagggacccatgaactctgcagctgaccaatcagagaatcaggcaggtgtagcctactgacctgggcagaggtgggcctcacgcagctggatccgaccctttaattctgcccttttggagtggaaggtctgattggtgtagctgctctgcataggcaggacagtgacagttcactaactcttgttaagttacatagtgtatagctttccccccacaggtggttttcaaagttgagacggaatttgggtaggggcagctgtttttcccttgattgttagctaggatatttgtcaagtaaactttggtgacaatcactctcttcccttttattcctcctttccttttcctttcttcccttttttctttccttccctgctgtctcccaccctaccttgttcttttcctccctccctccctccctccctccctccctccctccttccctccctctctctccctctccctttcttttctacattgaaatctgttcttacataatagagaacagggctattgaataaagacccaatcctaccagatctttagttctaaagggcaacttgactgtgagtaggagggcccccaagaaagggaggaaagtccacacccagctaaccacacaacagggcttcattatggaaatattttaacaaaagtacatgttattaccaaccaaagagatgcatgtgcaatagaagccttccttaaaaacaggctaaataacctcattttatgcagcagtttaatctgagaacagagggaaaggtgtgcagtggttccagaggggccttatattctatttttagtctagatattttttgtttataaattcccaaggaattgttaacactttggtgacacctaatggattctttttgaaattccaaggtgcttcagttctttgcccaagtgaactgtgccttttattgcatttctgttcgtctcttggtggctcttctgactttttggagaatacccatcttgttggaggcagacttaagttgttatgctgtgccacacaatttactgagacaatcatatcttcctaagcatttaaggaaagttgaaaaaaatagaattagctataaaatatgtatggcacatcttgtttaattttgcatgtaacttctcttttgtacattgatgaggttttagtgacattgtcatccaacactttacctttattgttcagggaatgccttcgtgattttttgtactggttttattattcagactatggcctggatttgagtatattgttattaccacctggttttttaattattcatcccagtaaacttatattttgtgaagcatttgtttctcagattaagacactgttagaacctaaagtagtagctgatgggtatctgtgaattttttttttttttttttttttacttgaagtagattgtctgaataggcatcctcatctatatttacccaaaacctcgcttactgtcatgtgcactacaaattgcaatttggaaacctactgtattgaaattctgtcagtttatggttcttgaagactgatgtcctttcccaaacactggttactgcagcagcatttttaatgtgtaagtgaagaaaaaaggccactaaggccaaagattttttaagaatcattgtacaaatcattatgttaaactatctaagctttgctgtaatactgttttctcttcaatatgtgatggtacaggaaggatgttaaatgaaggggtggtattgcaggagagcattttaaatggcagaagtaaaaagttataatatttataattttgatgggtttaagtttatttttgtagggaagatttttctcccctaaaatagtttctagaatggcaaaattgtttccattattaaaaattgaagttattagtt

SEQ ID NO: 798 - DNA, 87056 bp, Homo sapiens; identical to SEQ ID NO: 797

SEQ ID NO: 799 - DNA, 222222 bp, Homo sapiens
cggaagcagagctgtgcagctgaggcgccgccgtggagccgccttggagccaccgccccctcgccgcttcgccgctgcgttggggaacctggaccgcggcggcgccgggtttccctcatgatcccgggcgggtggcggcggcggcagaggcggcgggaggatgacctcttaccgggagcggagtgccgacctggcccgtttctacactgtcaccgagccccagcgacacccgaggggctacacagtatataaggtcaccgcccgggtgagtgccggtgtcgggctggggtagagcttggattgggacctgaggatctggggtggggaccctgatgtgagggtacctgactctggctcagagccgagggtgggactgggtgctgctcctactggcgggacttgggtgtcggaggttgggatttttagagtagtggctgagtgtgatatgcccagggcttcactgtagtaggtcgtggtagagtcctctttctgggggtggggcagtcagtggttgatggttttaaattgatgactcagttcccatcccgtttggactttctcttctgagttcgcaatttgcagaagtggttttgcttgctccaggaagataatgcagattaaaaagtgttaatttatgtattgtttggcttatgtaatataagttgttttttctcttgacctttatcaggtttgctgtgagaaagacagattcttgggacagatgtcagtgttaggccaccaacctaggaactgtggatccgggctttgtcaaacctttgagtttttcatgtttttcagtaggagacgtgaaaaaaatctgctgagggtggcttgtgtgagctaccatgagggcacattttaaagttgggaggctcctttacatcaactaactggtccaatttttagtacccactttatgtttcattgcttttgccttgagttttaaagagagtctgcatcttctaggaaagtaagaataaatcaaaattaaataagtatatatgtatgtgacgtatgtgtgcatgaatatatgtgtatagtaggcattttatgcacatcacccaatttaattctcattttaatgaggaagaaatagattaaagcaagtttagtaacttgcccaactttacattgcaaggcagtagcagatctgtctgggatctgaaaccagttttgcctaactccaagttatataaaatgttaataattaactttatcaatttttaaagaagagaggtacagattaagtaacagtagttcaatatacatttggaggatgtaaagcaggccttcagaataatttttttttttttgagacggagtttcgctcttgttgcccaggctggagtgcaatggcatgatctctgctcaccgcaacctctgcctcctgagttcaagcgattctcctacctcagcctcccgagtagctgggattacaggcatgtgctaccatgccctgataattttttgtatttttagtagagatggggtttctgcatgttgctcaggctcatttcgaagtcctgacctcagttgatccgcctgcctcggcctcccaaagtgctgggattacaggcatgagccaccacacccagcctgagaagaatcttaaaggttaaatagatcagtttggggcatgggagtggcacgtgatgtatggaaatggtgcacaattcagataaatgtgagaaggagggatagatgaacatgtctgtataaagataatgagaagacctgacctgctattgccgattgctgttcggagaatagagggatgtttgttgctccctgcttgcacttaaggttgttacatgggtggaatgttagtttcaggttgtgtaagaaattttgtgagagtgaggggcccttattataccactcttgaaacctttctagtcattgggccctttgaaaatctaggcttagtttcctaacacatagtgtatggaatcagaacagttttcaacatacgtaatgtttctctcacagcatcctacttatccgttaatttaacaggaaagttatattgtattaatttagttgcatgtctgtgtctcttagtggatttagagcagttctctatcattggcatttgtttctgcttatatcaaataatagataaaagaacatgcatgtgcatggcacacagtgcctgaaaaacattgttgaatgttttcctcttcattgtacggagcacacccaataaatgtttagatccaggcactaaatactgagggacataaggctgaataaagcagggatctttattcctttcaaggatactcatagtagaagagagtttagtatacttaagtgtgatataacacaggaagttccagcagacactacagaaaagggctgtgggaagacagattgcttctggatcaagagattggggaatatgtaccaatcaagatagttgaaagaggggaagaatccagaaaaggagagggtatgaaaaggtagacagttgaaggggtagagtccataaagacctggaggtatgaatgtgtgtggaactggaattggaagcactgagtataattatttgtattgttactttacaaaaggaaaggttaaccaaattcagaattttttttttttttttccaaggcgtagtctcgctctcttgcccaggctggagtgcagtggcgctatctcagcttacagtaacctcgcctcctgggttcaagtgattctcctgtctcagccactcaagtagctgggattacaggcgccctccaccatacccggctaatttgtctattttttgtagagacgaggtttcgccttgttgtccagtctggtctcgaactcctgacctcaggtgatccacccacctcagcctcccaaagtgctgggattacaggcgtgagccaccgcattggccaaattcagatcttaaatatctgaagctgtgacctatttactgagctaagttttgacaatataaactagaagataaagtagcacattgccttagaactaaccacatttatatatatgcatgttacatattgctctggttatttgaacttgaaaattgcacagactgccttttttcttcccgtaaatatttatgtcttcatttattgcttatgttacagattttgtttttaaaatgtaaggtctgagagtcaacgtggagacatacttttaaaataactgtgcttagtattataaaatatttcttgagagttaaggagaaaaacaccttttttcaggataattaaccaggtaaatagtgctctcctgagagaacttcatgagataaaaattaagaatgtcttctgtatattttctactactgatttacttctagcttcaaggaacaattttctatatttttgatccttgcagggttatttctgtaggagtagagttttaatcattggaagtaccaatgttaaattttggatagcaaaagagctttttcatcttcttaaatctcctttgtgcttttttgcagttctctgaaatctggcaaggttagatgattttgaggccagttgcaagcatactaacagattctgcagttaaactcagtgttatttcttaatttttatgtagaataagtacctctattcagaattggaaaattctttcataagttccctttgattctttagttgaaggagacacaagtgtaagagaaccatcagcagtgttttcagttatttcatcatgctaagtttacaaaattctcatattgtagtatagatttctcagcaacagtaggtgaatggcagttcttgcctgtattctttccatgagtataaaaggtatgtttttattctcaaaagacagtgctgtattataacttatttaatttacattgagtcataatttatatacagtaaaattcacccattgtaagtgtccaatttgatgagttttgacaaatgtatacagttgtgtaactacccatgttcatcactgcacaagttccctcatgttcctttgcagtcagtcactccccctcattccctatctctaggcaaccactggtttgctttctgtcactatagattgggttgtattttctagaattttgtatacaaggaatcatatagtatgcactttttttttttggtctggcttcttccactcagtatgattatttgagatttatccatgttgtcatgtgtttcattcccttttattgctgactcatattccattgtatggttatactgcattttatctgtatatactgcattttatctgatggatatttgggttgtttccagtttttggacattatgaatacagctattatgaacattcatatacaagtctttgtatggacatatggttttatttctcatgataccacatggctttgtttatgtagctttatactaagttttgaaatcaggtagtctaagtactctttctttctcaaaattgttctggctattctagattgtttgcatttgtgtataaaatttagaatcagcttgtctggtttctacaaaaatgcctgtccagattttgattgggattatattgagaatgtagatgaatttcagaagaattgatatcttaataatattgtctctgatccatgaacataatatatctcctcatttatttagctcttcagtatgagcagtgctttgtaattctcaggatacagtcttgcacatgtttatttttatttattgatctttttcagagatgggggtttcactgcatcacccaggctcgagtgcagtgacgcaatcatagcttactgcaggttgaactcttgggttcaagtgttactccctcctcagcctattgcctgggattgtgggcacaagctacctcattggctttgcacctatttaaagtagtttgggtttattttgaaaccaggagaatgtataaatcctagttttattatacgtagctagtgtttgttgagtaataacagcaaacacttacatggtgcttactgagtcaagcagtttatattaaattaacacatttgtcacaggggcccggtgagtaggtaccattatcatttccacattttcaatgaggaaattgaggcacagagacgtttagtaacttgtccagggtcatatagccagcaagtggtagagtctacatttgaacccaggtagactggtcccaatcacagtgcttttaatcccaatgctatgctgctgaatacctgtattataaaacatttttcattaggtgctgtgagtgtgcatatggggacacctatgtgtccccacaagggcattactatagtttggcaaaagtgatggatacgtgaataataagtaactgtgatgatgtgaacaaaggggagtgagggaattaatgggaagtactgagcttcacttaagtctgaaaaattaccatttccaaagcttcaaatcgaagcactatttatattgcttggagggaacctgtcctcatttcctgaccatattcttaagcagcctgcttgtgcctgggaatggaattatttgtagtttccaaattaggttagaacactacattcttccatatctctctgttagatgctattttctctgtctggaatactctttccttttgtcttggcaatctctgctcatctcaggtgtcagctataccctgtgttccgggaagcttttttttttttttttaggcgttgctctctatatgtcttgtatctcctccgttatcataatgtacttgtttgacacctcttctgatggcagactctattcttttttgagagtctcactctgtcacccaggctggagtgtagtggaacgatcacggctcactctagccttgactttgcaggctcaagcaatcctcccacctcagcctccctagtagctggaactacgggaacatgccaccctgcctgactaatttttgtattttttttaagagacggggtttcaccatgttgcccaggctgatcttgaactcctgagctcaagtgatccacccatctcagcctcccaaagtgctgggattacaggcgtgagccaccatgcccggctgactctgtctttttaactgtatattcttggtgcctagcacagagcttggactatagtagggatttcagggtaggctggaaggaggcagcgctttgcttttcaagtattgatttttaaattaacatacaatgaaattgacttattcttttgtataattctttgaatcttaacatgagtataaattcatttatctaccaccataatcaagaaacagaagtttcatcatcctaaaaaaactccacccttccccctactccttataccctggcaagcagcgatctatctatactactatacttttgtctttttgagaatgtcatataaatagaatcatatagtatttagccttttagactgataatttgcctatttttttctttgggttgtttgtttcttactcctgagttttgagagttctttatgttctgggtatcttttttttggggtttgatatgacatttgtaaatattttctcctgatctagagcatatcttttaattctctgaagtatcttttttttttttttttttttttttcctttgagacagagtctccctctgttgtccaggctggagtgcagtggcgtgatcatggctcactgtagccttgacctcctgagctcaagcaattctcccacctctcagcctcctgagtggctgggactacaggaatgtgccactgtgcccagctaatttttgtattttttaaatagagacccagtttcaccatgttgtccaggctggtctcaaactcctggtctcaagcaatctgcctgtcttggccttccaaagtgctgggattacagacgtgcgcctgaccttttttttttttttttttttttttttagagatggggtcttgctgtgttgccagggctggaatgcagtgcttattcgcaggtgtgatcatagtgtgctacagcctcgacctcctaggctgaagtgatacccacctcagccttccaagtagctaggactacaggtatgccactgcacccagacagtgtttttgcaaagcacaatttgtaattttggtgaagtccagtttatcagttctttattttatgaaccatgcttttagtgtcatacctaaaatctctgcctaacctcaggttacaaatatttttcccaatgttttcttctagataacttatttctttgcattttatattttgctctatgatccattttgaggtttttttttttgttttttgtttttttataaggtgtaaggtttgggtgaaggttctgtttttgcctctggttgtcccattgcaacaaaacaccatttgttcaagagactaacctttcttcgttgaattgcctttattcctttgccaaaagtcaattgactatatatgtgtaaagctgtttctggattctcttattttgttccataccatacaatcttgattattatagctttatactatatcttaaaattaggcaatattgtttctccaattttattctttttcaaaattattttgactaccctagttcctttgctttttcatatatattttagaatcagtttatctatagctacaaaaaatccttttgggatttgattaggagtgcattaaatctgtagatcactttagggaaaaatggacatcttttctatgttgaatcttcaaatctatgaacacagtatgtcttgcagtttatttgtgttctctgatctcttctatcagcattttgtggttttgagcaaattgcttctctgtatattttgttagatttattccccactatttcgtatttttgtagctattgtcaatagtatttttaaaaatcttggttttcagcttttctttgctaatatatagaaatttggttcatttttgtgttgtctttatatcacgtgactttttttaaattatactttaagttttagggtacatgtgcacaacgtgcaggttagttacatatgtatacatgtgccatgttggtgtatcatgtgacctttcaaactgacttattagttctaagactttttagtagaattcttggttttttcctgcatagacaatctgtgttgtctgccaaaaggcatagttttatttattctttccaaaatgtatgtcttttatttctttttcttgctttattacactggctatgacttgtagtccacagtcttgaataggagtggtgagagtagacttccttgccttgttcttgatgttaggaggaaagcattcagtcttttatcctctagtataattttcacggtagagtttttgtgtatgggaggctgcatgttttatttatttatatatatatattttgagacagagtctcacttgtcatccaggctggaatgcagtggtgcgatctcagctcactgcagcctccgccttccgggttcaagtgattctcctgcctcagcctcccgagtagctgggattacaggcatgtgctaccacaccggctaattttttttttttgagacgcatctcgctctgttgcccaggctggagtgcaatggcgtgatcttggctcactgcaacctctgcctcccgggttcaagcaattctcttgcctcagcctcctgagtaggtgagactacaggcacccgccaccgtgcccagctaatttttatgtgtttaatagagatggggtttcatcatgttgaccaggatggtctccatctattgacctcgtgatctgcctgcctcggcctcccaaagtgctgggattacaggcgtgagccactgcgcctggccacacccggctgatttttttgtatttttagttgagacggggttttgccatgttggccaggctggtctctaactcctggcctcaggtgatccgcccacctcagcctcccaaagtgctgggattgccggtgtgaaccaccgcgtccagctgcatgttttactttttagttttgttagcttttaaattttgaagtaatatgtagtcatacacatttcaagcaataatttgagtcactttaaaggaaaaaagaaagaacctactaaattttaaatccttaacctgttaggattattaacaaatgtctgatattaaggcagtgggagttgttagatttcagttgttaaatcagtagcttcttgaagatttcttgaataaatacttagttttggcttaatctggagatattttcaacaaacaaaataatcatagggatagggagggcaattagtttgttgtaaaatatatttatgcttaaaatttttgaaaaatggctctcaaggtgtcttgtgttttctagagtctagttttattctactgttcctttgtttttaacttgtaatattgtttagtagaaaactttctaatataccaaaaatttcagtaaatggaacttaaaaaatgtaaaccattcctgatttcatcttgtttgttgacaacttgtctcagatattaagattttatattaaactgcagactttctttaacattaaggattttgattttccttgaaccttgattggaaaatagtttagaatactgctataattggtaaaatttgaggtgagaaaaataactttagcaaacatatactgagtatctagagataacttgcagttttagcttctttactctccctgagattttgggattttaataatctagaaagccacaactccttactgtctttgtcagtttggatttttataacaagatattatagactagatggcttcaacaatagacatttctttcccacagttctgaaggctgcaggctgggaagtccaagaccaagaggccagcagatttaatacctgatgagggcccgcttcctgatttgcatacagctgccttcttgctgtatggtctcatggctgagagagatcattgtctttttcttgtaagcgcagtaatcccatcatgaagttcccaccctcatgacctgattacctctggaaggcctcacatccacatccatcacattggggatgagagtttcaacatgaaattcaatatgaattttaggagaaacacaaacattcagtctgtagtacttttgacataatgctttcgtgaaaacttgttagaaagttgaatgtctaaaatttgtcccattgacttatctatcttatatgggagttctttcactccagagaactaaaaattataaaatgtctaattatggtttgtgcaggtgttgcctcttgggtccagactgcctggctggtgggtgataaccagcccaaatattcttgccaaccagtgccacctgtggctctgcagggaagagcgggagagaagaactcaggtgcaggtggtcatgaaagggaggttgagttggtaaggtaacaattgcctatgtgagctgggtgctttgacctacttttcctgcaagacttgggtgtttttttttttttgtatgtatgaagtccagtttaaatatgtcagtatgttaacatgaaagtatggattttaaatatctgaaaatcaggaatgcatgcattatattgatgaatgtgccacttggtatacctaatcaccacaaggagaaatgttcagaatagtgtagccttccatttctgcatattattcctgtcccacattcagagattcatatctttgaaaaatgaaaagagtggacatgttttccatgtttgattatttgtaccttgacacttagtgtaattactagtattaattttgtcactttttcttcttagctctgctacccttaactagcagctgaacagtgatagtgaagtagccctcagaagacttgattacaatactttgcttataaaagtagcttcttaaattttatgtttaacttcttatcaatactagtttctaaaggggcttattttatctttttttttaacctaggaaatactataagtttgaataatttttgtagttttgttttctagtacaggttagcatccctattctgaaagtttgaaatccaaaatgctccaaaatctaaaactttttgagtgtcaaatgatgctacaggtataaaatttcacacttgacctcatgtgataggttgcagtcatgcacacaattattaaaaatactgtataaaattactttcaggctctgtatataaaggtatatatgaaacaaatgaattttgtgtttagtcttgggtcatgtccccaatatatttcatgtatgtgcaaatattccaaaatccaaaaaaaatacaaaatctgaaacacttcttgtctcatgcattttggaaaaaggatattccacctgtagctactctttgttaatcttaacaaaaaatacagctttttgtatatgtctgagttaacagagtgatttctaatcatcattatggtgataatcagataagagagtgcttttgaatctttttttttttggggcggagtctcgctctgtcaccaggctggagtacagtggtgcgatcttggctctctgcaacctctgcctcccgggttcaaggtattctcctgcctcagtctctcgagcagctgggactacaggcgagccccaccacacccagctaatttttgtatttttagtagagacagggtttcaccatgttggccaggatggtctcattcttgaccttgtgatccgccagcctcggcctcccaaggtgctgggattacaggcgtgagccatcgcatccgggcaagagagtgcttttgacctgacttttaaggaaacatggtaatatttattaagaagtagatagaataagttagcatactggaaaggatttcagggacccagtggcaatgtgacctgttgattattatggaactgacctaggccaagcctcacagtctgatctttgttttcagaataggcaagggggctgactttgggtcttttctttgtttttactttgttttagtactgagctggcagaaaaagcagttcatgggcagtgccaacaccattattcagaccccattctttttagttccaagccccttgtttattttctgcttttccaaagtggttcttcaatttctgtattttagttgacttgtaagacaaagggtttacctaactgtaatgcctataggcattttgtcagagatattttgtcaggaatattacctgaatacttggaattttaatcttgaagagagccaattggcttatgtcctggagagagcactttggagtcatggagttgtgagatctggtcctgcctctgttatttgattgagtctattttctaggtctttggttatctcatcttaccaagcatggttgtagtgattattgaatgaagtagagtatttaatttcttagcacaataagagatagttacttttgctgtgagacattgtttttctaaattcataatttgctgttcatgaacagaggcagatagactacagaaattgtggtagtatttctctagtgcttcagattttagtaggtgttgtactaaataaataatgaggatgataataataaataacataaaaataaaaaattgagtggctagatgtctttgggaaatactatgtatcttccttttggggatttactaggcatattaatgtattaaagggtttgaagaattctgctgtaaacaacattccttcttaaaaagaggtaaattgaattgattattaagcccttcctgtgagatcactgattttaaagaatactggtattccatgtaacatgttttgtgaagcactgctgtagggtaatacttttttttttgtatttttagtagagtgtaaggtaatactttttaagatgagttggtgataaatttctaaaaagcaagaagcatttcaagatatataggtagtactaactgaatcagtggcagttaatgcttgcagtggaaatttctgaactttatttttatttttatttattttttttgagacggagtttcacttggtcacccaggctggagtgcaatggcgtgatcttggctctctgcaacctccgcctctctggttcgaactgttttagtgcctcagcctcctgagtagttgggactacaggcacatgccaccacacccggctcatttttgtatttttggtagaggcggggtttcaccatgttggccaggttagtcttgaacttgtgacctcaggtgatccacctgccttggcctcccaaagtgttgggattataggcgtgagccactgggcccggccaaatttgtgaacttttttttttttttttgaggggttgtttcactcttgttgcccaggctggagtacaatggcgcaatctcagctcactgtaacctccacctcccgggttcaagcgattctcctgcctcagtctccctagtagctgggattataggtggatgccacaaagcctagctaatttttgtatttttagtagagatggggtttcaccatgttggtcaggctgttcttgaattcctgacctcaggtgatcctcctgcctgggcctcccaaagtgctgagattacaggtgtgagccactgcgcctggcctttgtgaactttttttttttttttttttgagatggagtcttgctctattgcccaggctggagtgcagtggcgtgatctcggctcactgcaggctctgcctcctgggttcatgccattctcctgcctcagcctcccgagtaactgggactacaggcacctgccaccacgcctggctaactttgtatttttaatagagacagggtttcaccgtgttagccaggatggtcttgatctcctgaccttgtgatccacccgcctcggcctcccaaagtgctgggattacaggcgtgagccaccgtgcccggccttttttttttttttttttttgagacagagtcttgctccgttgcccaggttggaatgcagtggcgcgatcttggctcactgcaacctctgcctcctgggttcaagtgattctcctgcctcagcctcccgagtagctgggattacagacgtctgctaccgtgcctggctaagttttgtatttttagtagagatgggatttcaccatcttggccaggctggtctcgaactcctgacctcgtgatccaccctcctcggcctcccaaagtgctgggattacaggcttgagccatcgtgtctggccctttgtgaacttttaatgaaaacagtcactgttttaaattccaacttttgtggaatttattggttgaactttgtgacaaactctcttgaaatttatccagagaaaaattactgagttgctagctcagttttatttattgtcagtatggttatattcttccctcagatttctgattgatactcttatttttcattaacttttcagtcacggaagataattacacagaaagaattgttactcatggatttttgcactcaattcacattatcctagccattttgtggttttcgtttccgttttgggggacacatttgtgaagtatttaaatgagatgacacattcgggaatactgaatccctaatagtggggtaccaagtggttgaagttggtaatgtatttgggaagtgattgtatttttataatgcagttgcgtaggaatcagacctagtatattctccattgtactgcagtacctggcagcagagtaggcactaatatgtgttgaatgagtaggtgaaataaacaaaaacctaatggcgatggaattttatggaaataagtaaacttcattattgctgaaaataccgcagataaatagagggaggcagtgtaatagagtggaaagagcagtagaccaggagtcagacagtcgaggatctcattctaaatttgaaggtgaatagccatgtggctttagacaggactctgaaccaccttgttttcttatctgtaaaaggggaagtcataatagctactcctgcctaactcataggttgttgagaaaatgaagtgattcattaatataaaattcttcgcaaatgtaaatgtacagagtcaaattttccctatgcctagcgcagtgccttgaacagtattagcacagatatagactgttaataataaaaaggaggctaaaaaacaagagtttaaaacaattcttggagtgttcacagaataccagggggcagaaggatgaagaataacctacaaaagagaagcaaaagcaccaaagaggaaagagaatcagggaagtataaccctgtgcttttaagacacagttttcactaagctttaggcttgtcaggtaatacctaagtagcttttgatttgattttccaaaccctgtctaaatttcctccttcactgtgaagtatttggtgggtacagagtagttccttttgtaagcctaaaattaaagaccttcacttaggtagtttaagtatacttcaactttgattttctgtatattgcataataatcatgagttactgttgttaccaaaacaccaggggttccgtctaggtcctgctgcttgtcacacagaaagcaatctctgagacaatgagtattgctaaggaagccggctttaatcaggtgttgcagtcaaggagatgtctcagatccatttccctgactgactaaaattaggagtttatatagcagggagaaaatgtgattatctatgggaaaacaggaactacagagggttaaggaagcaattgtgatggatgagaggtctggcatctcattgtttggatgcagtgatctggtgaatttcagtttatttaatattgtaaaaggaaaataaatcttgaggcccccaaataactaagctaaaggtgaaagtcaagttgggaactgcttagggccaacctgcctcccattctcttcaaagtcacccctcggctcactgagataaccattaatacataccagattgcctcatttggagaagcgaatcagaaactcaaaaggatacagccatttgtcttttaactacctgtgacctgaaagccccctccccacgtcgagttgtcccacctttctggactgaaccagtgtacatcttacacgtatttattcatgtcttatgtctccctaaaatgtataaaatcaagctgtgcccctaccaccttgggcacatgttgtcaggatctcctgaggctgtgttaccggtgcggatcctcaaccttagcaaaatgaactttctaaagtaactaagacctgtctcagatattcggggttcacaatattaatactttttgagaggcctgagggccctttcctgaagaaggaactctgataaaacaaatgttaagtttcaagctttaataccagaagggtcagtttccatgtttatccaaaaaaactgtccgtgggaccattgggtcagtttcacttttattatcatgaagacattaagagccttacatcactaaaccatgactggttgactgcttttgggatgccactttgctctgcacagtgaggattcagtgtcatgggaaggatctaggatgaagtgtttcccaatcttttgcttagcactctactgttatctgaggtatggaaatatgtttgggaaatacaccctccttcactctgcactcccctcccaccccaccactgtgtaccactagactatgagctccaggaggaaagggacttgctcaccattgtaatccagcacatagatgtatgtaaaccactaagaggacggctgagaaataataatcaaattggttatttctgataagatggttttaatattgtggctattgttaggggatggctaatgtgtttttgtttatgcagtacacatgtatttgatttccaggactggctcatctgaagaaaaccaaaatgtggtacttctaatatgtacaccaaactaagaaataagttattctgtctcaaaaagatcatttgcttatattaaggaagattatttaaaatacttaagatatctgaatatatttataaattcaggaaatgtattaagctgagaaaaacataaattgtgaaatttaaagtacatttgaatagaccttgctgtgagtgatcatgtgctatttttggggggtggattattagtggattggttatccatgacttttcttctcaatacatttcataaaaatgtaagaacggcggggcgcagtggctcacgcctgtaatcccagcactttgggaggctgagacgggcagatcacgaggtcaagagattgagaccatcctggccaacatggtgaaaccttgtctctactaaaaatacaaaaattcgctgggcatggtagcacatgcctgtagtcccaggtactcgggaggctgaggcaggagaatcacttgaacacaggaggtggaggttgcagtgagccaagatcgcgccactgcactccagcttgggtgacagagcaagactctgtctcaaaaaaaaaaaaaaaaaaaaaaaaaagaaacacttataagaagcaaaattagtcatactatgtgaaatactatacttttggaaaggtgtgtgaggggacaggctggtatttgaaagtaatagctaaaatcaaagatttgaataatgtatagttgttagttacctgttatagtctcttatactgaatctgtgttgtctaatttggtagccattaaccacatgtagctattttgatttaaatttaaattaaggcttacagtggttctcacttataatcctagcactgtgggaggctgaggcgggaggattgcttgatcccaggaatttgagagcagcctgggcaacatagggagacccccatctctaccaaaaaaaaaaaaaagtgtatatatgtgtgtgtgtgtgtgtgtgtgtgtgtgtgtgtgtgtgtgtatgccgactgtggtgtgcctatagttccagctacacaagaggctgaggtgggaggatcagttgagtccaggagtttgaggctgcagtgagctatgatcatgccatggcactctagcctaggtgacagagtgagaccctgtctctttaatacaaaaatttttttgaattaatttaaatgaaataaaattaatgtagtttctcaaagtagccatatttcagtggctcagtagccacacacatgtggctagtggtggctgtgttgaacactgcaaatagagaacctttttttccgttatcacagaaagttctattgcatagcactgtagtataaattaatgacaattactacaagatttcaccaagtttatatattctgaaagttggagaatagagtgcaagatatttgttctctggaattcttaggtgggaccttttacaatggttaacctgtctggtaggggacaggaaacttttaaattatagagttcttgctgtgtccttatttgttgttcacaacagccaggccaggcagttagtattatctccgttttatcgatgagatcaaacctgtaagaggaactgtaatttgaaccaaggtttgtctgactttacatcctctattttttgttcttattttggactttaggggtgttgctgaatggattataatccctagttcatggtgtattgtcattagatatcaaagacccttttcttcctcacactcctaggcaaccattttaatgtgtgtttgatttatctttttttaaaattttttttaaagtgaaagcaagtttattaagaaagtaagggaataaagaatggctactccataggcagaacagcctgatttatctttttgtttatttttgcaaaatacaccattgtagcttcaaaaccgttaatttgacacttacatggatggtaccgtattatgtaatctaatgtgagattttcctaatttaggatgctgtttgatgatttaaacacctagccttttcaaaagttttgtgaaaaaaatctttttacctggtgttagactttttggcctttgtcatcagggaagtctgaaggaatctctccttttcctctttgcttagggagtattgatagaaggattatttgtccctgaatgtttgtaaataatttatattacttttgttttcttcatcataggtagccagtgattacttctcatacttctcacatgttgtgtccgagcattgtagctgcttttttttaattgaaagttttattgtgctaattgtagattcatatacagttgtaagaaataatgtagggagatcccttgtacactttgcctaagtgcagctgctttttatgcttctaatttgtatataggcttgctgggaaggggagatgtgaacaaacttgttagaattatgttaattaagtaagagtaaaggccagatgctttttcttaagaatgtagtgaatatatgaactttagcatgtggacttacttttagctgtttttttgcttaatttttagtattgttaaaataacatttttagccaaattaaatttaacagagtttaattgagcaaagaatgattcacaaattggtcagcctcctcagccagtgtaggtccagagagactccagcgcaaccatgtggtggaagatttatggacagaaaaaggaaagtgatgtacagaaaaggaaactgaaacagctgtattggttccaactaagcatttgccttatttgaacactgtttgaacagttggctctctttggccaaaacttggtgattggcgccagagtaggttacagtctttacacatctatttacatatctatttctctttcattatgtacagagaaacttttaggccaaacttaaaatatgtagcctaagggaggtaactttaggttaaacttgatttaacagtatgaatttcagatagtgaagttattatatagctgagttttggataaatgatatagtgtttatttttttaagcaaattgaatttttcatacaaatactattggaagttaattatacaaatatgaaatcttaaattttgataatgattagagatttctatgtatgttttgttttaggttgtttcacgaagaaatccagaggatgtccaggaggtaacatttatatgaagattttattttatgtatttgataaaaatttaactaaatgcttttttgaggaaattgcctgaatcatttgtacatcaacctcttttttttgagacggagtttcgctcctgttgctcaggctggagtgcagtggcgcaatctcggctcactgcaacctctgcctcctgggttcaagtgattctcctgcctctgcctcccgagtagctggaattacaggcatctgccaccacactcagctatttttgtatttttagtagagatggggttttaccacgttggccaggctggtctcgaattcctgacctcaggtgatccacctgcctcagcctcccaaagtgctgggattacagacgtgagccactgtgcctggcctgtacatcagtctttatatgtttgcgtgaagattgtcttcatttcacaaaacagtagctgaagtgtcctatttgagacctactaagtaattgttaagttttagtaggtgttaagttatataaataagaatttaatgaattatggtgctgtttactaagtgatcattgttctggtaactagtgtttacaagatttcagtatcacttaagggcccctatttacccatttcaagatcataatgcctgtgtaataaaaagtatttggtaactaatatttattttaaagattctaacagtaaattatgggtctctgcctactttcacttttagattgaattgacatgttgacatcttggaaaactgctttaggcatagatatttctttttttttaaactttaagttagtaagttcttttgcagattcttctgtgcattttttcattttttttccttctttctataatggtaccagcctgttatgttttgcttaaaattgtggaattctctatttgtatttactttgtgcttgttgtgtatctttaggaatccttactgaggagcttgctgctttgaatgtttcttgatttattttcattttagtccctgctcaatttcactaagactagaaggacatatatcaggattttttccgcctccctaatgtgtttaaaacagatactttaagtttacagtcctgattctgcaacagtattgttttttttttttccacaattaaatatgaatgtctttgggtggtaggttgtttctgtttagccacgggtcccactactctacagaaaatacctggcttgattcatacatttaaggtgactgtttggtactggttgatatgagtgtatggccccaggtttagataatatttaaattttatacattatcatttctggctatgtctgatttcatagttgtttttgtcctatgatttaaaacagatatatttttatacaaaaattagctgggcatggtggcaggcacctgtaatcccatctacttgggaggctgaggtaggagaactgcttgaacctgggaggcagaggttgcagtgagctgagattgcaccactgcactccagcctgagcaacagagtgagactctgtctcaaaaaaaaaaaaaaatagatttaatactattttcctgatgggttttaagacaattcattccctaccaggaaacagaaagaatattgtaatattgttattttgaaagaaaaaaatgtatacatacatatatatgtatcagtgaaagtaatttgcaccattgattaaagtacttttctgtctttacttgtatcaattgatgagtgtgaactattctttagatttctagtttacaactcttaaaattgaaaatgggtgtatttcctttgaatgcattgtctgattgctgtgctgtagtttgtagcttgatgttcccattttccagggagaatcctgaaccaacctatccatgaacatactctctgccattttcttagtccttttttcgggaaaactcttttataataacaactgttggtgaaccattcatctgaaaactcttgtaagtgtcttttagttagacaattgcatggttctttgttagaagtggtataaatttttaaaagttttctatttagttggcttcttaaaatatagaataatcttgaaattataacagtactttttttagtttcccacttagtgtatttaaacattagaattctcatttgggagaggaattcaccacttagagtttgtttttcacttcctttcactttccctctccattaacttattcatttgttactgctttagactatatagtaaagcttcacaagggctattgaggactagatgtactgatagtttaacaaaatgtagggctagtaatacgctagccttataaaataggagaaattttgttgtttttcttttatatataccttggcacatgccaccacatcagtgttttcttcctaagaatgctaaaagatctgtggcctgtcattcagtagattgtgtagaacatgaatagacagcagaaaagtgaagaagagatggttttgctccccctcacccttttttaaacaaattaacctgtacctgtttctctctacaggtaggatatttcactggtgaaatttgggaaaggaaaagaactgaaacaggactttctatgtattatgtcagaaatctctaacttttaaatccttttttaaaaaatagttttattatttatttattatttatattatttatttatttcttgagatggagtctcgctctgtcacccagactggagtgcagtggcatgatcttggctcactgcaacctcggcctcccgggctcaagtgattctcctgcctcagcctcctgaatagctgggactacaggtgcccaccaccacacctggctgatttttgtatttttagtagagacggggttttaccatgttggccaggcaggtctcaaactcctgacctcaggcgatctgctcatctcggcctcccaaaatgctgtgattacaagcgtgagaaaaaatcattttagaaaataggtacacactcagaaatatatcgggaaaggaaaggctcttgaaaagagggaaaataaaatccataagcaaatagtgtggtagtgatgttggttgtaagaagagataatccagcaaattttaaatattaaaactatgtgagcgtgaaaaggacaaagttaattcaattggtggttctgtaaaatacaggaatctaaaaagtttttggtgttattaagtgtaattatctgaaaaggaaacatttatgtagaaaatatttaagggaatgtttttaaaattaagcttttatttgtatgttttatatggttgtcactgaattaatatttcattgagacattttcttcagagtgactttaataaataagaaacttatggagacttggttcaataaagaaagaggttgttatagacctattttttcaatgggaaagtattgaacattaattagagaaaataatttctaaatgtgtctctgaggactttgtgtagtccagatatgaacatcagtacttgctgttgtagtggaagtatatctttgttcacttttgtattttgaagatttctggaaacctcagaacttagaaggagtaagaagaaaaggaggcagtggatgtgacattttgcgatgctgttaggtattttggttctgcagccctagagttgagaagaaggaatataggattgaataaattagggcatggtgaagaaacacagattctcacctggggggttctaattcttgctctgacagactatctactggttcatataccatggtattttaataattattatgattaaattgttaaattttgctccttaagtttgtcttgcagtatttaaaaatgacttaactagaataaattttttttttttttttttttttttttttttacggagtctcgctctgtcacccaggctggagtgcagtggcatgatctcagctcactgcaaactccgcctcccgggttcatgccgttctcctgcctcagcctccctagtgctgggacttcaggcacccaccaccacgtccagctaattttttgtattttttgtagagatggggtttcattgtgttagccaggatggtctcaatctcctgacctcatgatccgcccgccttggcctcccaaagtgctgggattacaggcgtgagccaccacgcccggcctagaataaaaattttatctgcaaatctaattgtttccatgagctacagtcttttgaataactcatgtccaggtcataatgaccttaaccttacgtaatgtccagtttataatgacatttaccttatataaggtactgcttacataagcccatcaaccatttctcctttaattccttggcaatgtcgtatgattgtaatttgatatatttttaaaatataaaaataacaattttttgttcccatcatttcattgttagaatcctcacatctcactgcgtatgctgagaaacctttcctgagtgattactgcctatctgctactgatcttttaatctacaagctaatagatcctgctcagtttttgctcttcaaccctaaacctatctcactgaacagctccaagcagctccctcacgagctcctaagtcaaatgtgttgaaaattgaacctctttcttgcctcagaactgctgctgcttccttagtgttcacttcagggcatggcaccaccattctgtagcaaaacttgctacacagctatttattcttcagtgttcttcagtttatttatcattttaggcaaatactgagtatgtacttttgtttaaaaattgcctaaattaattgtcttcatttagtaatacatacttagcatctcactcttcttttagaaacttcacccccggtgccctccccttttattttatttttgtcagtctactgaccacttcccttcaggactctctaaggtagtactttttgtgaagccttctcagacatacaaggctgatttaggtactacatctacagcactcttggactgcccctctcagcatttttcaagccgtcttatgatgatgttgtcttgtgatgtgttggcttattcttcctaactagactgtgaactctttgaaggcaggacctgtatttcccttctcttcatactttgtaagaatatgatgcttagtggaaagtagggccatagaaatatttgtttggtgactctttttgttgttgagtaaatgaacagggaacatcaggaggaacaagggaagcatcaggaggaagcagtttttaaaaattaattcatattatagtctgcctagcctcctaggattataactgtattaaaaacaataaacattaattaaggtagaatttttggcagcatgaaaaagtttgctgaagagttttatacatacagagggtaggttttttggcaggaatctcttaaatcacacctggttacctgcttgacctgttatttgctcattagcattatactctattgtatatgaaaaacttgttagaaaactttgttagaactgagatgattaagtttttcagaagaccccagtatctgaagtaatgggatttaaaactcaattttactctattttctagagattgaggggctgaatctgtgatatcaaggccatgtttcaaatcctttttctttacaaagtggtttttttttttagatataatctgagtaaggttaaataataattcagactaatgaaggaaaacacacttttttacatgtcgtctaatctagatgatattttgttttttaaaaatatactaattttaatgatgttctggtcaggattcagcttgcctgcagacatcttattactagtgtgaattaagatttatgacatgaaagtccatgttaattgcttgctgcatagctacttcttcagtgttactcagtttatccttttttttttttttgagacaagagtcttactctgttgctgaggctggagtgcagtggcactgtgtcggctcactgcaacctctgtctcctgggtttaagcagttctcctgcctcagccccccgagtagctgggattacaggcgtccaccaccacaccctgctagtttttatattttcagtagagatggggtttcaccatgttggccaggctggtcttgaactcctgagctcaggtgatccacctgccttggcctcccagagtgctgggattataggcgtgaaccactgcgcccggccagtttatccttttaggcaaataccgagtatgtacttttgtttaaaaattgcctaaattaattattttgtctttataaatacattattttgagaaaggatacatgttttgacatctaactcatttgcaggccaattgtaattggtttttgaagagatgaagtgacattttatatagtataaatcttctccatactgggttgaatatttttccagtatgaataaaaccatacttgtttaaaatgaaaatttgaaaccaaaacagaatagtttgaggaagaattgccgctttatatgtaatatatttttactttattttattttatattattttcctggtcagcaggaatctgccttatatttttaaagcaaatattattagttaatttcagtcagttaatcatattgtttaggacatgtgtttgcctttgcatgacaattttgaacactttaatgaaaggattatttgttgttcagatatctgaacctaaatggttatgagatacatgtttaatttttttctctctagataattgtatggaagagatacagtgattttaagaaactacacaaagaactatggcaaattcacaaaaacttattccgacattcagagttgtttcctccatttgctaaaggaatagtgtttggtaagtgattattttgaaattgtaatttaaaaaaataattaattttgtatatatactgaactctaacataactacactatgaagtcagaagcccttttacttattgagataattcatattgttcaacagcacttgaaattgtcttttcttgttcttgttatagttttgtgtacccagaatatatttactcttcctatctatgaaacaaaacaacttcagttccaaccaaccaaataaaaaaccctgtaggaacataagaaaaggtgatattcagttattcttatagttttaaaattctttctttttttaaattaagtctcattttgtatgtttccctgacactttgcttatagtatgaatggtgtggttttctagtatttgcttcttgcaacttctttttgataccttagtattcttttttttttttttttgcctcatcagttttcaaatacctaggtaacagtattttatattaaagtttctgtgtcaaaataattggtgtagtttctgtcccctgtctggattttgactggaagtatagaatattcatgttttttttctataactctaacgtaaatgttcttatatggacagaatttttttgaaatggagtctcattctgtcacctaggctggagtatagtggcacgatcttggcttactgcagcctccacctcctgggttcaagtgattctcccgcctcagcctcctgagtagttgggattacaggcgtctgccaccacacctggctaatttttgtatttttagtagagatgaggtttcaccatgttggccaggctggtctcaaactactgacctcaagtggtccgcccgccttgacctcccaaagtgctgggattacaggcatgagccactgtgcccgggccagaacattttatcctattactttttgcaaccaatttctgcatatgtaattgcagagtcaaggtatatgcacatttatttttcaaactagacaattttttttcaggttatgaaagtagtatatgcaaataactcaggtggtacagaaaaatacttaaaacgtaaagagaaattcagcaataataccatctcctagatagtataatattttggcatattattctagactctgtatcagtgtgtgtgtatggtgtatttttgtgcttattaatatgtatatgcctttttacccatctatgtatagaaacctcaaaaatggaatcttgctatgtatgattttgtaacctggttttatataacagtatatatattttttctttattttttatatgacagtatattatgattgtcttttcatgtcaataaaaagatctacattactaattttaatatgtacatagtattccagtttttgaactgatttattaaccaatcttttactggtatattacttttggccttttgctgttacaaataacactgcagttactattcttgttcatacattactgtgcaggtgtacagtagggtgaattcctgggagaagaattactcagtcaaggggtctgcatatttttgagacttttgatgcatattgtctcattgttttaaataattgtaacatcattttcctttatacattggaataacttttaaattattattattattttttgagacagagtatcactctgtcacctaggctggagtacagtggtgtgatcttgctcactgtagccttgacttcctgggctcaggtgattctccttccttggcttcccaggtagctgggaccataggtgcacaccaccatgcctggctaatttttctattttttgtagaaatggggtttcaccacatttcccaggctggtcttgaactcctgggcttaagtgatctgcctacctcagcctcccaaagtcctgggattacagttgtgatccaccgcgcctggcagataacttttaaagaggcatgtggctaagtaaaataaaaacaaaacacaaaggtagtattgaagaatgcacgataaaaacaagtttcctgctccttccctccacctacttttgcttctagacataactgaattttaatccttttttttcaagtacttatatctgtatctgtaataagcttataccattttttctttttttctttttttttttttttgagatgaaatttcactcttgtcacccagactggagtgcagtggcgtgatctcggctcactgcaacctctgcctcctgggttcaagtgattctcctgcctcagcctccagagtagctggaattacagacacctgccaccacgcctagctaattttttgtatttttagtagagacagagtttcgccatgttggacaggctggtcttgaactcctgacctcaggtgatctggcctccttggcctcccaaagtgctgggattacaggcgtgagccactgcgcctggcccattttttcttgatttaacaacttttacgtatctattgactcactactctggtgggtaaggatttagcttgtttaccctgtttctctgtattattacataatatttttagttcttctgttgactttatttctcgttctgtaagtgtggacaatatcatttgtctaagatgattctaatagcatttttgatcttcctcctacctcttcagctctcttcaccacttaacatttgaaatctgtgcttatagtttaacatttgtcaaaggtggtaatatttatattctctttaatagtcataattaagctcgtaatgtatagaataattctcaaagctagaatgtaataaacatcatttataaaattattattttttgagacagagtctcactctgtcaccctgggtggagtgcagtggtgcagtcccacagcctccatctcctgggctcaagcgatcctcccacctcagccccccgagtagctgggactataggcacatgccaccatgccagtctaatttttgtaatttttgtagcaacatgttttcaccattttgcccaggctggtctttaacacctgtgctcaggcaatcctcctgcctcagccttcctaagtgctgggattataagcgtgagccaccgcaccctgccttattaacgttattatgacagagcaaatattgttcattataacaccaggtggtataccacaattacattttgttctgcaaggttcaattgttacaattactgtgccaacataagaaaaatgtgtaagtgaagtctctgttttccttatactacatcagggaattgaaatcatgccacattttagtttgctaaatatttggaccatgccttttgtgatagccagcctccaagatagcctcctatgattcttttctcctggtattcacacctttgtgtcttcccttctgtcttagtctgtgtagtgttgctacaaaggaatacccggggctgggtaacttataaagaaaagaggtttatttggctcatggttttacaggagataaaagatgcatggggcctccatctgcatctaggaaggacctcagattgcttccactcatggcagaaggggaatgagaggccaccacatgacgagagaaggaaacgagagagaggaggaggtgccaggctttttccaacaggtttagttcacgggaactaagagtgagaaccagcaagccactcatgagacatccattcccgtgatccaaacacctcacaccaggcctcaccttgaacgttggggatcaaatttcaacatgagacttgatggggtcagacacaccatatccaaaccatagcaccttcccagattgtactagggttggtctgtgtgaccaataacaaaagtgatggtatatctcattcctgagatttatttataaaagactgtggcatctctcttaaggttttttttttttttttcctttctctttctcataacttgccctgagggataccagcttttcctatggttaagaacattctggtagcctatgaagaggcccacatggtgaggaacaggggcatccagccaaaaactagtaagcatgaagcctgccacagccatgtgaatgaacttaggagcagattctccagtcccagttgaactttgagatgactacagcgttgaatgacagttaacagcaatttcatgaggggcctgagctagagccacccagccaagccacttttgaattcctgaccctcagagactgagtgagatagtaaatgtttcttgtaagctaccatgttttgggataatttgttacccagcaataactacttaatagactttgtaacaaaactgaaaatgtggagtggttttgaaatgagctatgggctttgaggagtgttggtgagtgcctgaagtgccttgaagaagtgattaattgggcccggcacggtggctcatgcctgtaatcccagcactttgggaggcgtagtcgggcagatcacgaggtcaggaaatcgaaaccatcctggctaacacattgaaaccccgtctctactaaaaatacaaaaaagaaaaaaaaaattagccaggcgtggtggcaggtgcctgtagtcccaactactcaggcggctgaggcaggagaatggcatgaacctgggaggcagagtttgcagtgagctgagatcgtgtcactgcactctagcctgggcgacagagcgagactccatcccaaaaaaataaataataaaaaaaagtagtgattagttggagcctcatggtattcggtaagactgcaagtgaggtttcccaaagaagttaggtaagtgttactggaaactggagggaagatccctcttatgtagttgcagaaagtttagcaacactgttgcctacagttatgtggaaagttgaaaatgtactttgcaaatgaactgggtaagctagctgaagagatttccacccagagtgtttacagtatggtgcttcttgctgctcatagtaaaatgtgaaaggagagagagaaactaaaggaaggattgttaaacaaaaaggtcctaggacttgttttgaaaatgctatctttctggatagcagagagtactaaaattaagaaatgacttctgagcaaatatggcctaaagatgaagcccagtgtgaaataaaatgttttttaagaccttagaaagattcagtcagaccaaatgctctcaataaagattaaggttgtgccttacacatcctctcaaatagtagggcttcgtggaagtgtaagcctctgccaactcagcagaagccaaagctacagaagggtttaacttgagatttgtggctatcacttttgtttaattgagtaaaccccaataagagtcacaggtgacccccccacaaaaaagttataagtaattatatatgcagaaacattgttagcttggactgacaagcagaaaagcagtacaaagtgaaaagagacttttgtctcccccaaattttactggaaggaaggctaaaaacaaccacgaagccacacaccttgctgtttttcaccgaaaaggaggtatgactcagagggtggaaccagtagctcagagggcagagccatagccttggagaatttattcccagcctgtgagccttaatcagaaacttccaacatttgccctgctggatttcagaattactatggacccattgacttctttggggctcgcatttactcccctttttgtacaggaatgtctatagcagttattccatgcctatcccactattgtgtattgagtgggtagaggggaggtaacttgtctatagtttcacaggttaggaagattgtacttaaggagctacacttagggaacgacacctgaagaacctcagtcacacgtggatgtgacttagatgagattctagactttgaattgctgccataatgggatgagacttttggggaccttgggaggagggtgaggagatcttgtatgtgggaggggtgtgaatctttgaggccaaagagaggtctgtgttggccagcttccaagatggcccccagtggtccctgtctcctggtgtttatgttcttgtgaagtcccttcccacactgaaccaggattagtctgtatgactgttagcatatgcagaagggatggtatatcacttccaggattaggttataaaaaagactgtagcttccatcttgtgtgctcatgctcccacctcccctccatgtgtcgttacatgttttggggaaactggttgctttatggtgagaacactcaggcagcctgtggagatgagggatgtttcaaacttacagaaagttgcaagaagaagaatagtacaagaacacctctatactttccaaccagattcacttattgttaagcttttatcccatttactttatcatttgctggtgtctctctcactctttctccttccctctctccctttccctctcttcctctgtctcctctctctctccctcttcccctttctcccccagcacacacatataaaatatatgcacgtaattttacattattttaagttttaatttcttaacttttctttctttcttttctaacttttttgagacagggtctcactttgttgtccaggctggagtgcagtgtcacagtcatggctcactgaagcctcgacttcccagactgaagtgatcctcccactttagcctccctaagtgctgggattacaggtgtgagccaccacacctggccataattttttaatgagctattccaaattatattccaaatttcatgtccctttactcctaagcacttcagttcttcactaagaatagggatattgtattacatcaatggagttcagttatcaatttgagtaaatttaatattgatacaatactttgatataatctaccatctgtattccacttttgttagttgaccttttaatatcatttttcttctctctgggataggatccattctaggattggtattttatttagtcactggaatgttaatatagccgttttttgttttcattatattggcatttttgaagaataccttctgcctctctatccatatccctttccccctttttaaagagaacgattctcattttaggttctctgatgttttctcatgtttagttctaggttatgaattcttcctggctggatactgcataggtgtcctcagagtatctcatctgaaggcacatgatgtctgtctgccccttattagtgatatgaatttgtgtcacctggtcaaggtattgtcaagcttttccactgtgttagtttcctggggctgccataacagattaccatacacttggtggcgtaaaacaatggaaatttattttctcacagttatgaaggccaaagtctgaaattggtatcactgggctgaaatcaaggtgttggcagggatgctctcttttcagaggagagacactgttccttgcctctttcagcttttcgtagctgcctatgttccttggcttgtggcagcattactttagtcttcagggtcctcaacttcaaacctccctctgttccatcttcatatttccctctttgtgaaattgccctcgactctcttataaggacacttgtgaagcatttagtgcccatccagataatccaggataatatccccatctcaagatccttcatcatatctgcaaagactctctaaataaggtaacatttacaggttccagggattagctttagggaaccagttttcagactactacacaatgtatattcatttttttttctttcttgaagctaataagtaacctttgggtagatatttgtaagatcatgaaaacaaaattatcccctggatttagcatccattgatgattcttgcctgactcaatgtttatataatagttacaaaataatgattttccaattcctgtacctctccacctttgctgttacccttccttctccctttatctgtgtctctttgtttatgcatctacgtttctctgtgtatctatagagctgtgtatctgtgtctgtatatctatatattgtatccatgaatctgtccatctatccctaattgatctggactcacatatcttttttttctagtagtttagaatgcattaatacatttaattattttgattcacaaattgtcccagctttgatcagtaggagcccttttaagctggattctgtgtccttgtaacttcctctcatcctattttcttttttttttaatttcagcacttgttatttttaggcataacaagatgttcagtgctcatcttgaatttattctgctcctgccctgaaatctaccatttcttcaaggaaccctagttgctttttgtggataatggtgttaaagactatgctgcttctcagtttattgtattttagctccacatccatccttcattgctttgtcagatctccttttccagctggtatggatgagcttagtcagtagaaggtgttggaaggacactgtaggaagtagggttttggtgtgcttccgttcctatttgctctgtgctgccagtggcatgtgtgggatgcctagtggtactcatcccctaggaaattttgttgtcagttactgcctgcggctccttgcctttcagcctggatctgctggcaccacaacagagcttcctgcttgccagtctcagcctgtagttccttgcccatgaagtttgaccctcctactatcatattagaacagctatgtcagggacaaccagtgggttacagccacattgcctccaatgagatctgaattccagccttggcaaggaggcacctctttcaggtatttcctttggttttcctcctcaatctaggcattcctaagagttgtcttttatttcttcttagtagttaattctgggtaaatagttaataattctttataagactccctatttaaattgctgtatggatttcattttctgtccagaccctggctgctacagagatcactatctggacagtaggtatgcttcttgcaacttacatctaagcttttttcaacagccagagataggaaatgtaatacatttatctatatgcataggtataatgcacacatttatacatacctctaatcatttgcaaacctgcatatatatatgtatatgtgcacgtgtattatatagatatacatatattttagaattgtttataatacctttagtgaaacaaaattttatatgttcaattatatatttagttctctttgtactctcctcccacctcctggttttgggtttctggtcttgactagaaatgtctcctaatgcctacctgttttacaagatgattattatagtactagttaaaaaaaaagtttaaaaaataattcttgaggaatttatatttgaacaggatgtcagatgatgtttcactttacctttttttttacagatgaaatggacttataagatcacttgttagataacccacctttttctcaatgaagttgaattattatctttgttatgtatagacttcatgtgagttttcactaattaaggattttctcttttgtggcatttatttgtctattcttatataaatacctatgtctatatcacattgatttttatgcagcggctttacagagtatgttctgatagctaataccagctatatttcttatcaacattggggaaattattgcctttcaagatcagcctggagttcctggggctcttacagtgataattattggttctaagaggctgtgccagttatccctttattgcttcttagcttcaaatctctttcttcatttcctccttggttaatgggtaggattctttcagtattttttctttatggtgaatacactgttaagcttagcaacggagggcactccatttcaggagtatagggggcttgtcttccttcttccagtatcctatggattttgttttttcttgctctttttgcattgttgccagagccattctgccttggccacacaatctcttgataagcttgcaggctcagccagtttggtgatcacctagctaaggacaccaaggtgccgcagtcctattggagactgagtttctaactctctggctccttctgtgtacccggaatttgtctgtgtatctgcccctcagctttggcctgctagcaccctgcagagttgtttcctgtgtcccttgttccccctccctgccaacacattttggactctagacctggttgccctcctggagagtacgctcctaataaccccctctccttctacaggcctgtctgctagccttggtctgctttaaccccagaaagttgtttcctatggtcttcccactgcagatggtaggtaccccaggacttgcattaccttgctggtgagttggttcctcataccatgactgtgtgctcacctgtcagccttggcatgcttgaattctggaggagtctttcctgttcttctggcaactgtggttcaacgatggcccagggaacctagcaaactttttttccatccaatggctgcaacccaaccacaccttctctacagagatccgaatcccagccttggagaagagttcccctttctaagttgttccttctttgggtattctccctcaccctaggatattcttcagagttctctttttacctttattgttactccactctcatggctaataattttttttttttgagatggagtcttgctctgttgcccaggctggagtgcagtggtgtgatcatggctcactgcagcctctacctccgggttcaagcgattctccggcttcagcctcttgaatagctgggattacaggctaccatgcccaactaatttttgtatttttaatagagatggggtttcgccatgttgctcaggctggtctcgaactcctgagcacaaagtgatctgtccgcctcagcctcccaaagtgctgtgctggtattacaggcatgagccactgcgcctggcctcatggctaattttttttatattaaacttttccctgttcaaattactgtgtggcttctgtctcttgattgaaccctatattgatactctgatttaggaagagttctgaatgatctgaagtaattctgaatgacctgtttccattggctggtagtctacatggaacaggggtttctccaggctgattataggattacagtattcactgaacttgacacttgcttcctcagtacgttttacatttcacgcctacttgagatttggggacaagatacagagaatctcacatagtatagcaacatcagtggcatttgtgccagaatgaagtgatcatcaaaagcttattgctactattctttaattttaacaaatatttaatagtaacaatttatgattttttaatatcttgagatatatgtaatagaggtaacttgggcacataataaaaagaaaaacatttttattttcttatgtgaaagcaattgagggatgtgggcaacaggtcaatagcaatagaaccattagttctgatgatgggtcttcaatccattctgttcccctaccaagcatttgggagttcatgaactcttaccgttgtaggctgttagcatgtgactgcctgcttttggcctttgaccttatattccatggtgcttcacatttctgttgttttctctttacagttactattcaatatcaatggttccttactttttttcttgatacctttcccatttaaagatgtatgtgtgtgccctttcccattgcaactactacctcttttgaccaccattttgctgtttgtttttttttttttaagatggagttttgcccttgtcacccaggctggagtgcagtggtgcaatcttggctcactgcaacctccgcctcccaggttcaagcggttctcctgtctcagcctcccgagtagctgggaatacaggcatgtgccaccacacctggctaatttttgtatttttagcagagacggggtttcaccatgttggccaggctggtctcgaactcctgacctcaggtgatccacctgcctcagcctcccaaagtgctgggattacaggcgtgagccaccgcgcccggccccattttgctgttaaagtgcctggcaagcatgtttacatgccaaaaatctattacctcatgcttttattttgctcaacttatttttcaagtatttatatgtcaggcgcggtcctacgtgctgaagatacattcataagactgaaacagtctctggatcatgtagctattaataatcttctttgactaatttcagtccagctatcaattatctagaaattttatgggcatatttaattcaagaagctttctaaaaattggcactgaggatatcatgatgcaaacagcccctctaagaaacttagagtcttatggttgaagaagtgagcattaggatccagagttgagaaagagaactgtttcaggatgtggtattctcaccatcaagtttttaagacttgtggcactctaaatatgaagatgaagataattttaagaagtcatcagtctgaggagttttaagaatcatgcttctaaacctacagccagtattttttcttgtgttctaaaagtaagaaccctgccttgccctttaattataattttctctctttctctttgattccttgacaagaccctaagctgcatgatccagagactgctttggtgttatgaatgtatcttcagcatgtaggactgtgcctgacatataaataagttgagcaaaataaaagtatgagttaagatttaaaaggtagagtagttataggtgatgatgtcatcaaaagtcaatcccaaagccaaaattaaaatgtttgattatacctagtatggagcaatagatatacaacaggaagagtataaattcatacagtttctttggagggcaatttgaaataaaccttttctattctgtttttaattaatttttctacacatctattctcatgtctacatgggagatatatatgaatgactattagatgttttggtcttagattcttctttatattcttaaaaattattgaagacttcaaaggactgttgtttatgtaggttttagctattaatatttaccatactagaaattttagaaattgtattaaataaaaataaaaaatacactacatgttaacataaaaggatgtttttatgaaaaatgattcttccaaagcaaaaaagaaatagcaagaagagtggtgttggtttatgtttttacaaatctctaatgtctggcttaagaggagatagctggattcttatagctgtttctgtattcagcctgttgagatatgttattttggttgaagtacatgagtaaaattcagggtcacaaagataatgcagttgaaaaagggaggagtgtttttttttttgagacggagtctcgctctgttgtccaggctggagtgtagtggcgtgatctcggcttactgcaagctctgcctcctggattcatgccattctcctgcctcagcctcccgagtagctgggactacaggtgccagccaccacgcccagctaatttttttttgtatttttagtagagacggagtttcaccatgttagccaggatgatctcgatctcctgacctcgtgatctgcctgcctcagcctcccaaagtgctgggattacaggggtgagccaccgcgcccggcctgggaggagtgttttaatacctttttcagataattaaaggtattctttgatacaccaaaacttgatgtgtggtaatttcataaaggctagttgcattgtggaatcagaaccctgtaaatgaaccttttgtactttgttacattacaatccgttggtctgtcttagatttgaatatatcttttacctgggcatgagtttgtaacaccatgtattggtcatttgaaaaatattggtttcctgaattatgcagattttgtaaacacttacccattttattatacagtgttaaaaatcattaatatcatcacagatttctaaggaaaaaattttaaagtattgggaagctgtcaagcttacagtggtttgacagcttgaattttatcactgataacaatactgttggttattttccttgaattgttaggcccagttgtttatgtttgagaaaatgtctgtcaaatatccaaatctgaatagttatagtttgtttcatttcacagaatttaaaaaattattgttctcaagggttgagatttaataaagttaataatttttactgctttatcaaggacattctaaatgaaactggcattacatttctttttttttttttaaatatgagtgagtggcatattatactcgtaatcattatattccgagtaagtatagtttggtgctgttgccttgatttcatgctaagaggtcagcagttttattaccattgcttttagatcatcagtgcaaatgttagtgcagtaaaaaaatgcaactgcttttgtagtagtattattaaaatggtttgaccttgctgattgcctgaaaggccctgcagggatcatctgcagtctgtggatggctcatagagaacacacgtacacacatatatacatatacacagggtgttcattgcagcattatattcagtagaagaaaactgaaaattgaatgtttctctatctgtgattgtatggatgtgccataatttagccaagtaataggattttggggctgtttgaaatacacttgtatgggccgggcccggtggctcatgtctgtaatcccagcactttgggaggccgaggcgggcggatcgcaaggtcaggagatcgagacaatcctggctaacatggtgaaaccccgtctctactaaaaatacgaaaaattaggccgggcatggtggcgggcacctgaagtcccagctactcagggggctgaggcaggggaattgcttgaaccagggaggcggagcttgcagtgagcccagatcgtgccactgcactccagcctgggtgacagagcaagactccatctcaaaaaaaaaaaaaaagaaatacacttgtatggaacaatatccaagatatgtttttaagctaaacaaaacaaacgcgtataatgatgtttagtaagatcctgtgtatgtgtaaataaacatatatgaatcatacctatacacatttgtatagtgtatgtaacctctgagggagtggtaggagggatatttttacttgttgcattgcactttctgtactgtggaatttaacacatttatctttaatgttagaggatacatagctggcttcttaaaaaagaaacttgtcactgggtgaaagagtggcttttaaattggttgaagttcttagctgttattatcagctgctaatggattatcttaaacttttctccacatccttccatattatagaatgaaagtttcatattaatcttaataagtaagcaatttatctcttttaataaatggtaccgttcatttgtaatgtttgataactgtaatgaaccttgtaggcagcagctgtggttgtgtggaaggaattgttggttaataatctactttttttttttttttttaatgaggcggagtctcgctctgtcacccaggctggagtgcagtggcgccatctcggctcactgaaacctccacctcccgggttcaagagattctcctgcctcagcctcctgagtagctaggattataggtgtctgccaccatgcccggctaatttttgtagtttagtagagatggggtttcaccatgttggccaggctggtttcaaactcctgacctcaggtgatcctcccgcctcagcctcccaaagtcctgggattacaagtgtgagccactgcacccagccaatcatctacctttttataggtcctcttacattagtaagtaaacttcagcagcaaaggagtcctcttgtaattttgcatatgatcgagctgatgtagttattgttctaatggtatggtgagaagtacttattttttgcagtcagatagatttagacccgtatcttctgttaactatttactgccagtgtgatcttatacaaattaatatctgagtctagttttcttattggtaaggtaaggataataccttactgttctaacaattatatctgtataatatttagctccatgctagatgcatgtcagctagtgttagctattatctgttactcagtgagtttaccattcctctaacataccttactctcttgtgtcttcttctttagttttgtgttgctccgctgtgaagtttctggttagcctttcagaagatatctcttctaggaagtttgccatgcttcttttcagctgagttaactgtttacccttcctggttattcatctcatcagtatagcacttaactcatgtatttttccccattttttttaaattgacaaaatttcaaatttatgctccccccccccaccaagagaatagtatagtgaacacatatatatacgtttttttccaaattcatggattgttaatattttgccacatcttctgcatttctgtctctatgtatgtgtttctcattttttcctgaaccatttgagaataaaatgcagacatcatgatatttcatccctactccccatgtttctgctatgatcataataccatattgcacctatgaaatttaacattgatgcaatattataaaataggcagtccatcttcagatttctgtagttgtccttgaaatgtcctttttagctttttttttttgattcataatcatgcctctcttggtttctttaatctagaatagttcttattttttttctttttgatttttcataacactgacatttttaaagaacgtagaacagtagttttgccagtttcacaagctatatctgtctgattgttttctcatgaatagatcattgtttgttgtttgttttcttctatctgtcatcagagtatgacttcctgtgagagagagacaggcagctcccaatagctaagaactggccaggcactatattggtttgaccttggtgtttcttagagttggcctggaattcacaattaggctgtggtgttctcgtattgaacaaaaacaattccatagaacattgaacattaagacaagatcactccatgtccttggatgacgacaaaaacaagaccatcctgtagtcatgtctgaacacagacaaaaacataaacattgttcaagtcacaaaaatgatcaaatatcctcattctggttacaatgaatgactactgcttctttataaatcataaccttagccttgctttatttttcctgcttcatagtaagatacattaaaaaatcatagaatcatagaattagaattgagagaatcatagaattacctccacttcctgacagcatccaatccagggcagaaccccacttccttgaacccttccctaacacaagccaaagccctgtaagtcctttctgataccctcttggtgaaatgccccagtgttcccaatggtatgtattctccttagttgtaagaagtaataaattcagcttgtttaactacaggtgtgttcctggtgctgtttggctagagagaatttaatccagagaatcttgacctctctctttctttttactctgtgaatgaacttttgatatagttaagaatcatcagcattaagcttttctagataatttcatactggtcaaggataagttttagttccatgaactagcttttgatgactaacatgcattttaaaaaagttgtaaactctgctatttaggagttcttctaaataataaaaacaacatagggaagataccaaagacagcttataaatcaaacagagaggctttatttttagtgagtaatgagcttagttagaatgtttggatttaattccctcccctccacagcttttaataaccattgttgggtgattgggagtgggagagtgtcttatatatattatacacacacagaaatatataggtatacctcagagatattgcagatttggtttcagaccattgcaataaagtgagtcacacagaatattttggtttcctagtacatataaaagttgtgtttatactgtactgtagtctattgagtgtgcagtagcactatgtcttaaaaaagtacgtaccttaattaagaaatactatattgctaaaaatgctaattttcatctgagccttcagtatgtggtagtctttttgctcatggtgcgtcttgtctccatgttgatggctgccaactgatcagggtggtggttgctgaaagttggggtagttgtggcaatttcttaaaataagacaacgatgagatttgctgtatccattgactcttcctttcacaaaagatttctctgtaacatgtgatggtgtttgatagcattttacctacagtagaacttctttcagaattggagtcagtcctctcagatcctgtgactgctttatcaactaagtgtatgtgacattcagaatcctttgttgtcatttcaacagtgttcacagcatcttcaccaggagtagactccttctcaagaaacgactttctctgctcgtccataagaagcaactctttgttcatttaacttttatcatgagattgcagcaattcagtcacgtcttcaggctcctcttccagttttcattctcttgctatttctaccacatctgcagttacttcctccactgaagtcttgaacccctcaaagtcatccatgagggttacaatcagcttctaaaatcttattaatgttggctgggcatggtggctcatgcctatagtcccaacactttgggagggcagggtgggtggatcacttgaggtcaggagttcgagaccagcctggcaaacatggtgaaaaattagccggacatggtggtatacgcctataattccagctactcgggaggctgaggcaggagaattgcttgaacccgggaggcggaggttgcagtgatttgagattgcgctactgtactccagcctgggtgacagcacgagacactgtatcaaagaaaaaaaaaaaagttgatagttttaccttcccccaaatgttgtcaatggcatctagggtggtgaatcctttccagaaggttttcaacttattttgcttaggtttctgagaggaatcacttgtatgtcatctatagcctatgaaatgtatttcttaaataaataataaataataaaccattgttgggtaattgggggtgaggaagtggcttatatatattatatacacacagaaatatataggtaaataaggaggattgaaagtacaaaattactccttgatcccatggactgtagaattgatgttgtgttagctggcatgaaaacataattaatctccttgtacatctccaccagagcttcgagtgaaccagattcattgtcagtgagcaataatattttgaaagggcagggcacagtggctcatacctgtaattccagcactttgggaggccaaggcgggtggatcacgaggtcaggagttcaagaccagcctggccaacatggtgaaaccccgtctctactagaaatacaaaagttagccaggcatggtagtgtgtacctgtaatcccggctaatcaggaggctgagacaggagaatcacttgaacctggtaggcggaggctgcagtgagctgagatcgcgccactgcactccagcctgggacagagtgagactgtctcaaaaaaaatttttttgaaaggaatctttttttctgtgcaatagatctcaacagtggtcttaaaatattcagtagaccatgctattaacagatgcactgtcatcgaggctttttctgttgatggaacacaggcagagtagatttagcctaattcttaaaggccctaggattttcagaatggtcagtaagcattggcttcaacttaaagtcaccagctgcattagcttctaacagaagagtcagcctgtgcttcgaagtgtggaaaccaagcatgacttctcctgtctaggtatgaaagtgttggatagcattttcttccaaaagaaggctgttttatctccattaaaaatctgttctttagtgtagccatctttatcaatgattttcgctagatcttctgtataacttgaagcagcctctacagatcagcccttgctgcttcaccttgcacttttatgttacggtgatggcttcattccttaaacctcatgtaccaacctctgctagcttccaacttttcttttgcagcttcttcacctctctcagccttcatagaattagagagttagggccttgctctggagtatgctttggtttaagggaatgttggggctggtttactttctccatatcagcaataacgctgcttcactttcttatcattcatgtgttcactggagtaacacttttaatttctttcagtaacttattttttgtattcacgacttggctaactggtgcaagaggcctaactttcaacatttcttggtttgtgttatgccttccttaccgagtcttgctctgtttccaaggctggagtgtagtgatgcgatcatggctcactgcagtcttgaactttgggactcaagcagtcctccctcctcagcctcctgaatatctgggactacaggggactacaggcatactacaggcatgtgccaccatgcccggctaatttttttttttttttttttgtagagacggggtttcaccatgttacttaggctggtctcaaactcctgggctcaactgatcagcccgcctcagcctctgagagtattgggattataggtgtaagccactgcaccctgccttatttccagcttttgatttaaagtgagacacctgtaactcttcctttcacttgaacacttagaggccattgtagaggttaattggtgtactttcaatattgttgtgtctcagggaatacagaggcctgaggaaagggagattgggtacagctggttggtggagcagtcagaacacactcaacacctattaactaagtttgcgttttatattcttgtggtttgtggtgcctcaaaacaatgttattgtattgcaaatgccagtaccaaagattactgatcatagatcactacaacagatataataataatgaaaaagtttgattgtgacatttaccaaaatgtgacacagagacataaagtgagcacatgctgttggaaaaatgttgccacaaatcttcaatttgtaaaaaaatgcagtatctgtgaagagcagtaaattgaaattcaataagatgaggtatataatattgcactgtaaacctcgggaaaaatttgttttgcattttctatgtttctatgtctataatttttctactctgttcacaggaaaataaacattggtactacaaagggaaattcaaagctgtagtaggagaagcacctgattatgatttctcatgttgttacagcctttcaagtgaaattttgattatgttgaaggatacacaagtagagaatggttgcaaggttattgtctgccattaggatgactgttgaatcttgctgctacttttttgaaaattttcaaattaggttgtctttattaaatatattagttctagaagttatttcattaaaattcatctgtgttttttcatttatgctacgagtactatttttttctttgtagtagactttacgcaacattttattgtgaaaattttcaagcatatagacaagttgaaagatgtggacagtgacattttgctatattttccttatcatatatctttccataatctgtcttgtttttatgcatttcagcataaagtgcagataccagtgtctttcacccatacatattttaacatattgtcattaataagagttcagtatttgtttacattttgtttagataagtttacacacagttaaatgcacaaatcttaagtatcccattgtatgtgtgacaaacatatacctgtataacccaaacccctatcaagatatagggcattaccaacacctaaaagtttgcttcttgccccttccctgtcaatccctgcccttaagctacccagaaggaactttttctactatatattagttttgtacatcctggattttaaatggaatcacgctgtacaaacttttcatgtctggcttccctcctgcagcatgtttttgggattcatccatactgttgtgttcatcagaggttcattccttgttattgctgtttagtttaaatgtaccacagtctgtttatccactgttctatcaatgggcacctggaatgtttccagtttggggcaattttaagtaaatctacaataaacatctttatatggacatatgtttctcttgggtaaatacctaggaatataatttctggatcataagataggtgtatgttttattttataaggaactaagagactttccaaaagtgcttgtatatttgatattcccatcaacaatgtatgaaatttctggctgcttcacactcttaccaacattgggcattatcagccttttttaattttagccattctggggcatgtgtaatggtatcttattgtggttttaactttcagttcctgacggctaataggctaaagattttttcacatgcttattagccactcatatatcctttttttttgaagtatctgtttacatcttttgtctattttgtggggctggagttctttgtatatcttagacaccagtcgtttgatgttttgcaaatgttttctcccagtcagttgttcgtctattcatgtgttaatggtctcttaaaaattttattattatcaggaaatgggaaaacattagtttattttagattcagcaggtacatgtgcagatttgttacctggttatattgtgtggtgttgagatctgggcttcaaatgaacttaccacccaaataatgaatatagtacccaatagatagtttcttaacagttatctccttctttccatccccgcttttggagttctcaatgtctgttgtgcccatctctgtgtccatgtgtacccagtgtttagctcccacttaaaagtgagaacatgtggtatttggttttctgttcctgtgttaattcacttaggataatggcctccacctgcatccatgttgctgcaaaggacattatttcattcttttttatggctgtgtagtattccatggtgtatatgtaccacattttctttatccagtccactgttgatgggcacctaggttgattccatgtctttactatcgtgaatagcactacgataaacatgagagtgtaggtgtctttttggtagaatgattcgttttcctttgggtatatacccagtaataggatggctggatcaaatggtaattttagttctttgagaaatctcaaacatgccttccacaggggctgaactaatttacactcccaccaacagtttataagcattccctattctgtgcaacctcgccagcatctgttattttttgactttttagtaacagccattctgactggcatgaggtggtgtctcattatggtttcgatttgcatttttctaatgatcagtgatgttgagcatattttcatgtttgttggctgcttgtatgtcttcttttgagaagagtctgtctgttcatgtcctttgcccacttaatgccattcttctgttgttattctgaagtattttaggaacaaagaaatgagcatgttcctttatcgtatttgttctgataataggattcaatgtaattgaagcttatttaatgcataaccctttatttttggttgtgcactactctgaaaaaaagtctcaattcatatctgcttgtcaaagtttagtggaatagaaacaataaatcaatagcagtacaagaaatgcttttgacatttattccattgcttaagtgttttactttagcttaatggagaagattaaagcctccaatttttttttgtatttgtttcagatagaaataagatctttttagggtactattaaatattaagaagacttccattaagatttctcaacaagtagttaatgcatttaaagatattctcaggtagtctagtgggtcaaagtataaaataatgtgtgcattttctaggttatttttctaagcttttagatgtttacacaattactaatattaatttataggcacttgaatttacttttttctttaagcgataactatattggactataatcataagcactgattcatactttcttatttaggcaaaataaggaataatgagcatttaatctagttggccagtagattttttcctaagattaaatcatttagattgttttcaagccagagaattggttttacctattggggttcttgcagatttgtttctagataatattagtgataggtaagcgagtagtgtcattttagatttggtattgttattgggagggttgagtttaattgttgcatttgaactgagagcatttgaactgagaactaagaaaaacaaatgtggcataatggattatgttgggtttggttatttgtgagaaaactcaagatagaagtccatttcttcctcatggcaaaagatttggaggtagcctcaagcgtggcagctgcccagtgatctggaatccaagctcctgtcttgttgctgtgtcattttttaatgagatgtagtctcgctatgttgcccaggctgagttgaactcctaggctcaagtgatccttctggcctcagcctcctgagaagctgggattataggtttgcgccactgtaccctgtttgtgtcatttttaaccttccacttcttggttcttcttgaaagggggaagggacaaagaagaaagggagagaggttgtatgtcatttgtcttttaaaaagatttctgggaagctacagtataatttgtttatatgctatttgccagaacttagtttatatctatgcctaactgcaaagcaagctggcaattacaattttttttttcctgggctgtcatgtacccatttgaataaaaattgaggaagaaagcaagaacaaatatttggatagcagtggacagcctattccatagtaagtaaagcagtatacagaatgttaggaatcctctaattgactgctacttgcctgctgacctttatttggtcctaggctctatcaagatactgataaaagttatagaccctatccttagaaaaatgcacctgtgtatatatatgcatggaattctgtgggattattgtctctggagcccatccatgaaccattgcctaagaggttgtgtatggatccactgttaagatttcctgttataggctgggtatggtggctcatgcctgcaatacaatcccagcactttgggaggcctagatgggaggatcacttgcatccaggaattcgacattagcctgggcagcgtagtgcgaccctctctctacaaaataattagctggctgtggtggcgtgtgcctgtagtcccagcttcttgggaggctgaagtgggaggattgcttgagcctgggaggttgaggctgcagtgaggttttgatcactctgggtgacagagtgagaccctgtctcaaaaaaaaaaaaaaagattatctgtgataatgtttcattgtaagacatttatttatttattttgacatggcttttaaaagtttttgttattcactcacacagtcaataaaagcttgctagcatgctctgtattttagtcagtatgatagaacttgaagattcaaagaaccatgatattctattaagtgcttactatgtgcctcgcatgaaactgggaaccttaagtacattatccatttcctacattttaaaaatgaggaaataatctgcctaagattttatagctagtgaatgatagaggtagtatttgaattcaggtccttttagttatcgtgaaatagacacttcaccataagcatgagacacactgggcagagggtattttagtggttcagtttcacttgccagtcatataggcacttgccttgcctatataactaggaatctctttgtgcctcagttttctgttaatactctgcaaaggcacttaaaatgtttatgtggtgatgctacttttctgattttgtatttttttattgcaatcagtatgatatatggcatatgataaatgtcaactggtaatctaatctaagtactacaaaatgatcatattttgaaaatgtcttatcagcattcaaattttatgtatcatttaaaaattctatggaaagcaccttttgatcaccttgtaaagcagaactcactggtgccatatgtgtgttcttttttctcacaagcatgctgttatgtatgctgacagcatcacacgttgaatttagcataaaagctttttgcttcaagctgagatttttgaccccactaataatacagatgttctcataatttcctctcttcagcccctttataaatcaaaaagagtagaaaagggaaaattatatgagtaattacagtattagattactatagaaaaccatttcacttctttaaaattctcttttcatctttagtttcgaatcaccagcttcttaaatgtcaactttcttaaattgacaggctctaaattatgaatgtaccatttatttatcggttgacacctttgtctcttgttttatcagaaacattttcttttctactgagagtactgctgattctaattgtagagattagatttgacttcagaagtttgcataataagcaaagcaactaagtgataggcctgctgctgctttctgatctgtggacgtaaactatcataaaccagtgtttgatcattcttcccttaagtgttgattcttatttaattgtagggcgatttgatgaaactgttatcgaagagagaagacaatgtgctgaagacctgctacagttctctgccaatattcctgctctttacaatagtaaacagcttgaagactttttcaaggtttggtagtctttctggaatattttatatcttattaaatacttttgtaatttgtagtaaagtaaaataaaaaatgccacttttgaatttcgttattcactataaaagtagaaattaatagctctataataatgtttatggcatatttcctatttttagtatagaaatttatgctttttttttttttttaaaggaactggttctgctctgttgcttagactgttgttcagtggccattgacaggtgtgatcatggcgtactatagtcttgagttcctgggctcaagcctcctgttgcctcagactcctgagtgtttttgattcatggatcttaaaaaattgatgcaaagagcttagagattgtttaactcactctgtcataattgaaatacattaaaaaaaatgaagcatcataaaactctagtacttaccttcactttttgaagtgtctttcagtggcagattactcttggaatataagccactgtaagtctatattaaatttgttattatgttgacttgtataaagatacaacaaaaatataaaactgcacagttttagagagcaggccagtgcaaattatattactggagatcattggatattagtgttttaagttcctagatatgtaatgctttcattttaagtttttttttttttttttaccatttttaataataattttctaacttattttgaactgtatcggtatatgttgtcagttggtattgttgtatttaattactacattttccctgttgcattgagttaaccttctaaaaaaaaagaaatctaagtgattgtgctgtaattgtttttacttctttaaaatctattcacttgtataagttaaatttcttagcctatataaccagtgatatgtatgaatagtgagatatttaatttttctgattttagtggatctacacagattatttatttatttatttttttctgccagtgcttcatcacctaggaatttattttttatgatgttttatctactgaagaaagttcttttgaaagatattgcaaatttacagtaatagaaataatgatagtaatagaagtgtttatagtaacaataacatttctgatgattgaccgtgttgcttaatttttcaccattctgcaaactaggctgagataataaatgtgatttctgcatatggccctatgcagatctttaggataaaggccaaatcaaattgatagagtatttagctctttgctgttctttgttaataattgtttctatgtgtcagggagtctgttttttatggaaaaaggctttattattaaacaagaatattgctttatagaaattgtgaaaagctgtcatgcaaattaccacctgccatatggctaaaaaaaattagggattatggaagtcctattaaatactttaaacaatttaagtaaaagttagctgttcattgtatttcttctggatatgggaattcctgattgtaattgttgctggaagtcactgggaaatgagactgtcattttcagagtttgtgaaagattggacagtttaagagaagtcaaactaatcttggaaagtatcttagaactatctttaacagcgtgctaggcgggaacaggatactgatttgggaatatcagagcagtggtattcagtcattatctctatttaaatagagataatcaagcaagaaaaaaaaactcattccattagcttgaacaaaaaaaaaggtatttatttttcatatgacaagaagtatgaatgaggaaggtagtccaggactggtatggagctcagtaatgtcatcagtgacataggtttctgggtttaggtgtgaaagggaaaaggccaaaagaaacatggcagtttttaaaagctttcccagaaacatgatctagagatagtccttcttacatctcattggccagaacagggtcacatgcccatccttaatttgaaggagtctcggaaggtgactcttagctttctagttctgatcatggatgaaggctgtggggaaggttttggggtagctaattcacagggtgtgctatagtatcatagtttatttttctctttagagacattgatgatgccacatgcaaatgaccatatagccacttgcttacattgactttaaaaaaccacatacataagagtagaatgaatagtataatgaacttctatgacccatggcctggtttcagaaattatcagtatattgccaaacttgttttatctatacctttccatcccatactcttcactggttgtttatttattagtattagtacagttactaattataattgtacaattcaccgattttcagtaaatttatagagttttgcacctatcaccaacatccaattgtattttattttattcttttttttttctgagacagaatctcactctgttgcccaggctagagtgcagtggcacaatctcggctaaccgcaacctcttgcctcccgggttcaagctattctcctgcctcggcctcctgagtagttgggattacaggtgtgtgccaccacacctggcaaatttttgtatttttagtagagacagggtttcacaatgttggccaggctggttttgaactcctgacctcaagtgatccgcctgcttcagcctcccaaagtgctgggattacaggtgtgagctactgtgcctggccaacatccaattttagatcatttccattaccgcacctctgtgtctacttgctatggtgatccccttttccatccccagcctggggcaaccaccttgttctgtctatagatttgcctttccccataatttcaaatacatggaattacacaatatatgtagcgttttgttcacaacataagtatataggtttctttcacttagcataatgcttttgagcttcattcatgttatgtatcagcattttgttcttttatgttgctgaaatgcatttcattgtatagataataccacattttcttcattcattgataaattgatggacatgtttggatgtttctacgttttggctgttatgactaatgctgctgtgaatatttgcctacaaatctttgtgtggatatatgttttcatttttcttgggtgattcctgaggagaggaattgctggatcttatggtaaattcgtgtttttaagaaactgccaaactgttttccaaacggaaaatagccagtaatgtttgaacttaccagttgttccacaacctcaccaacacttggtattgtctgattttttaactgtagccattctagcaggtgtgcagtggcatttcaccatagtattaatttcagtttcctaatggctaatgatgttgagcatgttttcctctgcttttttcatatatctttggtgaaatgtccattaaaatctacccatttttttgattgggttatcattgagttgtaagagttctgaatatattctgtataaacagtcttatcagataagtgatttgtaaatattttctccccagtctgtagccttttagttttcttagtggtgtcatttgaagctcaaaagcttttagctttgatatgatgtataatttatatatattttttcttttttgggttatgcctgtcatacccaggaacttttcgagtatcccaagatcatgaagattttcttctgtttacttttagaagttttaatgttacaggtctgtgattcatttttagttcattttatatacggtgtgaaggaacggtctaaattcatcttctggtgtgtgtatatctaatattctgagcatcatttgttgaaaagactatcctcattgaatcaccttgggactcttgctgaaagtaaattgactgtaattataatggcttatttctggactgttgatagttctattaatctacgtgcctgtcttatcctagaaccatactgtcttgattactgtagctttttaagtattgaagtcagctagtgtaagtttgcctactttactttttcaaaattgttatggcaattttgagttctttgaacttccataaaaatttttagtggcagcttatccatgtgaacaaaaaattctcatagaattttaaaattattttattattttacttcttttttttttttttttaaagaattggggtctcacttttttcaccgaggctgggatgcaatggcacaataatagctcactttaacctcaaactcttgggctcaagggatcctcccacctcagcctcccaagtaactgggacaggaaccaccacacccagcttatttttaaatttttttgtagagacaggttctcactgtgttgcccaggctggtcttgaactcctagccttaagtaattctcttgcctcagcctcccaaagtgctgggaatacaggtgtgagtcaccacacctggctgaaggtattggaaacacctgctaaaatccttcagtttgatgctctcccaactgagttattttggcttgctcctcagaattctgattagaattgtattgaatctgtagttcagtttggggaaaattgtcattttaacaatattatcttgcaatccatgaaaatgaaatgactctatatttatttggatattctgtaatttctttttgagacggggtctcgctctgttgcccaggctggagtgcagtggtgccatcttggctcactgcaagctccacctcccgggttcatgccattctcctgcttcagcctcctggttagctgggatgacaggcgcccgccagcacgcctggctaatttttttgtatttttagtagagacggggtttcaccatgttagccaggatggtctcaatctcctgacctcatgatccacctgcctcggcctcccaaagtgctgggattacaggcatgagcaaccgtgcccggcccgatattctgtaatttctttaagcaatgtttcataattttcagggtataagtctggagcttcttgccttaaatttatttgtaagcattttaatcttatgatgctgttttgaattaaactgtttttttttccatgtagtattatgctttaatggttcattcatgttgtagcatgcatcagtactttatccatttttgtgattatgtaatattcttttgtgtggctatggatatactacattttgtttatctacagtgtgtgttggtgcatatttgggttgttccccttttggctattatgaatggtgctgttatgaatattgacatacaagttcttgtgcagacaggtatttttgtttctcgtaggtatacctaggagtggaatttaggtgggaagtttttttttttttattggagatttagagggtgtgtatgtatgtacatatatttatgtttttaaggttcatccaggttgtagcatgtatcagtagttcattccttattatggctaaataatagttcattgaatggatatgaatataccacattttgcttatccattcattagttgatagacattcagattgtttttgcttatggctgttatgaaaaatgcttcatttgatccttttttataattttgatttatttatatttgctattttatgagtcatagtccttttaattctttaatcatgttttcccttgataatatgaacatatttttaatagctgctttgaagtttttgccaagtccaacatctttgttccctcacagatagtttcgattgactggttacctcccatgtttgggtcacatactttcctgtgtctttgtatgtcctgtaatttttttttgttggaaaatctatattttggataatatacgatagaactctaagttctgatgttttttttcttcctgaggattcttgccattttatgttagtgtgtttagtaactaatactttttgttagtgtgtttagtccatagtaaatctgtggagtccatttcctgtgaagtgtgtgactgctgatatctctgcccaatatttaattctaattttatttttaagccaggctatataggggttagacctgtgtcagcatagctttgtggtcagccagtgctcggtcattgcttgtgcttaaacacctgtgccattatatgctttccttttaatgctgatgattttttaatgtgttttcaaagtctcagctgttttaaaatttgccctggcttttactttcctctgaagtcttgaatttcctctgtgcctgtgcactgtctcatggtttgccaggtattcgtggatagcttgacccctctctggtctctacacagatgggtagtgagctttatgaagaccccctgtggctgtgttattttctggatctccctgctgtctggtcttttcctgactgcaacttcaggtgtgctgagccatcacttttccttgccatatatttggccctgagattgctactattattgacaatatttggggtggatttttttttttttctgtgcttcaatccaaatcacattagcctcctcaaaagtgaacctgctggttttcaagacttgccttgcccttatataattactgtgaccactcagctgggatgggggttgggaggaactgaggcaagaacatcacagacgtccatagttcttacctgtggttctgtggtttctcggtaaccactctttcatttgctttatgcttttagtcaatttccagagccctcaatggtggttttgacagatttctccagatttataattgccttttggggaaagcatttgctggatctcctcacttaactataccagaagtccttccctgctagactcttcattaacagaaaaactttgagatactatatatcccaaaatttctatgaaatttttttactgcatactcagaaacacctaaaaggttatttttgaattagaagtttaaaattaggattgtggcattattttactgctacatccctctagttcctgtataacagtttttgttgtgtttcattaaatatttgttctttcctatttattttttataacagtgtttgttaaactaggtaaataaaatatttaggattatgagctaaaacattttgcattttaaattttatcttacaagaagatcttatgtcaactaataataaacatttattgagtgcctacattgttctaaatactctgtgtgtattttttattttgcatgaaatatgtaaaataaaataatgtcttagttagaagacattttataggtcggtaacttaaatcgcacacctagtggtagaagaggtagttaatagttgaaagatactttgttttaacattaactttatcttttgacattctctagaatacttggaaatcttgatttggtttggatattgtttaaaagatggcttagtctagaatagatattctttttggagaaaagttcaaatataagctgtaatctgaatattgtaataaagtgtagaataaagtaatacaaattgtcgctcctaaagagaataatcatttttaaggttttagttcacataacactaagggaagtaaaatgtggtaatttgagagggaccatttcaaatttctgttccttaaaaacaagctgacagagaagggacttctgattaggtaaagatagtaattgagttttttttgtgctgaagtagagaggaaatgggggcttgtaattcttttgagctttattattctgttagtagtgtttggaggcatagaactgttggtagaaggtagaggggaaggtattaaggagcagaagagctattgttttaattatttaaggattataagctcttctattgtgattggagcatacataaagctatagcacagcatcataccaccactacttgtctggtgatatcattctctagctgcatgtagagtaagattaactttctgaggcgtgaatttgcaaacctaaatagggaattaaaatgatagccacatagagaaatcaattttatatttattttttatatctttaaaaaatatctctactaaaagtaccttaattttttttgttttacctatattgtatacaagtggttctcaaactttttttttatttttatttatttatttattattattatactttaagttttagggtacatgtgcacaatgtgcagggtagttacatatgtatacatgtgccatgctggtgtgctgcacccattaactcgtcatctagcattaggtatatctcccaatgctatccctcccctctccccccaccccacaacagtccccagagtgtgatgttccccttcctgtgtccatgtgttctcattgttcaattcccacctgtgagtgagaatatgcggtgtttggttttttgttcttgctatagtttactgagaatgatgatttccagtttcatccgtgtccctacaaaggacatgaactcatccttttttatggctgcatagtattccatggtgtatatgtgccacattttcttaacagtctatcattgttggacatttgggttggttccaagtctttgctattgtgaataatgccgcaataaacatatgtgtgcatgtgtctttgtagcagcatgatttatagtcctttgggtatatacccagtaatgggaaggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttttcatgtgttttttggctgcataaatgtcttcttttgagaagtgtctgttcttgtccttcgcccactttttgatggggttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgacattgcttttggtgttttagacatgaagtccttgcccatgcctatgtcctgaatggtaatgcctaggttttcttctagggttttgatggttttaggtctaacgtttaagtctttaatccatcttgaattgatttctgtatgaggtgtaaggaagggatccagtttcagctttctacatatggctagccagttttcccagcaccatttattaaatagggaatcctttccccgttgcttgtttttctcaggtttgtcaaagatcagatagttgtagatatgcggcgttatttctgagggctctgttctgttccattgatctatatctctattttggtaccagtaccatgctgttttggttactgtagccttgtagtatagtttgaagtcaggtagggtgatgcctccagctttgttcttttggcttaggattgacttggcgatgtgggctcttttttggttccatatgaactttaaagtagttttttccaattctgtgaagaaagtcattggtagcttggtggggatggcattgaatctgtaaattaccttgggcagtatggccattttcacgatatggattcttcctacccatgagcatggaatattcttccatttgtttgtatcctcttttatttccttgagcagtggcttgtagttctccttgaagaggtccttcacatcccttgtaagttggattcctaggtattttattctctttgaagcaattgtgaatgggagttcactcatgatttggctctctgtctgttgttggtgtataagaatgcttgtgatttttgcacattgattttgtatcctgagactttgctgaagttgcttatcagcttaaggagattttgggctgagacagtggggttttctagatatacaatcatgtcatctgcaaacagggacaatttgacttcctcttttcctcattgaataccctttatttccttcttctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagcttttattattttgaaatacgtcccatcaatacctaattgagagtttttagcacgaagggttgttgaattttgtcaaaggccttttctgcatctattgagataatcatgtggtttttgtgtttggttctgtttatatgctggattacatttattgatttgcatatattgaaccagccttgcatctcagggatgaagcccacttgatcatggtggataagctttttgatgtgctgctggatttggtttgccagtattttattgaggatttttgcatcaatgttcatcaaggatattggtctaaaattctctttttttgttgtgtctctgcccagctttggtatcaggatgatgctggcatcataaaatgagttagggaggattccctctttttctattgattggaatagtttcagaaggaatagtaccagctcatctttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtctgtagtattctctgatggtagtttgtatttctgtgggatcggtggtgatatcccctttatcattttttattgcgtctatttgattcttctctctttttttctttattagtcttgctagctgtctatcagttttgttgatcctttcaaaaaaccagctcctggattcattaattttttgaagggttttttgtatctctatttccttcagttctgctctgattttagttatttcttgccttctactagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttcttgttggtttcaaaggcatctttatttctgccttcattttgttatgtacgcagtagtcattcaggagcaggttgttcagtttccatgtagttgagtggttttgagtgagtttcttaatcctgagttctagtttgattgcactgtggtctgagagatattttgttataatttctgttcttttacatttgctgaggagagctttacttccaagtatgtggtcaattttgtaataggtgtggtgtggtgctgaaaaaaatgtatattctgttgatttggggtggagagttctgtagatatctattaggtccgcttggtgcagagctgagttcaattcctgggtatccttgttgactttctgtctcgttgatctgtctaatgttgacagtggggtgttaaagtctcccattattaatgtgtggtagtctaagtctctttgtaggtcactcaggacttactttatgaatctgggtgctcctgtattgggtgcatatatatttaggatagttagctcttcttgttgaattgatccctttaccattatgtaatggccttctttgtctcttttggtctttgttggtttaaagtctgttttatcagagactaggattgcaacccctgcctttttttgttttccatttgcttggtagatcttcctccatccttttattttgagctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagtcgatgcagtttcttcctagtctcgatggtctttacattttggcatgattttgcagtggctggtaccagttgttcctttccatgtttagcgcttccttcaggagctcttttagggcaggcctggtagtgacaaaatctctcagcatttgcttgtctgtaaagtattttatttctccttcacttatgaagcttagtttggctggatatgaaattctgggttgaaaattcttttctttaagaatgtcgaatattggcccccactctcttctggcttgtagagtttctgcagagagatctgctgttagtctgatgggcttccttttgagggtaacctgacctttctctctggctgctcttaacattttttgaattttaaaataatagtctatttctagggcagtttaggtttatagaaaaattgtgcagaaagtacagagttttctcatatatctcttcttcctccccagcccccagtttctgccattaaatatcttgggttggtgtagtacgtttgttacagtcgatgagatatacctattgtttttttttgaaaacacttgtcatctagtttaatagattagtatagtcgtttctgtacatctttacacatacttaattgggataactattttttatttagtgttgtttatgctcttaatgctaatgaaacacaattgctcttatctctttagggtggaataattaatgatagttctgaattaattggtcctgctgaagctcactcagattccctcattgatacctttcctgagtgtagtacggaaggtaagagattttaatttttttgcatttcaaaggtttggattacagaagactataaatcatatctgcattgcaaaaagacagatgtatataggaatttgagggtatttcactgattctaagatgctttttttctttacattttattatcactgatgttgggtgcatgatattgggtcaggcatatctcatatttaattggcagcttttttttttcatagtggtatataaaataatgattcatcctccaattaatggtatcttagaattgatgaaatatggtataatgagtagttcagaatttgtattgtctagtgtaagaaggccttacttggccaggcatggtggctcatgcctgtaatccctgcactttgggaggctgaggtgggtgaatcacctgaggtcaggagtttgagaccagccgagccaacgtggtgaaaccctgtctctactaaaacagaaaaattagctgggtgtggtggcaggcatttgtaatcctagctactagggaggctgaggcacaagaatcgcttgaacctgggaggtggagtttgcagtgagctgagactgtgccactgcactctagcctggacaacaaagcaagactttgtctcaaaaaaaaaaaaaaaaaagccttactcatttctttagcgcatctgacttttagagaactaatttcaagactggctttagagatttagtcatttagccacaaagaataaaccctaaggcagttttaatgtttttgatatgtttttaaataaaatgagtctaaatcaagttttaatcactttcattcaagaatgcttaatctcttgttttattcttctattaaggtacacttgaatttatacatttcagcctttggatttctgtaactagttttttttcagggaaggttacggaaaaaaaaagatttgggggcaggggtaggagggatttttaaaatcaaaatagataattagatttgttttaggtggcttaggtttggtttattaaaggtaaaataataaactaaataatattgcttatctctttcatgagtaagagtttatggtggaggaggatgctttatgaggatgaggtagccatcatctcattgtagtgttgtttttgtgagggtatgtactcctgtcatacagcagcagccacactaacataaatctcttgcagtaaatttccatcgtgatttggtaagagcaacgtgttcttatttattatgtgggctggtgcacttaagttttttttttcttttggtactaccgtattgagaagtggttagcttttattctttttcattgtactttccattgacttagcatctatttatttaaacttagtgttctgtgtaatgcatgggggccacatgcccaggggtcttcactgagttctcagtatctttgactccaccctgattctgccagggtcatagaaaaacattgttgacagtaattttactttataatctattattttttttgtgtgtgtgtcgggggcggtggtggtaaaatatctgttctttgtgacctattttaatcagagatccttgcgaaggtttggaaaatctagtccctgcttgggatcccaatgtgattctaatagaaccagtttcctcggaaggtgacttttctgtataacctaagctggctgttgcctcagtttccctactcctgagaaagaggagtgcacattttccacctgattccatactgattctgtgagaacaagtaggagagttagaaatatttgtaggagaggctgggcatggtggctcacgcttgtaatcctagcacttttgggaggccaaggcaggcggatcacttgaggtcaggaatttgagaccagcctggccaatatggtgaaaccctgtctctactaaaaacacaaaaattagccagacaaggtggctggtgcctgtaatcccagctacttgggaggctgaggcatgagaattgcctgaaccatgggggtggaggttgcagtgagccaagatcacgccactgcactccagcctgggcatatatatatatatatatatatatatatatatatatatatatatatatatatatatatatatatatatatatatgagagtattcaatgaggagtgcaatagtcagaaatgcagaatgtttcttttctctatttttttgatacaagaatcaaaggttctgtgatatgggagtagttatattcttctgatatctataataagcttctgttactaggtgggagtcaaccatggtgaaagaacggtatcttaggagcctattttagtataaggcaatcatggatgcaagctctgcagagatctttctgttctttgctgtagtctaggccagaaagggagaagcatgattattaggaatgaggtttcttgggatggtattctaaaatactgatgctgttcaaggtgaacagatggctgtattaatgctaaaggagacacaacctaaagctagggtgagcatgtagtttattctccaaactgggacacttctgagaattatagacagtgctattaataattataccaagaccacaaacatgacacaggacagcctcaggcaaactgagctgtaagggtgacccttcctaaagcagttgtttcagagtttacctctgaagtttcaaaaagatgtgttttctttggaaggatttatcttttaggaatgtgcttttatgagagaaattggggctaacatttctgtcaaaaacacggaaaatgacttatgacatctaaaaggaatattgacattttatcctgtcagtgcggtttagtttttcaactatgttaccatctctgaaacacactgtgatccatgaagaatgaaaaccatggaactggaaatgctgttaatggttatgttgtttttctcccctccctttaaaagttgcatgcctggcaaattaatcctgctgaaagatattaggttgataaatacagatagatcaaagtgtcagacagcttgcaaattcattgttatttgagagggaaaatggcttttaaatatcgtaagattgtttggcatagtgggaaagtggaagatttacttcataccaaaaggtctgcaaactctggagacaaccagggagaggaacatctagtagcaaaagagcaggaaagccagcagccagccaagccccacaggtacgcagtgaaatggagggttgttagagggatcgtggtgacaaatgcttgtgttttggatttagagctaaaatgtgaggaagtgattcaccccatgaaaacttctctaaatgtactattttaagccatgttttaaaggtggattgtcatttttcatatttgtgaattagctagctggtggagtgaggcagagggggtaaatcttaatatatagtctgctgtttcaatgttctttagttacagttagagtgacatggcaagttgatcacttctcagagaacagaggtagaggtgaagtgatcattatttttgttaatatcttaaaatgcagtcaacagatcctaatatactttgaaatgaaagttttctgaggaaaacatgacgatctgggtgtctgtttatttgttttgtgatagggtctcaccgtgttacccaggcttagtgcagccttcatgtcctgggctcaagtgattctccttcctcagcctcctgagtagctgggactacaggcaggcacaaccatgcctggctaatttttctttttaaattttttgtagaaatggggtctcactgtgctgcccaggcagctctcgaactcttagacgcaagtgattctcctggccttggcctcccaaagtgctcgcattatgggtgtgagccactgtgcttggcctgttttttaaaattacagttactttgtagtagcatgggatagagaaacccctttaaggttttgtaaaaaataatttggtgataaactggtaaatatagtttgtttaatatgaaattgaaaattaagaaattatttggtaggtttttaaacaaaatattgttttacattttaaaaatgaaatcctggttactctttatctcctttgttcaaagaagttaaactatattttttcaaagatgaaagaagatgtaattggttgctaacatcttatttctattatgtctatttcaacttatgtcttttccttgaattaaatttagccgtgaagttactaggacatttgtagaaacctgcccaaatcggtgcatatcagttgagctccttgacatatttctctcacctgttggcctttttgaagggtgtagattgctttggtgccatgctggccttgatatcagagacttggatgttggtatagtctcatctggtaacctgtgtcatttcctcttcctaatacatcacttttcagtttggggagggacattttttctggttcatgcagcaaatgagagaaaataattaggtaattgtaaccacaaagaaaaattgaatgatcagcttattgtatgtagcatatcttaagaatgaatatgcttaaatgtcttctgggaataacaaaatctacccccacctttttttggctggaaattgtgaattaagaactcctcaagtgcttattgtaactattgtagagacacgaaaggatctattaaactgtcttgaattaactattttaaagtaaatgaaatgtgcattttgaggatagcatctattgctcgtctttgtaacggatcccttaaatgacattaaggtcaagatttgtatgtttatttgatggcaggtgggggtagattttgttattccaggagacatttaagaatattaattcttaagatctgctacatgcaataagctgatcactcaatttgtctttgtggttacagccacctaataattctttacggtgtgtagacagacatgaagattgtgattaaactgtgttaaattgaatggcgttgattatatttaaagcactggttggtctaattggaaaggtgtatagttatttaagtttgaaaaaaatctgtatcgaaataccatttattttgtcttattatttgtgttattttcatttaatagatttaaacttgacactttgaggcaagatcattttaaataggaatatttgtcacatgattggttacttaataacctaaatctattttcaagacaaacttaaagtctatttactacataatatagtgtgagatgacaaaatacagaaagtattaaatattaatttaaatgtaaatttatagaaagtgcaagtaatttaaagtaaaattaagtgcaaatgtccactaggtggcaccataagaactctaaatcttgttactggtatttttctaggccctttggtgttatgtatgttagaatatctcttgcatactcagcttgaagagattcttttttctgttatgtgcttatttacccaacttatttttattccctgcccccagttgaattttccttggtagtggagcttgacaaaaacaacaggtcattttttccccccaagatagccacaaatgagaatgtaccagtgtgtgtaaatgatacacatgacactgatgataaatattgactcttacaaattctagggctattgaggataatattggatattaggagtttaggggttgggtgggacaaataacagaaaattcatggtatgccatgggaatcattataaatgatacacttaaatgtcttatttcacaattacagagtttgaatttcagagaagtttagccatgtgccgaagatactccaggtatttgatagcactcacagaactatattttgaaatgaagagatttcattttatggaggggaggcggggagaagacatatttggtatagaaaactcagcatgagctacttgcatactggtaatgggcttgatgtcctggaggctagagaaagttatggagagtagcagagtataaagttcatttggcaaaaaatgaagccaagtgatggatctttattatgataagatagcagtattagggttgtaattaagattgctgtgttgttttctgggcttattttgttgttttaccaaatctgtacgaggtattctgaggctctttttgtacattttcaaggatgaagcataatagacatgacccaagaacgttataaaaatgtgaaacttcaaaggaaaggttcttttttgtaacaatagctattactaaatgatgaatagggaatcacatacaggaatcttaactagcattaagctttggatttaggtattcacttaaaatcatatttataagggcttctttcttaatggaaactggtatgtatgtcttctaccttagggtaacctttgttctactggctagataacttgctttgtgcatggcgcatgagtcattgctactaggaaaaatagaaattcctttttgttgactatggcaatatttgaacctcagggctcagtgaaagctatcagctaataataatgaggccatgtattttatatatagtcacccatgagagaccacctgttgttctaaaggaaaccgatctctttttacagatggtcttcaaatacagatttctgatagtttatagtataaagatttattctatggcaactcaacctgttcccctggggcctgtctttcagagatggtgtcctagacagatttcactatactgccctactctgagcagttcaaagcacagaggtaagggtaggtaggtgaactgggatgctaaataaacgcctatgtctgtagctgctttttaacaagtcacctggggccctctaatagccctgagacttgaatttctgtgatacgaacctggaggcagaacgctttcatagaacctttgactttttccccttgtatcacttccaaaaaaagcttaggtttttgccttgatggtgttggtgaaggatgcaccttttactcttgcgatggcccagagggcctctttaagtatggggttgacttcaggttggtttaacttttgacaaatagtctctgtattatgtcaaatgtcagtgattgccctgccttatccacaatgtccttcctacctagactgagaacctgtcacttgcttgttgctccctatatctttcttgttaactttctttctgggcttcagggagctagtttgcgtttcgtatgatatttatatatagttttgtatgaaataagttgaattgtagtgtgatttctaggagttgaacaagcactgtattaagcagatgtgttaagtatataatataaataaactaggcattgaatatttacatataatatgtttataaataagattcattgctgtggtggtgaaaggagtttttaaatgttatcttcctcgagctggccggagaatacgtcattgagaagaagggaatttagaaactgcttaaatatggaagagaaagatatcagtgagtactagaagatgattggttgcattgtgtggtcgaggagatatggtagggttaggcttttcaggcatggtaagatgcaacttcaagaggataattaaaggaataaggtgggcaaggaagaggtgtcaggggtttgcctgctttaaacagatctgcctttgtacttgtgtctaactccttttttaagtttggaattcttgacgctagctgctggttgatccatagaggtttatatttcacaaatgatgcctgtataactttcttttactcagataaattcccaatattggcccttgatgcatctcttttgatatctttcagatactgaacttaagggcttaccatacacaaagtatattattaaattctatattatagaattacctataatcttaccatacacagaaaatcactgttaatagtgtatgtttctagccttttttctgtgtgtgtttgtttttaaagtagaattaagtatacatactcatttgtagtttgttgtttttgcataatataagacactttagcattaaatattctataaaatgattttaatagctgtataatattttatcataaggagatatcataatctattattaggaatttgttattgccacatttttactaatttttgtgatggacagatggacattcttgtatgtagatcttttttgtacacctctgataggttttggtataaattgctgaatttctgggtgaaagaagcaattttgcgcttttgatatgcattggcaaattgtcctctaaaaaggttaaagtagatgtctttttatttctctttgcttcttctggtttggctatataaatttctcttttttatctgcttgtgtgtgtgtgtgtgtgtgtgtgtgtgtgtgtgtttgcttgcttttaaagatgccgaattaagaaattatttagaatttgaaaaggaatgctttgtatagaatgtttatttacttaatcttactatctttctctctaggtattttaatggtcttacttttttgatctaatctcatttaatcatgattctcattgctaataaaatatgatttgaaaggtaagaggaaatatgactatggtaccagttttttgtggtcaaaagccaagaaacagagtatacataactttgcccgcttgccctttggtgttattgttattgttaaaaggaaaaatggggcaaaacatgaaacagaacaatgtgatagatggtgtgaaggttatagtgacaagataccagagaacagacaaaagagatctctaatacagcatttcctttcttttgtgattagctatataaaccagaacttttttcaaccttatctatttgtttatcagtttcaatgggctagattatatattggcatcatttaaggaaataagtttacattgaaatacataaaatatttaaaatgacaagaaaaatctcataaaatttatatatatttcttaggatagtagataaataactgtagattgctataaaagattcttattatgaagtactgttactgtccgtatggctgaaatgtcagaggactgaaaagattttcactaggctcaatgaatctcatttgagattgtcggtttaatgaaatctgttgctttttgggaatagaatttgttcttttggggcattctaagaagttgaaaaaaagttgaaaatgaggatatatattgacagggtgccaaagcagcatctaaagctgattagaaatttgagcttagtggccagtaacatgtttttaccctaacttactttatttgatatgaagtaggcaatttgaatttaaaataggggttggcaaaactatgttctatgggctgaatctggcctgccacctgtttttgtatggcctgaaaactaagaatggtttttgcatttttaaatagttaaaaaaattaaaagaatatgattttgtggttttgtgatgggaaaattataaggaattcacacttcaatgtctgtaaataaagttttactggaacacagccatgcttattcatttatatattgtctatggctgcttttgcactacaatggcagtgttgagtggtgacagagaccacatatggcctgcaaagcctaaaatatttactttctggccctttatagaaaaagcttgctgatccctgatctagaattgtatagtctaatccacttttaattttgatttagtatataatcctgaggatatcattttctttttaatttttttttcctgagaaacttggcagataatgttcagtggtgaatgcagatctcagttatttccaaactagtttttatataactctgttgtcagtcttatttaatggtatagatcactggctctcaaatgtaatcttcagatctctgggtgtttctgagatattttcagggagttcataaagcaaaactgttttgataataatgccaggacattctttgtcttttcaccatattgacatttgccctgatgatgcaaaagccatggtaggtgaaactgctgtgcttgggcatgaatcaaggcagtgtcaccaaaccgtaacagtactcattgcacatacttataaaaccaatgctaatttttcctaagtagtagaaactgttacattttgttaaatcttaacccttgtcacttgtctttttaatatgctgtgtgaaaaaatgagaattatacataaagcactctgcatactgaactaccatggtcgtcttgaggaaaagcacttatgcagttgtttgagccattagctgaactagctgcttttttcatgggacaccattttgcttgaaagaacaattaacaaactgtcattattcagacttgtgtatttggcactttttttcttgaaagggagtgaagtaagctgacacttcaaggaaaacaactgatattatttgttgccaatcataaaattggagttttcaattcaaaattaggattttcagataacctctgtctgccactttgggtttgacagtttcccaatacttagttttctgatgagattggtagataatgaaatgttgacatatgattttttgggataatgaaatgtgctgtcaacatttcgaagatctttataactaagggaaccagtattttcaggatgaccaatgtgtgatgttataaattcatgcacagataaaagatccattcagtgtgcaagacagaccaatggatttgaatgtaacagaaacagaaatttcattcataggattttatattccacattacaactaagctttaaaaacctatcacttgttgagttttggtgtagtatcaaagaacaatattcataattatttgaaaaggctaatacttgtttctttttcagttacattatctatgtgacatttccttcatatctttcatccaaaacaacatatgacaacagattgtgagcagaatcagatatgagattctagctatctgctgttaatccagacattaacaaaaatgtaaaacaatgtaaaacagtgcaaaaatgtaaaacaatgccacttctttcactaactttttttgttttggaaaatatagttatttttcataaaaattatgttaacatgtaatggggctttaatgctttattttatacatttctagacttcttttgtaaatatcaatattggtatttaataaatattcacagatacaattcacatgaacaaaagctttttagagtccacaatcattttgaagaatataaaaggctgtcctgggagcagaaagtctgatatgtattgtggatcgtgctcatttaccatgatgtcagttatatgaactaggagaaggaattttcactgctaaataattcagtagcacctattacctcttttttgtctgaaaactaaggtggaaatatacctttccagaagcttgtagaagaggctgagatgaaaatgtctaaaaattcagtttttaaaaaatgctaaatagcatacattttccagttacggatggttacctaaaagcacacttctgaggacgcattgtgtagttgttatatagttacaggttgagtatccctaatctgaaaatctgaaatctgaaacacttctgtcccgagcatttcagatgaaggatattcaacctgtttatgtaattgttataaaagttataatataatgatagtctattatgctttatatgcattaactctattcctcatttaaagacttgcataataagtaatactattaagtaacctgctgttggtcacacagtaagttttaagagctggcgctgggcttggtggctcatgccatctaagctactcgggaggctgaagtgggaggattgcttgagcccacgagttggagtgcagctgggcaacatggcaagatgctgttctcaaaaacaaaaacaaaacaaaaaaaagagagctgagattcaagtgctttttcctttattaaaatgctattatttatagcaactatgtgtacaggcaacagctttctgtaaatagcttacaggatcttgtggtaaaggctctttttggcaaccaaactagataaagatttgtcttcaattttagtttgatgattaaggcaagaagttgtcttccagagttacagagagacagtaaaatgaatggactaagcctaaacaaattgctagacactgacttccatcagtaaattacagccttccaaattgacttggataatatgaaaaatgaataattagcatgatttgtattcgtttggctgattctcaatttaatatctgtttactattgtgatcatatttctaggcttctccagtgacagtgatctggtatctcttactgttgatgtggattctcttgctgagttagatgatggaatggcttccaatcaaaattctcccattagaacttttggtctcaatctttcttcggattcttcagcactaggggctgttgcttctgacagtgaacagagcaaaacagaagaagaacgggaaagtcgtagcctctttcctggcagtttaaagccgaagcttggcaagagagattatttggagaaagcaggagaattaataaagctggctttaaaaaaggaagaagaagacgactatgaagctgcttctgatttttataggaagggagttgatttactcctagaaggtgttcaaggtatggttttatgtatattatgttttggcatgctcttttgttggtatgtgggaaaaaaaagtacatacatatatcttctgtatagtcttatggaaataatactgaaaatgagaaattactgaagcttaaaagacctatatatggatatatactttaagttccttgagatgttagacattatcggaggtacttaaccctctacttttaatcaattaatccacaaaaacaggatttaaaaaaaagtcagcatgtcttgaagtctcttgtatgaataataatctttcttttctgatttgaaaaggcagtgttttaccggccttcatctctctcaggagtaattcacagagattcttgatgacctgaagagacaaaatgaaatggatttttaaactaagagcataaaagattcttgggtttgccgactattctgttctttgtagttgtagtaaattctcatttaattaatggaggtgatgtgggacatgtagagctgactgtaactgaatgtctgtatatagaacttacttttttgaagtatcagctattgttttaacccttaaatttttccttataaaagcagaatgaagcattctgcatttagttgcatgactttttggatgcagtaatcaaagattgatattgacattcttccagtggtttcatttacagaagatcatcattttcattgttctgtggtcttgggtttgtcggtaccattcagattaccagtctcctgtattactaacactttttactacagtacttctcactatgcctagtatcctgtagtccagaagccttttgttatttctggagtataaactttcagttttataaaatggtgtacctgtctgtatatggagggtcctaactgcttcttaaccaggattttgaccatttctcttgtttttaggtttcactcccatttcctaatgccaccaattcctgaatttttggagagttttaccatgccatgtaaatcaggcaactttcttgattcccttttagtaacttctcatccatctacctttttttttttaaattatattccatggcagcttttatattctaaaattttgttgctgttaccttctcagtttctttattcttgtggggttttgtcttaaagaaatttttgactgccatgttaatagagtttctggagggagaatagctaaagaaatgtgttcagtttgccatcttcaactgggaattcagatttcacaattgatacttaatttcggtgggcctgaggatcaaacagcgattaatgttttgtgtgtatagcaataagaggagatggagtcttgtttcttttttcattagttattgtcttactaaagttgcttatataaccatttggaacctgttaacacagtttcaaataattgattctaaattcatttctcattaattttgtcatcttgatatgattaatattagctatcacttttaaggtttctaattgatacctaattttgaagttacttgttttcttgctttgatggaaagatcattttcaccctaattttatttttcaaatggttttataatgttaggttttttttttttgagatagagtttcattctgtcacccaggctggagggcagtggtatgatctcagctcgctgcaacctttgcctccggggttcaagtgattctcctgcctcagcctccctagtagctgggactataggtgtgtgccaccatgccgaactaatttttgtatttttagcagaaacggggtttcaccatgtttgccaggctggtctcgaactactgacctcaggtgatctgtctgccttggcctcccacagtgctgggattacaggcgtgagccactgcaccaggccatctgttgggttttttgtttgctagtggagcattctggtcttaaatatctattcatttttattctttgccttaactctcattttgggttgggagtttaaaatgggtatgagttataaaaaaatctgctctgacattttttccatttgttttcagagaattatgtgctaaaacatcactggtgtttaattgacacaaataaaacacatcagtgtggtcagtgtgacattttttaagttatttgcatttaatcttagaacatttcataatgttaccacttgatggcaccagaaaaataaaaatctgtgcttcaaaatgagaattatagatgcatgtcagaaaataacaaataatgtgtcatttggttagttactttgctgattatggtggtgaattatttctccactagaacttgataccaaacctactagactgctatcttaaggaacattaccatttaaccatgtatctcctatttaatgcatgtttgtctttttgaaagcacaatatccattcctgctctggattggtttctgttattaatatgccacaattccagaagttaataactgactaaattgattttagtcttttattgtttattcataatgtgatcaatttttattcagacaaactatgggaaccacaatcatagaattctaatttttaaccagtatataaaagaacctttgtttcagtcctcctggttacacatttgaccctgtgtcaaatgtaagatcaggacagtgcttccagtccatggattctgtactagcatactagtcaccacctaacagacatatggacattgtccttcaatttctggggaaactgggggctctagttatgagcttgatttgacctttattttcagaagagatgtttccttgggtaaagtttgttctggggtaacaaaactgttagtgaaatatctctatagccagtaaaacgtatgaatcatttaaattgaactcttcataacatttgttcttgtgacctttattggcatggattggcatgccttataataaaataagtatttctggatatctgataatacagagaaaataatctttcagagctaagtaatgctttatacaaagattcttgtgggttggcaaattttgttattttgttactaaactattcatcctaaagaagtttatctgggttgttagtaggtctgataaagatggcttgatgtttttcttatttaactggtatttgcacagctgagaccacatgcaaaacacaatagcaacagctctctttgcccatccggcagagaataagtataccctgatagtggtaactttgaattctctttgaacctgacacttcacttactccctcttagaaatggttcttggaatgaaaggactgtctactcttctaaattctcaggtctttatggatttaagagagaaaatccaaaagtcagagttgaaggaatcaacttgaatttttgaaaaggatgttgcaatatatatatcacactttcctgtccatcttgtttatatattactgaaagtggcggatatgattaatctatgtgtgggcttattggagtggttgtggtaatatagagtggtaaatggattacataaaggtatcaataaaatgtttaagtaatttattacatgcctgtcactgtacaaggtatttttcttacattatttttaatcttcaaaggaaccctataagttgaactatgactggccatactggactttgtctaaggacaccaaaatttagagggtgcaaacatttaatataatgattctaaaagcttggcacctagttagcaagaataattatttaaaacaggaagctaccagatggcgagcattgttagtaacacccatctgtgggctacatcatgaattacagagtcgatttgagagctggttttgtgtagtttgttccaggtgccaaaagtactggtttgatgtctttgtaaggtagatattgtgatccctgttttataggtggagaaaactaagacttacataaattaagcaatttgctcaaggacacaaactagtgaaagttgagctacgattttaatctaggtctttctgagcctaaatcatattttcttcgtattgtgctatgctacttctcacatgttcctcctaattagattagcattttaagatggagaagtgggaaatcctctccattgtagaatatttgaaaactttcttattttgagtatttgtcatttttccttctatccatttgtttgttttcactcagccatctattcatctagttgatctttcaacaagcatttatttcttgtatgtagcaggccctgtaatagggaatataaaatggttattttctaaaaatatagaatcaaattgagtgacggcccttcaagatgagatgtttctgtcaacttaatagcatgctaatatgacccatgattttgtagtgtatatcttgttgaaaatatctggtagatttgctgccatagttatacccgttgcttttcacttaacttgatgttgatgccacacttaaaaaataccccattatttccccctgcccttctcactctttttcttttcttcctctctcattttcttccttctcctctccttcccttttacctcctttcctctcctcttctcttctcttgcatacattatgagtgacatttcataatgtatttctggatattgttgatatccaatttttctttgaagattttgttgatatttttgaccagtgagactatttttaatgttagtactcagattaagagatgcaaacattttcattctggtaaatggtataataagcagtaccaaaccattttttatagtttattcttgggtagatatgtgctaggctatcagggatgtccagacgtatttcagacaccatgaccttgtatggagcttggaccattgatttattccatgaataagagttactcaaatatttagaaacccaaaggataaagtttttggctttggaaatagatagataatatgaaaaacgtagtaagtttaggtttgataaagggaagcaagtcatgtgattttggtatttagggaatcttagaaccaatcccctgtggatactgaagggcaactgtataagattataattctgagaatagaggtagttttccttcttccttttcaatttggatggcttttatttctgtttctcacctaatgctctggctagaacttccagtacaatgtacaagaacattgggaaagcagacattcttgtcttgttcctgatatctcagggggaaagatttcagtcttaccgtggaatatgatgttagttgttggtttttcatagacgccctttatcatgttgaagaagttctattctattcctagttttttgtatgttctcttgcaggggtgttggattctgacaaatgctttttctgcatcacttgaaacaattgtgctttttttcttctttgttctattaatgtggtatattacattgcttttcttatattgaaccactctggaattcctaggataaatcccacttgccacagagatttttatcttaagtttgaacccagttgtgccttttggtatctcttgtgtattttgtttatcattgtaatatggttggaaaagagggactgcttattgaggtatgagccttctatccgtctctgtctggaagttgagatcttatttttcaatagggaggagtattaaacaaatacagaatatttcttattttattttattttttccttcagttgtgacctgtgacctgaatgtcatgaaaattttccacagctttttctgttttaaaataaaatgtgtacttttcactatgatttaataaattgccttagttgagaatttttcagatcttaactgttttgaaactggctagaaggaagcattttaaaacagtctaattaagatttttaaaaatagagatttgaaatgatttaaatatgccacttagtcttctgtcttccctcctcatcagcattctgttttttcctttctttagttgatccaggaagtgtctgccaataggagtcagcagttactaatgcagtgaactcagaaggaactatttcataggttcagagagaagacttacagattctctgttctcaatattcacaaatgaaaagagagttgctttttaaattatcctatactcaggtaattctctttcaggttttgtgttaagactagattttcagctccaggtagcaaaatcgtaaccaactcaaagaggctcacatagaaaacattgttttagtccatctgaaaaagagtgttttattccacttaaatgattacatatagctcaattcaggtgttcaagaaatgccaacaggtctctgtctttttatttgcctgtctctgttcacaccctgtatttgctatcccctttctcttatttgattttatcttcatggcatgaaaggtaacccctgactagctccaggtttacaaagactttgtcctcaggatcctggaggaagagggtattttccctcatagctccaataaaagcctcagggaggattggcctggcatgcgtcacatagctttcacctctgtctttgtaacctgattaggcataggttatttggtcatccctgggaaggtggacagagctatccctgatgcactgcatgaactgaacggcataaccatggaatgtggaaggagtggatcaaaatgaggaagggatgttaggcagaaacaaaaaaaaaacacattgaaatgttatcttctgcttatctgtcatggcccaacagtgccgtttattatcctttctcccctggccttaaaaaacaaaaatgattgttttggttgttcatgtgtgttctcttacatgtttcttagatgataattctctagagaaccggcatggtatctactttttttaaacttttaacggaagtatattatatatacagaaaagtaaatatcataatcatatagctgaatgtattttcacacatgggacactcccatgtgactggcatccagatcaaggagcagaatttggccagcaccatagaagcttcttcatctcccctcttcaaaggaaattattattctgatctttaacagtgttgagtgcaagaggtctgctttttcttttaagaaatattttggagaaggagtcttgctatgttgcccagactgtcttgaactggtctcaggcagtcctcctgcctcagcctcccaaaaagccaggacttcagtgtgagccatggcacctggctcaggtctgcttttttctattcccattccttacaagggcagggttccagttttgagagcctgctttctgttgtttccaccctcttctctgcaatttccattatggatgatgatggggaatgggttggggtcttgtttctcttttatttctgtaggatcctgacctttctctcattttcttctttccctttggcctttcactgccacaccttgaaggggtatcactcattttctatatatctgattcttccccagtaggaaggctttaccaaggctctcactttttattttcttcactttcgagcctataaagcctgttttttttatttttaaattttatttatatttatatatttttttgagatggagtttcactcttgttgcctaggctggagtgcaatggcgcaatctcggctcaccacaacctctgcctcccaggttcaagggattctcctgcctcaacctcccgagtagctgagattacaggcatgtgccaccacgcctggctaattttgtatttttaggagaaacggtgtttctccatgttggtcaggctggtctcaaactcctgtcctcaggtgatctgcccaccttggcctcccaaagcgccaggattagaggcgtgagccaccgtgccttgccaaagcctgtcctttaactatcagatgccaacctgtgtttggcatttagttgggcttcctttttctgttttgtttgtttgttcgtttgttttttcctgtgctttggtttaagtccagtttgctctctctctctctctctctctctctatatatatatatatatatatatttttttttttttttttttttttttttccttccccccacccccaccaagggatctcttaagcttttcttcctctggtcaccacatccattggcttacaatagggggccctgggagtgctgttgtagtttggttggtttttctatttacagataatccaaaggtcatggtatctttgtttcctagtggtgctgaaaatgtgagccatatgtggatttatttgtgctcttgattttttgtttgtttcttgagaggttatgtggagacatttgaaatttggtggccattgttgtcctctaggcccaagagttcacacagattgatttcagaatgttcaacaacttttgtatgcctaaaataaactttacttggttgtgatatggattatcctttttatatatcattggatttaattgctaatatttattcatttatgtacaggcttaccttgttttgttgtactttatagcactttgcagatttttttttttaaaaccaaatagaagttttgtggcaacactgtattgagcaagtcttttggggccattttcttttttttcttcacaactttcattttaggttcaaggggtatatgtgcaggttcgttacataggtaaattgtgtgtcacaggagttggtgtgcagataattttgtcacccaggtaatcggtgtaatatttggtaggtagttttccagtcctcaccctcctcccaccctttaccctcaaagaggcctcagtgtctattgttcccttctgtgtccatgtgtactgaatgtttaacttccacttataagtgagaacatgcagtgtttggttttctgctcctatattaatttacttagattatggccttcagttccatcttttgttgctgcaaaggccatgatctcatttttttaaatagctgcttagtattctgtagtatatctgtaccatattttctttatccagttcaccgttgatgggcatctagcttgattccgtgtctttgttattgtaaatagtgttgtgataaacatgtgtgcatgtgtctttatggtagaataatttgtatctttgagcatatacccagtaatggagttgttggattgaatggtagttctattttcagttctttgaggaatctccagactgctttccacagtggctgaactaaattacattcccaccagcagtatataagcattccattttttctgcgatgtcactggcatgtgttattttttgactttgtaataacagccattctgactggtatgagatgctgtctcattgtggttttgatttgcatttctctactgattagttatattgagcatgttttcatatgtttgttggctgctagtatgtcttcttttgagaagtgcctgttcatgtccctgcccattttttaatggggttgttttttacttgttgatttgagttccttatagattctgaatattagacctttgtcagatacatagtttgcaaatattttatcctgttctatgggttgtctgtttattctgttgatagtttgttttgctatgcagaaactctttagtttaattaggcccagttgtcagtgtttttgttgcaaatttttttggagtctttgtcatgaagtctttgcctgggctgatgtgtggaatggtatttcctaggttttcttttagggtctttatagtcttaggttttacttttaagtctttaatccatctttagttgatttttatatatggtaaaaagtaggagtccatttccaatcttttgcatatggtagccagttatcccagcaccattttttgaataggccatcctttccccattgcttgctattgttggctttgtcaaagatcagatagttataggtgttctgggttccataacctagaaataaagaagggtttcattggtctgtgtgtctgtttttgtaccagtaccatgctgtttttgttactatagccttgtagtatatttgaagttgggtagtgtgatgcctccaggtttgttctttttgcttatgattgctttggctattcaggctcttttcttattccaaatgaattttagaattttttttcttattctgtgaaaaaatgtcattaatagtttgataggaatagcattgaatctgtaaatagctttggggagtatggtaattttaataatactgactcttttatccatgagcatggaatgcttttctatttgtttgtgtcatatctgattcctttcagcagtgttttataattctcattgtagagatcgtttacctccctggttagctgtattcctaggtattttattatttttgtggctgttgtgaatgggactgcattcttgatttggctctcagcttagacgtgattgatgtatagaaatgctactaatttttgtgcattgatttttgtattctgaaactttgctgaagttgttcataagatctgggagcctttgagcagagactgtggggttttctaggtatagtatcttgcgaagaaagatgatttgacttcctctcttcttatttggatgctttttatttctttgtcttgcctgattgttctggctgggacttccagtactgtgttgaataggaggggtgagagatggcatctttgtcttgttctggttctcaaggggaatgcttccagcatttgtccattctgtatgatgttggctgtgggtttgtcatggatgactcttattattttgaggtatgcaccttcgatgagtagttcattgaggatttttaacacaaagcgatgttgaattttatcgacagccttttctgtgtctattgagctgatcatgtagttttcatttttagttctatttatgtggtgatcacatttattgatttgcatctgttgaaccaaccttacatcccagaaataaatcctacttgagcatggtagattagctttttgatgtgctgctggattccttttgctagtattttattgaggatttctgcatcttacattcatcaaggatagtggtttgaaatgttttggtatcagaattatgcaggcctcatagaatgagggaggaatcccttgattttttttttttttttgaatagtttcagtaggattggtacctcctcattttttttttcttttttttttgaaacagagtttcactcattgcccaggtgggagtgcaatggcgtgatcttggctcactgcaacctccccctcccgggttcaagtgattctcttgcctcaacctcccaagtagctgggattacaggcgcccatcaccatgcctggctaatttttgtatttttagtagagacggggtttcatcatgttggccaggctggactcaaactcctgacctcaggtgatctgtccgccttagcctcccaaagtgttgggattacaggcatgagccaccatgcttggccatcccctcttttttatacatgtgacagaatttggctatgaattcattttgtccagggccttctgtttggtaggtttttaattactgattcagttttgcaacttattattgatctgttcagatactcagtttcttcctggttcagtcttgggaggtggtatgtttccaggagtttacccatttcttctaggttttctaagtttgtgtgcatagaggtgttggtaatagtctctgaaggtttttttatttttattttttgaatttttgtggggtcagtagtaatgtccttttggtcatttctgattgtgtttatttggatattttccctttttttcttttttagtctagctagaagtctgaatcttatttgttctttcaaagaaccaacttaaaaaagtcgtttgtatggtttttctcatctccatttcattcagttctgctctgattttggttatttcttttcttttgctacctttgggattggttagctcttgtttttcaggtttctctaggtgtgacattaggctgctaatttgagatctgactttttaatgtggatgtttagcactgttaactttactcttaacactgctttagctatgtcccagaaattctagtatgtcgtatctttttttttttcttttttcattagttttgttgggtggagtgttctgtagatgtctgttaggtctatttagtcaaacgttgagttttggttgtgattatatttgctgatattctgcctcaattatctgtctagttctgtcagtggaatgttgaagtgtctcagtattactgtgtgattatctaagtctctttataggtctctatgaacttgtttcgagaatctgggtgctccattgttgggtgcatatatatttaggatagtcaagttttcttgttgaatcgaaccctttatcattatgtaatgcctttccttgtcctttttgatcattgttgatttaaaatcagttttttttctggaatgagaatgggaaccctgctcttttttgttttccatttgcttgacagatctttcttcattcctttactttgagcctgtgggtgttactgcatgtgacatgggtctcttgaagataggatatagttgggtcttgctgtttatccaacttgccactctgtgccttttaattggggcatttaatctgtttatgttcttctggttaagaaccattactggggagctagtacggtcttttggatgtaaggagacactctggctcctagagttgccagagttcttgcactggttctttctcatctgtgtgggctgatcttcctttaactgtggtgtaatttgagtatagtcaattggctttatttctggatgttttcaggtggatgaaagtttgtaaagggtctttgcttgtggctgatttcttggcattggtttcacagggttgcaaagtatttttgatgttgaagtttgggctgccatccggtagatggcgattaagcaaccactaccctgatcagtcggcagccagcaacataaaagcagtattccctctaacagcaaaaagattgcgacttactgaaggctcggatgatcgttgtcattttttagcaatatttttaaattaaggtatgtacattgtttttaaagacataatgctattgcactcgtagtacactatgaatggtgtaaacgtaattattatatgcaccgggaaacagaatgtgtgacttgctttatcatcaaattcacttttttgcagtggtctggatcagaacctacaatatctccaaagatatgcctgtatatatatttttatttttcttagattaggtatatttagcaaatttaaaagtaaattagagacatcgtggcctttactaccgttgtgtagtttatatctctagaatatagggtcattcttcttcatatccacaatatatttatcatccttaacatattctatgggaaggattttaatagtagattcaatttctttagtagatattcaactgttttgtatatttcttctttcgtgaaactcagcaagttctatttttcaagaaatttgtctgtttcacataaaaggtgaaatttaattgtagaagtgtttatagtgtctcctaatcttttggatgtctgttgggtttttctggattttggttatttgttatgtatttttttttcttattcactcatgttagcattttatcagtttttttaatgttcaaaagaattaacttttaacttttattttgctgttctgtgttttctattttatagatttgtattcctttctcattctacttacatgaagtctgaatattctttttatttttgagttagaagattacatctttgagtttcagcctttttttaatatacatttaggattattaaattttccataaagtatttgtttagctacctcctatagattttgatatgtcaaaccttagttattatcagttcaaaatatttttcatgttttgttttcgtttttaaatctcattttattagttttctattggtgctttaactacttaacataaacttaatgattttcaaaacaaatttttaattttattgttttgtaggttagaaatctgacgtgaaccacactgggcaaaaatcaaggtgtgagcagcacctttttttttttttttttcctggaaactgcacataaaaataactgttttcttgtcttttctagcttctggtggccacctgcatgcctttgcttatggtcccctttgtccatctcaaagccagcagttttgcatcgctctgaccattctttcatagttacatttcacagtgatcctcagccaggaaaggttatctggttttaaggagctatatgattggattgggctcatgtgaataatctaggataattgccctatatcaaaacccttaaccttaatcacatttgtaaagtttctttagccacgtaaaataacatagacacaggttctgggcttagggcatgaacatcttcaagagtcccatcattattctgcctcctgtacctgtgaattacttagaagtatgtcataaatagcataagcatattgtttaattttctggcagttggagttctttagttttttattttttagagacagggtcttgccttgttgctcaggctggagtacagtggcacaatcatagctcactgcagcatcaaactcctgaactcaagtgatcctcccaccttagccttcagagtagctgggattatagctgtgaaaaaattcatagaaatgggaatcttactatgttgcctaggctggtcttgaactcccgtcctcaagaagtactccagccccagcctcccacagtgctgggattataggtgtgagccactgcacctggccccctttcttgacctttctaagtctactttaccagcttgttcttccccacttgatctttaaatgctgaaattcatcgtgacttggttatcaaccttcttaggctctttaccctattctccttaggtgatttcaggattacatactttaataactgtctacaacagcagtgtacaatagcaatatcatatcaacacatatgtaatcctgaattttctagtagtcacattaaaaaaaaagattcagggccagtgcagaggttcacgcctgtaatcccagaattttgggaggctgaggcaggcggatcacgaggtcaggagatcgagaccatcctggccaacatggtgaaaacccatctctactaaaaatacaaaaattagctgggcatggtggtgggtgcctgtaatcccacctactcaggagactgaggcaggagaatcacttgaacctgggaggcagaggttgcagtgagctgagatcgcgccactgcgctccagcctgggtgacagagcaagactcccatctaaaaaaaaagatttatactgctgaccaagataggtaacagtctttcctgaagcaactaaaaataccagacaatatatttaacaatgattttcgagacactgggcatcaggtaatgaaagacagtgatttctgagaggaaacaaatgaagttaggctcatgattgtcccagattgctgtcttgaatttctaggttgtggtgcagggagaaggaagccatttggatcctggcagaacgttctctctgagttaagaagatgaagttgagaggctaggaagaatgaagttagagtttgtagttagagcttgcaggatacgatatttagaattattgcctgatgtccagtgtgttgtctagaggagagataatggtacagagattggtagtgtctcctggaatatacacagagtactcattagtgtatgctgtggggaaactactcgagaccaaaaaagatatcccaaaaggattacgagacacaattctggttgctcacacagagctgggaatagtgtcttcctaagaagtagtctcagaaacctcaatcatgtggcattaggtagaatacatagaaggagtaatagtactgtggaataataattaggcccactcccacaagtcttttaaaaaatacataatttttatttttttcaattttttggtaggtacatagtaggtgtatatatttatggggtgcatgagatgttttgatacaggcatgcaatgtcagataagtacatcatggagaatggggtatccatccccttaagcatttatcctttgagttatgaacaatccaattacacgctatgtttttaaaaaatgtacaattaagttattattgactatagtcaccctgttgtactatcaaataggtcttattcattcattctgtttttttttttttttttttttttttttggtatatgttaatcatcccacctccctgtaacccccccactacccttcccagactctggtaacccattcttttactctctgtgctcatgaattcatttttttttttttttaatatttagatcccacaaataagtgagaacatgcaatgtttgtctttctgtgcttggattatttcacttaacacaataattttcagttccatccatggcgtcgcaaatgacaggatctcattctttttcatggctcaatagtaccctgttgtgtatatgtaccattttttctctatctgttcatctgttaatggacacttaggttgcttccaaatcttggctattgtaaatagtgctgcagtaaatatgggagtgcagatatctctttgatacactgatttcctttctttggagtgtatgcgtagcagtgggattgcaatttttttttttttttttgagacagagtcttgctttgtcgcccaggcaggagtgcagtggcacgatcttggctcactgcaacctccacctcctgggttcaaacagttctcctgctcatcctcctgagtagctggggttgattacaggcgcccgccaccatgcccgggtaattttttgtatttttagtagagacggggtttctctgtgtcagccaggatggtctcgatctcctgaccttgtgatctgcccacgtcggcctcccaaagtgctgggattacaggtgtgagccactgtgcccggccgtgggattgcaatttttattttttttgaggaacctccaaactgttgaactatgtacaacatagtgcttgtactaatttacgttcccaccaacagtgtaccagggttcccttttcttcacatcctcaccagtatttgttattgcccgtcttttggatataagccattttaactgggcggggataatatctcattgtagttttgatttgcatttctctgatgatcagtgatgttgagcaccttttcttatgtttgtttgccatgtgtatgtcttttgagaaatgtctgttcatatcttatgcccgttttttgattggattattagattttttccctatagagttgtttgagcatcttatatattctattaatcccttgtgagatgggtagtttgtaaatatttcctcccattctatgggctgtctcttcacttttttgattgtatcatttgctgtgcagaagctttttaacttgatgtgatgccatttgtccattttttgctttgattgctggtgcttgtggggtataactcaaaaaatcttttcccaaaccaatatcctggagattttccccaatgttttgttgtagtggttttatagtttgagttcttagactttaagtctttaatccattttgatttgatttttgtgtatggcaagagataggggtgtaatttcattcttctgcatatgggtattcagttttcccagtaccatttattgaagaaactgtcttttcttcagtgtatgttcttggcacctttgtcgaaaatgagttcactgtaggtgtgtggatttctttctgagttctctattctgttccactcatctatgtgtctgttttgatgctggtagcttgctgttttggttacaatggctctgtagcataatttgaagtcaggttatgtgattcctccagttttcttctttttgcttaggatcactttggctattctggatcttttgtggttccatataaattttagtgttgtttttctatttctgtgaagaacgtcattgatattttgatcaggattccattggatctgtagattgctgtgggtcatatggacattttaacaatattgattctaccaatccatgaacatggaatatttttccatattttgatgtcctcttcagttttttttcatcagtgttttatagttttcattgtagagctctttcacttttttggttaagttaattcttagatattcagttttatttgtgactgttgtaaatgggattactttttaaatttctttctcagattgttcactgttggcatatagaaatgctactgatttttgtacattgattttgcatcctgcaactttactgaatttgttagcagttctaataattttcttgtctctttaagtttttccaaatacacggtcatatcatctgcaaacaaggataatttgacttcttcctttccagtttagatgccctttatatctttctgttgtctgattgcttctagtactgtgttgaataacagtggtaaaagtgggcatccttgtcatgttcctgatctaagaggaaaggcttcagtttttctgcattcagtatactatctttgggtctgtcatatatggcttttattaggttgaggtgtgttccttatatatccagtttttgaggggtttttatcatgaagggacattgaattttatcaaatgctttttcagcatccgttgaaataattatttggtttttatctttcattctgttgatatgaggtttcacattgattgatttgcatatgttgagccatctttgcatctcaaggggtaaatccccctggtcatgatgtgtgatctttacaatgtattgttgaattcagtttgttagtattttgttgaggatttttgcatcaatatttatcagagatattggtctatggttttcttttttttggatgtgtctttgtctggttttgatatcagggtaatactggcctcatagaacgagtttataagtattccctcctctatttttcagaatagtttgagtaggattggtatcatttcttccttaaatttttggtagtattcagcaatgaagccatcagtcctgggcttttctttacttagagattttttactatggcttcaatctcattatctgttattggtctgttcaggttctgtgttttttcctggttcagtcttggtaggttgtatataagtaggaacttgtccatttcttctagactttccaatttattgacatatagttgcacatattagctactaatgatcctttgaatttctgcagtaacagttataaagtctgtttttacatttctgattttatttatttgtatattctttttttttcttagtttggctaaaggtttgtcaattttgcttacgttttcaaaaatccaactttttgtttcactcatcatctgtattatttcatttcagttcattcattgctactctgatctttattatttttttctactcattttgggttcggtttgctcttgcttttctagttgtgtaagatgctcatttgaagtttttcctcttttttgatgtaggcacttgtagttctaaacttccctctcagtattgcttttgccgtatcccataggttttgggatgttgtgtttccattatgatttgttttaagaaattttcagttctttacttcttcatttactcactggtcattcaggaacatattgtttaatttccgtgtatttctgtagtttccaaaattcctgttgtcattaatttccagttttgttccattgtggtcagagaaggtccttgaaacaatttcaatttttgttgaatgttttaaaacttgttttgtgacctgacatatggtctgtccttggaaatgatcaatgtagtgaggcaaagaatgtggattttgcagcccttggatgaaatgtcctgtaaatatctattagatccatttggtctgtagtgtagattaagcctgatgtttctttgttgctttttctgtctggaagatctgtccaatgcagaaagtggggtgaagtctccagctattattagattggggcctatctctcttgttagcactaataatatttgccttataatatatgggtaccccagggttaggtgcaaatatatttaaaattgttatatcctctcactgaattgacccctttatcattatatagtgaccttgtttgtctcttcttatagtttctgttttgaaatctattttgtctgatacaaatatatcagaaaaaatattttttagtttccattggtgtggaatatctttttctatccctttattttcagtctgtttgtgtctttataggtgaagtgtgtttcttgtaggcaacagactaatgggtcttgttttttcatccattcagccagtctatgtcttgattgtagtttagtccatttgcattcaatgttattatttataagtaaggacttacaccattttgttattttttttctggtggtttagtggtctttcttctttctttccttcctgtcttcctctagtgaaggtgataggatttagtttcttgctttttatttttttgtatgtacattatatgttatttatttatttatttatttatttatttattttttattgataattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcacgctgccttcaagcatctgtttaacaaagcacatcttgcaccgcccttaatccattcaaccctgagtggacacagcacatgtttcagagagcacagggttggaggtaaggtcacagatcaacaggatcccaaggcagaagaatttttcttagtacagaacaaaatgaaaagtctcccatgtctacttctttctacacagacacggcaaccatccgatttctcaatcttttccccacctttcctgcctttctattccacaaagccgccattgtcatcctggcccgttctcaatgagccgttgggcacacctcccagacggggtggtggccgggcagaggggctcctcacttcccagtaggggtggccgggcagaggcgcccctcacctcctgggcggggcagctggccgggcaggggggctgacccccccacctccctcccggatggggcggctggccgggcagggggctgaccccccccacctccctcccggacggggcagctggccgggcagaggggctcctcacttcccagtaggggcggccgggcagaggcgcccctcacctcccggatgggggggctggctgggcggggggctgacccccccacctccctcccggatggggcggctggccgggcggggggctgacccccccacctccctcccggatggggcggctggccaggcggggggctgacccccccacctccctcccggacggggcggctggccgggcagaggggctcctcacttcccagtaggggcggccgggcagaggcgcccctcacctcccggacggggcggctggccgggcggggggctaacccccccacctccctcccggacggggcggctggccgggcagaggggctcctcgcttcccagtaggggcggccgggcagaggcgcccctcacctcccggatggggcggctggccgggcggggggctgacccccccacctccctcccggacggggcggctggacgggcagaggggctcctcgcttcccagtaggggcggctgggcagaggcgcccctcacctcccggatggggcggctggccgggcggggggctgacccccccacctccatcccagacggggcggctggctgggcagaggggctcctcacttcccagtaggggcggccgggcagacgcgcccctcacctcccggacggggcggctggccgggcggggggctgacccccccacccatctccctcccggacgaggcggctggcctggcggggggctgaccccccccacctccctcccggacggggcagctggccgggcgaggggctgacccccccacctccctcccggacggggcggctggccgggcggggggctgatcccccaacctccctccaagacggggcggctggccgggcggggggctgacccccccacctccctcccggatggggcggctggccgggcagaggggctcctcacttcccagtaggggtggccgggcagaggcgcccctcacctcccggacggggcagctggccgggcggggggctaacccccccacctccctcccggacggggcggctggctgggcagaggggctcctcacttcccagtaggggcggccgggcagaggcgcccctcacctcctggacggggcagctggccgggcggggggctgaccccccacctccctcctggacggggcggctggccgggcggggggctgatgcccccacctccctcccggacggggcggctggcctggcggggggctgatccccctacctccctcccggatggggcggctggccgggcagggggctgaccccccccacctccctcccggacggggcggctgatggggcggggggctgacccccccacctccctcccggacggggtggctgccgggcggagacgctcctcacttcccagacggggcggctgccgggcggaggggctcctcacttcccagacggggtggctgccgggcggaggggctcctcacttctcagacggggcggccgggtagagatgctcctcacctcccagacggggttgccgccgggcagaggtgctcctcacatcccagacggggcggcggggcagaggcgctccccacatctcagacgatgggcggccgggcagagacgctcctcacttcctagatgtgatggcggccgggcagaggtgctcctcacttcctaggtgggatggcggccgggcggagacgctcctcactttccagactgggcagccaggcagaggggctcctcacatcccagatgatgggccgccaggcagagatgctcctcacttcccagacggggtggcggccgggcagaggctgcaatgtcggcactttgggaggccaaggcaggcggctgggaggtggaggttgtagcgagccgagatcacgctactgcactccagcctgggcaccattgagcactgagtgaacgagactccatctgcaatcccggcacctcaggaggccgaggctggtggatcacgtgcggttaggggctggagaccggcctggccaacacagcgaaaccccgtctccaccaaaaccagtcaggcctggcggcgcgagtctgcaatcgcaggcactcggcaggctgagtcaggagagtcaggcagggaggttgcagtgagccgagatggcagcagtacagtctagcttcggctcagcatgagagggagaccgtggaaagagagggagagggagaccgtggggagagggagagggagagggagagggagaggcaaaggcaggcgcagaggcaggcacagaggcaggggcaggggcaggggcaggggcaggggcagaggcagaggcattatatgtttttttgtttgaggttaccatgaggcttgcaaatatatcttgtaacccattattttaacttgataacaacttaacacttgtataaacagacaagcaaaaggaagaataataaaaactctacaccttaactttgtcccccagcttttaaacattttgttgtttctgtcttattgtgttgcctatgtcttgaaaagttattatttttcattggttcatcattcagacttcctacttaggataagagtagtttacacaccacattacagtgttataatatttggtgtttttctgtgtacttactattactagtgagttttgtaccttcaggtgatcatttattgctcattaatgtccttttctttctgattgaagtactccctttagcacttcttgtaggacaggtctgatattgaaatctgttagcttttgtttgtctgggaaggtgtttatttttccttcatgcttgaaggatacttttgctggctatactcttctagggtaaatgtttttttttatttcttcagcatgttaaatatgtaattcttgggaaggctttccagacatttgaaaggacttgtgtgttgtgatctaagctgtttctgctttagggctcaccacaagcctggtaatgttatggttcttgcagactcttagaggtaccagccaccttgatggtcttggacaagatcagggagaattctcttgattaccagtcagaggctcttgttgtttccttactttctcccaaacatataaaatctctctctctgttctaagccacctaaagctggaggtggagtgacacccctggggccaccaccactatgactgctctgcatcagacctgaagctggcacagtgctgggtcttgtccaaggcctgttatagccactccctggctactgcctatgtttgctgaaggccctgggactctgcagtcagcaggcagcaaagccagccaggcctgtgtccttcccttcctggtgatgaagtctcccaatcccttcgtggatatagaagtgctgtcagggagtcagggactagaatcaaaaaccttagaagtctacccggtgttatcttgtattgcactgttggggcactcaaaccacaaggtgcagttcttcccactcttccttcccttttctgaaggcagacaagccttaccccatagccactcaccccagaccataggactactgccagaatactgctggcattctcttaagtcccaggatctcttaactcagcttgttgtaaatgctgcctggactgggactcacccttgagggtagtgggttccccactggccaagggcaggtccggaaatgctgttcaatagtcaaggcctgaaattggggcaccttaagtgcccgcttggtgctctacccttctgtggccttgctggtatctaaggtacaagagaaagtcccctttacttttccctctgcttttctcaagcagaaggagttttgctctgtagtcaccacaattggtaatgtgctgagtctcacttaaagtctgcaagtctcacaggctcgcctgaagccgtaagtgtagtacctgggtaatgttgctgattattcagggtccaagggctctttagttagcaggtgatgaatgctgccagcacgaagtcctttctttcaaggcagcaggttcccttctggctcagggtgtgtatagaaatgtctgggaactaggacctggaatagggaccacacaactctgaccagtgccctatcttgctatggctgaggtggtttccaagatgcaagacaaagtcctccccactttcctctcctttcctcaagtggaggaatggcgtgtcttttggagctatgagctgtgcagcctggggttaagggagtggtgatgccagccctcccttgactgcctcagctagtatctcagtatgccatgtgtcctcctgtccactgtctctgggcctagttcagtactaggactcgcctacaagttgcagtccttatggcctcaaatgcctttcaaatttacttggagacacagagtgctgtagcccttgttggcgaggtttgcaggcagtcaatttctgaccactaggatcagtgattcccctctggctagagtgggtttaaatgctcccatcttgggtgggctttagctgagtttggtccagttttcctttttgctctaacaggacagcagttgctgttcagtacctcacagttgctgtgttctccctcccccagacgctctcatagacactctctgcaccatgctccagtaggagctggggtgcagggggtgacgtcagcaattcgggactgctttttttttgtatcttttcagtgcccctttcagtaagatgaagttaaaaccaggtactatgagtactcacctgatttttggttcttatgaaggtgtttttttctgtgtagatagttgttaacttggtgttcttgtgggcttggggatgattggtggagctttctattctgctgtcttgttccaccgtccccactctctcaaatcgtaaaagcaagacctaaaaggatcaaactatattcaagaaccatttctgtatcctagaacaaagctcaaaaatattgatagtagttagaaaaacacccaccacccaacatggtaaaattcaaaatgttaccattcatgcatagaagcaggaaaaatacccccttaattgagggaaaattaatcaatctaatcctaccaggaattgacagagatgttagaatgatcaggtaagggctttaagtgttgttgtaactttgtttattatcttgaaaaagttaagtggagacatgtaagaattacaaaagaccaaactgaacttctataggtagcatccacagtgtcagaaatgaatgcaaaggttgtgatctgtggcagattagattttccagaaggaaagattaatgaacttgaggacatagtaatagaaactatccaaaatgaaacagtgagataaaagtatttttaaaaattaaaaaaaaggacttcactgaactatagaactatttctgtatatggaactgggacgtgtgaaaatggagagggggaaacaaaatatttgaagaaataatgcctgaaagctttccacatttaataaaaacaatttgcaagtccaaaaagtccgataaaccccaagcaaagaaacatgaatactacaccaaggcacatgataatcaaattgctcaaaaccagtgataaagggaaaaccttgagattaacagcaggcagaagaaaaaagacaattcatgtatgaacaaagatatgaatgtcatcagatttcgtgttgaaaacaatgtaagagagatgacaattgatgaatatatctgagtagagaaaaaggtggaaaaaacctgtcaactgagatttctatacccaatgaaaatatctttaaaaatataggcaaaataaggaattgtttgggagtgatgagtatgttctgttttctctttgattttcttggtcagtctacctgaaagtttgccaattttgttgatctttttgaagaattaattttttaaatttcatttgttttctctgtatttcttctattttctgtttcatttttttctcctttcactgttttatatggtttgctttaattttttagaatttatcttaagaggtaaaagcttaggttatcaatttgatatcttgttttcaatgttggtgtttaaaactattagtgtccctctaagcactgcttccacatcccataaatttagatatattgctttcattttcactcagcttgaaataatttccagttatctttgtttcttctttgattcatgtatttttaagatatgcattctttagttttcaaatatatgtgaattttccaatttttaattttttttttttttttgagacagagtcttgccctgttgcccagactggagtgcagtggcacgatctcggctcactgcaggctccacctcctgcctcatctcctgcctcagcctcctgagtagctgggactacaagtgcctgccaccatgtccggctaatttttttatgtttttagtagagacggggtttcaccgtgttagccaggatggtctcgatctcctgaccttgtgatctgcccgcctcggcctgccaaagtgctgggattacagacgtgagccaccatgcccggcctttaattgttgatttctagttaattgttatggttggtgaatatagtttgcatgatttaaattattttacatttattgagacttgttttgtggccaagtacgtggtctgtcctggagaatgttctgtgtgtgcttataagaagcatatattctgctgtttttgtatggagtattctgtagattcagaattcaggttggttgataatactgctcaagttttctatattattactgattttctgtctctttgttctagcgattattgagacatatctgatgaatattgttgaattgtctgtttccttatttctgtcattttttgcttcatctgttttggagatctgttagtagatgcaggcatgtttatagttatagtttcctgattaatataaccttttaatgttataaaatgtctattattgtctgtggtaacttttctttcttagaatagattttgtcagatattggtatagctgttctctcttatgattactttttgcacggtatgtttccatttttttatttacaacctggttgcttctttgaatcaatgtatatcttctatagacaggatatagttagatcctgtatagtttttttttaatccagtcttagaaataatctctgcttttgattaacatgtttatgtacacttaatgtttgacaatgtatagaattcagccatttgaaatggcactagttaaatacatttgtagctgtgtaagccaggtaaatcagtactgtgacttcttgctactctcaccctgtgtttggttactagccttaacaggtaagatctatcttgttctcttgccttgtcttggcaatgtgcttgctattccagcacccttgaaactagggctctgttcagttttgatcagacccacctacagcttcctcaaaataaccatttgacctaaaactcaggcttggcagctgggaaactctcatttaagttgttataatactttcccgatctttgtgggaacaaggtggggatagacagatacccataacatatcacagtagctaatattcagggaaagcaaagtttaattaattttagtttattgtacttacaaatggagtagcccagtttagaatgatttgtatcgaaataaagagttaaataagcttggacacatagagctacttctccagtatttttttttaaactttttttgaaaacattcagacagaaaggcatgtttcctgagagttgtttattaccaagttttttctgtgctaaaattagtagtcacagatatgtaaaaaattgccctccttttttaaggaagagaaggaaccctagaaaactagtgtaggcttgtagttcttccttaatcttagatttaatttgttctggaaacatagaactttagagattacttacccagaaccttcaggaatgtctatctgggaatgattattggtatacactattacttattatataatagtagtagtaataataatggttatgatgatctctcatgtagtgagaactcaagaaggacaaagttcatatgcaaaacagtatgttttgcttcttcatttgtcatttcaagatatatgtttggtggatctagatggaatggattttgtatcattaaaaaaacaacccttaaacttctgttgatactcaggaggcttagtatactatagcctattggcataaagtgctgaattttccccagggttaccactgaaggaagaaagtctggacgagtagtttcctggcatatgcttcttgaattgttggctattttggtgtcaaattttatgttgagagtttcatgttttaatgacaaaaatgtttactggaaattatagcttggaaaagagagccactttcctgcttcagtagaaagctaggtaaagcattgatgtggggtaaagtagctgtggagttttatattcagattgtatgaacagtaaacagagcatctaaaataaccacttgcacgttgcaacaaacacatcatcatttgcttaaaaaagagttataattacagttgacgaagcatggacaccataaaaaatgcattagtttggcttgacacattaattacctgtttttgcagatgtttttatgtattgttgtatgaacagtttacaaaataattacaggaaagtcatatggaaaataaactaagtgggtggtttctcgtctaaatattttcattcatgtgaatctgtgaggcacagctgctctatagcaaaagcagagagatagatgaggattctcgaagtgttttttattagtcgatctctcatcagtatcaccacatttttatatctgtagcaatacagtttaaaaacatttgagagggctgatttattccctgtgattactcaaaaatctttgattctgatcagaagaaatgtggatatctacgattattttaaagtaaaccaaatgaaacccaaaaaaccctaaatgaaaatctattattttagttctgacaggttattaggcaccttgagaaagagttaatcattattttgtaattacttgagttatgcagttttatattacttatagcttattatatctttataattaaactttgtcatgtgtaaattacacagttcagcttatttgttctctcttatgaagtattaaaactgtaaatctgccttttctcagaagcatactgtgttgccgttagtgttctcaaaatgggtttcatctgaaaaatagccaggtcattatacagagatattttacctttacaaaatattacggaacacatcattcaaaattataactgtcaaacaataaaaagatagctttgtagacatcattctgtttacacagtggtttataattacttagaatatctgtgctgtattttcctcatgttattacaatttttcataaaattaaatcaaaatatagattctccttttagtccaatcatgcatcttttggaatatgttcacctgtattccttttgtttgcatttcagctacacggatgatgaagaccataattaaagatactttccctgacatgcattttatgtaactattgtttaagttagagaaaggcactaagttatagaaagaggtaattgagacatcagtaggcatgaaggtattgttatcagaccttataatagtggtggcaagtcatatacaacatggaatactatgcagccataaaaaaggatgagttcatgtcctttgtagggacatggatgaagctggaaacataattctgagcaaactatcgcaaggacacaaaaccaaacaccacatattctcactcataggtgagaattgaacaatgagaacacttggacacagggtggggaacatcacacactggggcctgtcatggggtggggggatgggggagggatagcattaggagaatatctaacataaatgacgaattaatgggtgcagcaaaccaacatggcacatgtatacatatgtaacagatctgcacattgtgcacatgtaccctagaacttaaagtataataaaaaaaatagtggtggcaagtaatttatatacttatccattcatttgtttaacaaaattttattgaaggtcttctacatgtaatgttctatgacagtgctgagatgactataaacattgagatgaccatgtgcctggaacatagtagataactcagaaactattaggcatcttttaaaggggataggaggggcaggaataaatgatagagaacattttcactctggtagtttatataaaggaagttaattgttagggaggattttctctgttactctgaaattgttttcaaatgtgatatagtctgagagtattacttgactcattcttttttttttttggtgacaaagtctcgctctgtcacccagggtggagtgcaggggcaccatcttggcttactgcagcttctgcctcccaggttcaaatgattctcctgcctcaaccacctgagtaactgggattacaggtgtgcaccaccatgcccagctaatttttgtatttttaatagagatggggtttaaccatgttggccaggctggtcttgaattcctgacctcaaatgatccacctgctttggcctcccaaagtgctgggattacaggtgtgacccactgcacctgccctcattctttgaatcatttaaatatggagatatatctgtttgtgttaacagccatttgaaaaaagatgaaatggagtctattctgattctgatgtattaatacactaagtcaatttaatttttatggtagagatgcattaaaggagtctgaaacttcatgggttgagaataataaactgcttgttatcagtaattgtcttgatcactttagatcatttcaaaggaaaaatatgggaattaatatcatggcatcaagaaaacaattattggactctagattcttccgtagattttctacttctcttaagatgtgtgtctcatggccagtgaaagaatgaggaaaatcctttttgggggtcaggagactttccatgtttaccagattaaaaactcataatttatgtggagtttcatttccaaattttctctgatgatatttttattccttctcataaggaaaaattttagttccttagttttggctctttctttttcgtttggtgtctgtcattagatctttgtgatgttttaatcttaattttttataagccatttgactttagaacataagagaaacttaagggactgctatcattattatttggacaagagtttggactgcaaataattatttggacaagagtttctcatcactaagagactggccatttttattgcctggccagtatctctctctgttgcccaggctggagtgcagtggtgccatcacagctcattgcagccttgaacccctgggctcaagcaatcttcccatctcagcctccccagtagctgggactacaggtgtgtaccaccaggcctggcgaattaaaaaaaattttttgtaaagatggggtcccactatgttgtcccagctggtctcaaactcctgggctcaagccatcttcctgcctcagcctctcacagtgctgagattacaggcgtgagtcaccatacttggccagcaatgttattttgaagggagtaaataagtctttggattctctctttaaaattgcataacaaggaaaaataggttagggagcagaaagaaattgttgaatctaagaacactgtctctgtaggtatttaacactctatgatataatgatgtataatatttgttttcagttagtgttactgatagcagaaaaactgctagacattattgaaaacaatcataattgaggcattgcctgggcatcaatattatgacttttactattctttggtgactctctgaatttctagggtcacatgaaattggttttgaaaaaacattaatagggggttgactaaatgcaaatggaaatcagattccctgactggttcatgttatacatggaaagactgatggcttcagagttgtggtagatgtgtagaactataaattactgttcttctcaaggttgccttttgttgtcagaacacttagcataaggcagaaatggtaggctgtacctgaaaagaacaaaacaccattaaacataataaatcagcacttaaaaaaaactaactgtaactaccaaggccatctcaagtgtgagttttcttttatgtgactaaagttgttaacaacaacaacaaaaaagaaggcaaaaaagcagcaacaaacaaaaactcaaaccgagtttgatttggatgttctttctattgtgataaatctgaatgaaatcaagcatgcttgactaagcacagggcccattgggagagtatttgtggtgtagagaaataaagataagaatataataaaatgtgactaagtagagtcttatgtggggattaacttctgtgcatgtggcagaaatcaaatagagtcaaaatactcttaatagccccttaaaatttcccacgaaacacagatatagacatactgtctttcaagatgtttaaattggcttgttcttcctccagcatggcttttcttttgttgaacaaatgatgaggctgttagttatattctttttagtgactaagagtagaattgaaagaaccgttttttattctaggttgcgaaactgaattttattagttccatgagtaaaaatgcctcttgattttttttttttaaatgggcaaatgagaaaaggccattgttatccaaatacatatttgggtaataaagatgttcaagagaccagtttttctcagaaagacctgttctcttttacatggtatgacatataactctttgtagctccagttttcctgtatgtttgtctgttgtctctccattctgattctgctttgctttgttgcctaacaggcacctttctcaaattcttatgtttatttctctgtatctttgtttccatactcacctgtacttctcctgtgctctgtatttttcttgtcctactcagaaacagtagaataatcaaattcaaattcagttatggtactttatattgaaaggtagcttaggatagtggcaagtaccctgaagtatggtgtaagacatggtttaggttcaggctcttatagtaactgtgtaactgagaaagacatttcacattcctcagacttaattttcttataaaagagaagagatatatttcttataaatagaatatggtataatgaagggtgccaagtggtgatggcttcttggataagttagaatttctggattccgttatctgtataccgtgccttctataaacttttcttagtgactgaagtcagagatggtgcactgagaaacacagcatgggtaattgagtgtttctgtaaatttcatcaacaactttggattttctcctcatatctactcagctactccctatcagagatcacacactataatcaccctgtatgatcagaaattgagaaggtgaagaaacacaggttgtcacaatccacattaagacatctcttatgatacaccagaactttttaacataaaggttattaaataatgggaacaatttttctttctttttttctttaaagacagagtcttgctctgttccccaggttggagtgcagtggttcatgcagtggcatgagcgtggctcaccacagccatgatttcccaggttcatgtgatcctcctgcctcagcctcccaagtagctggaaccacaggtgcgcaccaacacgcctggctgacttttgtattttcaatagagacagacatgggatcttgctatgttgcccaggcttgtgttgaactcctgggatcaagcagttctctcaccttggcctcccaaagtgctggaattgtaggagtgagccacagcctagtttttcttttttgaatgcctaagcccactggaaattcttgctgtagctgaatgattaacagataatcattgtggactgtgtgtgtgtattttaaaagggagaacaagaaatcaagcaggttagagttaattaaacattttttggtcaattaaaatctgtttaaagtcacatttgtcaataatttgactagttagaaatatcctggaaatctatagagtcatctttttttttttctggtactgacaaacctgaataagcattcaggagcagaaatcttcaagagatagtttttattcttggatgctgctgttgatcagcagtgattatgacctccttttaagggattgataaggaaggaaccgtagtatttatgtataaggttacttttttgagtcttgctctgttgcccgggctggagtgcagtggcatgatctcagctcagtgcaacctctgcctcccgggttcaaatgattctcctgcctcagcctcatgagtagctggtattacaggtgcccgccaccatgcctggctaattttgtgtgttttttttgttgttgttgttgtttttgttttttttgagatggagacttgcactgtcgcccaggctggagtgcagtggcgctatcttggctcactgcaagctccgccttccgggttcacaccattctcctgcctcagcctcttgagtagctgggactacaggttcccaccaccacacctggctaattttttgtatttttagtagagacggggtttcaccatgttagccaggatggtctcgaactcctgacctcgtgatctgcccaccttggcctcccaaagtgctgggattacaggcgtgagccaccgcgcccggccagttttatgtttttagtagagactgggttttgctgtgtgggccaggctggtctcaaactcctgacctcaggtgatccatctgcctcagcctcccaaagtgttgggattataggcacgagccaccgcacctggcctatatataaggctacatttaaaaagcctttcagtatttccatcacatcattgtagtttccttggaagtggaaccaccatattcagcaggagtccatttcaacttctggcttctggttcttgtttctgttactatggagactgcctagaaagtggcagaaaaaccaaaagtttaaaaaatagtaatttgattataaaatatggctttaattctagctttaactagttgttccatatcttgacatttcgaattccaaattatttggtgagttttttttttttacgaagcaaattttgaaactttattaaagcttaaacacactgaattaaaaagtaaattgccatagtttttattatatttgagcctaaggtgaatcaaaaatcttaaatggggatttaaattagggcttggaaggcattatataatctgaaatgagaagagctaatgacaatggaaatagcagactccagacacagtaaaccctaaaccaaaggactagtattgtgtagaaatagcaaatagatagcttttattatgtggcatgttttatcttcaaagtatgttatagttatttaagtgattttcacagaatatactcatttttcaactgagtagaaaagccctctaaaaccttgcctttaggacgtaagcagattgtaagggtagaggcagaagtacactgacattttaattgcgggttgaggagttggagagttaataaataaatgtagatggttccacagttaaaaagcaatagaaattttccccccaccaagaccagttatatttgtgaattcctcatgaaggagagaagaggtggaatagtaatgtaaaaggtgtgaaatgaaagttatttagcgaaattgcaatcccaactttgttgcagcttttcgttgaggtccgtatttagtcaggattctttggtttgcatgtgcggaaatccaaattcggactacctcagggaaagaagggcaggaatgtagctttgcctgaaatcagggatgccagttacattagaggaaagtaggttcacctgaaaacactgggatttctttctattttttcttttaagtctcgtatatctgctttctgagttaagttcgttctttcacattggcctttttttgcattggcagaaaccagctgttggcagttcctactcctcttatttatagctcgaataacagagacagtccagtttgtgttgtgccaattcctcccttcttcaactgtggccaggaggatagggttctatgattggctcagctcctgactaggggggcccatccttggctaaatggaccttggtgattagagggactgatatctgaaacaagaaagcagctttcattcaaaccacctggttagtgatgaggggaaggggtagaagagtatgatgggaagaagaaagggacatttcccagaagcagaagatgctgttccaggcagaaataagaagagggttctactagtagtcttttgggggaaattatctctttattataattcagttcacttcagttcagcaaaccaggaaacattgttttgtaggatttggtttttagaaaaaaaccaaggttgaaaacacacacacacacacacacacacacacacacacacacacacacacacacaacagctgttgcatttggtcctatttgttgagttgcttagttgtataatgtctggactagggctagtctttttgtcttcagagctttttacaaatagacatttcttatatatttgactcctacaaaaatacatcaaattatcaatacatatttaaataggagaatgttagaatttggataaatgaaatcaatggggggtaatagttagacttggttgatactaataactttcatgtcttttccaattttgaatatctcttcttttttgttagaaatgtgaacaagcagtgtattgggtagaaggaagttaattttcaggttgaactgaggaaaatttattttttacatgtccagacttttttttttaggagagtcaagccctacccgtcgagaagctgtgaagagaagaacagccgagtacctcatgcgggcagaaagtatctctagtctttatgggaaacctcagcttgatgatgtatctcaggtatgtctcatattttgttgtgtgttttcttcagtgattttttgctgtctggtctctctgctttatttctaattagaatgttataggattttgattttttgaattttattaatgattttcataaaggttgttggtagaaagaaatgcattatagcaaaccaccaaaagtggaataaaataagacttgctttctccttttcttggtcttttattagtttcttactgtacccttaatctcctcatctgtagattgacagtaatttatactgttatgatatctatttgtatttggacattttaaagttagattgtgattcttgtataattgttctccagttttattgattcatgttaaaactattcattttaagcctaagttatacaagtatatgctattggtcacctggaattataaaagcataattctagcagagatagttatgttatttgggacttctgctagacttgtctaaaacgcagatgaatactgaaaacattagaaacattgcaggttattattgtttttatgctgtatcgacctggatttggcaaatttctggaggaaacttttctgttattttttttctttatatcaaatgcaatttaagaattgtgtcttccggaaatgggagaaagggtttagtttcttttcttttcttttttttttgaaacggagtctcactctgtcccccagactggagtgcagtggcacgatctaggctcactgcaagctccgcctcccgggttcacgccattctcctgcctcagcctcccaagtagctgggactacaggcacccaccacatgcccggctaacttttttgtatttttagtagagacagggtttcaccatgttagccaggatggtctcgatctcctgacctcatgatctgcccgcctcagcctcccaaatagtttattttcttaattgatctaagagtcaggcaggcttgttcatatccagctctgccacttgaagtcatagaagattggacaagatacttaatcccacttctgcatgtcagtttctatatctgaataatgagaatatagtaattttttgctgggtagttactaggattaaatgaagtaaaaaaaaaaatttctgtggattacacatatacacataaatcaagtgcctctctagcatgaagatcagcccataagccaaagactaagttttagcctcattcttcatttccccttcatataccggcttatatactttttcctacacatttttatgctttgtatgctttttgaaaatgataagatagcagttgtcaaaactgtactaatcagtgtaagacattctgagaatttctgatgttaagtgtttgaccatttcttataaaacaaaaagattgtgtttcaacttgcaagccatatatacttatgttgctctaacataatctaacataatgattgtgttttaaatgacattattctgctgattgattttcagattgtgaattactgcgactcttttagtctgtattctgtttgctaatcttatcctattctctatcattgttcttttaattatattaaatttatttcctttactttttcaccattgaattttatctttttaagtggaatatttatgtaaacattactttgattcaattcccattttccgtgggattgacaaccttcctcgtgtgcagtactaatgtgtatatactcaatttcattttgggggggcattgatgaaagcattaacataattccctgtgaacttgctttactaaatccatcttgtatataaatattgtaaaagtttttttaaatttttaaatttttaagttttttttttttttttttgagatggagtctcgctctgtcacccaggctggagtgcagtggcgcgatctcagctcactgtaacctccgcttcccgggttcaggcgattctcctgcctcagcctcccgagtagctgggactacaggcgcatgccactatgcctggctaatttttgtatttttagtagagatggggtttcgccatgttggctaggctggtcttgaactcctgacctcaggtgatccacccacttttgcctcgcaaagtgcttgtgattacaggcatgagtcaccacgcctggccagtattctaaaagttttagggatttaaaattaccagtattctattcattcttataacattaaatttgaatggtttacctatacttattcatgtaatcctcctacttttgcatccctgttagtttcctataggcatatctatgaagcaataatttcttaggtaaataagtatgttgagcctcctgtatagttttaactagaagaatagaaccatgaagtatatcagtcagaatttcttcaagtataacttctaatgagaataaaacagaagagatctaatataggaaagctgattacatttgattatacagtaattcattaagcatcttttaagactgtatatagaatcaaactagatatactttggagttatacaaaagatgatgacacagcctgctcttgcaaatcctgtagcatagttgaggacctgtatatgtacatagttgagcaaacaaagttacactggtaagagccatcctaatgggaaattctatcagaaaggataaaaaggagtgccttctgaatctgatttgacatgtaggattttttcggttcttaggcaaggaggctagaggagagtaggcacagtatttttcttttatggtaaacatttgctttttaaattttccttttgtatgttattttgttaagcctggccctttttggccaagagcatccttgattattttctcatgtataatttaagttaaaagtcttccagaggattgtgattagcttggtgcatttattatttcacttctttaaccatctttgggtctgaatttcaaccaacacaatgagaggatttgtgtaaatgatttctaaggcccctttagctcaaatttggtgcaaagcagatattatttctctctggaatcagtgtgcaaacatttctttctagcctggttgattaagacaataaaggaaccctttttggctttttaaatttttgttaattattgttttctcctttggtacagtctatcatgacttcttccacccaggttttctgtgatgttttaagtgtttgtattgaactttagagatctttatataataaatataaaagttctaagtttcccagtcattcatgttaatatcctttttgcaaaagcacagaaaggaaaaaaagcactctcttactctttttcttcattgcttcattactaaaaggctccaagaaaatttaggagcaggtttcacataaaaaggaaatgaggttttttttaaagtaaaggttgaatcttaactgaaggagacagatttctttcttttttttttttcaaataaatcctagacaacgttgaatgatttaagaattaatgttgaaagaagctttccctggaaaagatttagaatagtttttttgctttttttagctataggaatttgaaactaaagatcaaatttagaaaaagacaataaatgatctaaatttagcacataaaatatttgtgtagtttctaaagtgtgaatatgtttttatgcagttacaaggtgtgaatgaaaattaatatgtagaatgtgtgcctttcctgaatatttgtagattttgagtacaactgatataatattgcaagtatttttctattgtgcattttgtttacttgtattattaattgatattattccattattccttagaaaatattttaaatttgccctcagtgagacatttgcttaagtcagtaataggtctgcaatttagtgtcaggcttgaaatgtgacctagtgcggctcaggagacggggtattagggttggtagattgcccgtgaaagtctttgcaaagccaaaaattcatggatgaagccaaattcaggagctttgtcataattagacagtagagttcagagtgtggtttcttgatacattctttgtggtgctttccttttgcccttgattgcttgttttcccgcagtaatggttactctctctcaggttatttgaggagtaagtaaccgtattctaaatgtggttggtgaaacagcagcatcagcatcacctgagagctaggtggaaatgcagaatatcagacctactgaatcagtatcttctttttaacaagatcatcaggtggtgcacataaaatttaagaagtactgcaccaacagattgggaagaatagagagagagatctcactgagaacaggaaataatatcaagtgaaaaagacagtgggcaggctgaacaccaacttcaaaaacaaatccccaaacagaaacaaagccttttaaagaatgtacaacaggcctgtaatcccagcactttggaaggctgaggcaggtggatcacttgaggccaggcgttcgagaccagcctggccaacatggtgaaactgcatctctactaaaaatacaaaaaataaaaaaataaaaaaattagccaggtgtggtggcacatgccagtaaccccagctactcaggaggctgaggcacaaggttatcgtttgagcctgggagatcgagcttgcagtgagccgagatcgtgtcactgcactccagccttggtgacagagcgagaacaacaatagtaagtaggttttaactagtgtgccaattctaatccatgcgtagtggctgccaagagcattgtattgagaagagttgtgagactgtgggattaacagagatgcctgccgtggacttgaccagttgagtgatatgtacttgccacctctgcttttgaagattgttgggtcatcatgtactcctgcctctcttcccttgtctttagtcctggtatagatgaatacaaccattctttgcctctcttagcatcttctgctataattgctaataaatgtaagtgaaaatcttacttttccatcaaggaactcaatcatattacctagaaatacattgcttctcccgtcgcgcttcatagcgcaatgggccaagtttcccctaacaacattctattatttcataagtaagatttaatcccctcttatctattacctacttttgctaaccttgctgcgtctcagttttctcatctaaaaaaaaaagttggacttgatctctaaggtctctttctgctcttaaaattctgtggatttgtatgtccttttgccatctgaagaaaggagtagatctataggattctacccaatttaagcactacatatgagaaatacaatttttttattgatgattttatttcatggtctttctttgttcgtttctgtgatctcaaacttttatagatggttaaagtaaaaagagaactttaatgatcactttgcctttggtcatttgtccttcaatttccccattcctgtctttgcaagagtaaccttactaaatcactgttttcattgggttatttctcatagaaagacttgttgtctagacttcggagactgtatagtcaagacttttcttctcggcattcaaggcctgtgaaaactgaccctaagtatataattttattttcctctgttctccaatttgaacaacttttccccaacaggctaatgctttccaattgtatacagtatagaataactttttcctaatctaatttccacataacatttaaaatcacctttagtcccacatctttctgagaccacagtttttcatacactaatgatgtatctatgtagtcccgtatttttaagagagtgttttattgttatttaactgttcatgtatttgtcttatcttctcaaatggtgaacttcttgaggttagactgagccttttgataatttatagccctttcagttatcatgcacatagtgggtgcacagtaattatttgttgaaagatgcaatagagatttcatagtttgctttctttgctctttaaattgccaaagtgaacaaataactttctttggaaactgaaagaaacagtgacatctgtgaataaggaggtataaataggagatagggatgttggagatacttggccatattttctaagacaaatgtaatggattaaatatcatttaaagtattcttttttccctccttatgacttttccttagcattccttttgccaaaatcacaagcagttcttacttgttcttgtagcaagaggcagcagcagaaaagaatttttaattttcagaatgtgttggttagtaaaaggattgcaagctttagaatagtagttggagttcttccactgtctctcttcctgaccacagacaaacactccagcattctgagaatccctttattcatctgtaaaatgggaattatataataccaacttcctgtaagtacatcacctggtatggggtgaagaatagagatgaaacaatataaatgaagatagaaaagactgtttctactggccgggtgtgctggcttatgccttcagtcccagcactttcggaggacgaggtgggtggatcacctgaggtcaggagttcgaaaccagcctcgccaacatgatgaaactccgtctctactaagaatacagaaattagctgggcatggtggtaggcgcctataatcccagctactcaggaggctgaggcaggagaattgcttgaacccgggaggcagaggttgcagtgagccaagattgagccgctgcactccagcctgggcgacaagagcgaaactccatctcaaaaaaaaaaaaaaaaaaaaaagaggttattgctattacatgtctgtttacatattataacactaaaatatcttgctaaatgtttttatatccctaaaaaggttccccttagtttttaagcttatagggaggcagaaatatatccgttttttttatggtacctagctcagcacctcatgaattgagacattaaataaatatttttgaaatgtatctaagaagcataaattaaatcaatttaaaggttattatctagtctaattgtcactatcaccaactttctcaagcatctttagaaataaaaagtctcttttaaaacttaaacatcatttcaggtacagttaaattattatttgcttgctaaatctgaaaacaaaacaaaaaaattgaaaagaattagaattgctgcttttagaaaaattcacaaatggtagttttcccagttgtaaatgacacctaattttccaagtaacctccctccctagattccctcctttctctctcctctcctcatttctgctctccctcacattttccaactaactaaatactagcaatatgctaggcactgtgaatatagacatgactaaggcacatttctattctcaaggagctgcctgtctggtgatgttggtctgtacaggaacttcaagtatcaaaaatggtatctcaataattcccttaccatggtgtttgatcaggatattttatcttccattcatagggtcagaatgtttccgctgtattctaatagatttttgatagcaataaggtctgctctaagtaagtaataaggctttgtgtctcctgttgtcctttgcagcatcaccattttaatacaggatcaatgtagcagtactttatagttgtaaatgtcgtatggaggtgcccttagaatttatctaatttaatggcttatattactgatagggaaaaactaaaactaataaatggaagttgggattattttaaaattgtgtgcagaatttaaatcttccttcctatgttcactgattttttaaatcttttttgtagctaacagactgttttccacatcacagatattcaaatatttgaagaaaaatttctttctcttacaaatcatctcttaaacaggctcagttttagtaattattggttatatgatgaagcttcttaatttttcacaattattggtaatttttctggttgaatttgaatggaccagtccctctgaaaacacataatacataaagtaacaattatagaactgtagctttatgatgagagagaatggcttgtgcccctccctccccatgtgtgcttattattatattgttttttagttcccccacttccaaattactcttgaggtgtctgggttaaatataagactgggattgattgttggcccagttatccatttgttacaaagttttatgatagctgtatggtctgaattgaattattgctctagaaactgccagctcattaatttttctttttaaaattttttcaatgttatgatttatttacttgcaacttttttcttgctttttctttttgattttctttagtttttatttttaaaaattttatattacagacaaacagaaacttcttcctttcatctttccattctctgatttatgatgaatttactttcctttggcctggcatttgcttcagcaggcagccttccttcaagtacctccctgattgatgtataatctttgatatcttccattagcctccaggatcactaagttcaaggcccctttggaacctaaggagccctgccgaggagctgaaggccttcagagtccttggggtgattgacaaggtaattcttcagtgtctcttcaagagttcagtcataaatcgactgcatgctgacattctgtctttgaagctttggatcttaaggatatgaaacaaaaggagaaaatgactcaaatgcatgtgcactttacaataacaaaagcaaaagagaaaaagcttttatctgagcaattcatgtaaggtcatgcaaaatatatttgagctaaaggagaaggcgcatatttgttggcattcagttgagtaaggggtttggttttatagaagtgttatagcagagtaaagatgtattgtgttaataacaattgtgagccagtagttgttcaacattaattaatacggtcattgtaatggtcaaaaaagtggaatccccttgtaattaccatttactgagcacctactatatgtcggaccctatgttaggcattttatatgatacaatctttcttacaattgtatttgcatcttggtggaaaagtgatgtttagagcagattaaataacttggcccaaagtcacatagctaatttaggatggtgctgggatttgaacattactttttttgactcaaaagctgtactttttctagtacactaacccctcacttcacacccacatgcattttaattttaggggtaaaaatactggcctcacagagttatctgccattgtgtatgtgcaaatttggtgacatctcacgccaaatattaacagtactgttcctatcagatggtttacaagtgtaatttaaaagccacagacaacaaaccatgttttaagtatatttgctcaaccaccgctttaccattcaaagtaaataaaatgctttatttaatattaagggataggttaatttagatattttttcaccattaaccattttttatgaagcaccttaatgttcatttttaacttactatacattatttgtgaagtatgcgtgtgattccatcctaaaattgagcaatatgtagtattctctagcaatttagacagtaaaagtttgaagcattccaaagggaacattaagttggatattacataaagctgtcggtgtcttaagttctggcaaggatcatttttctcaaattcatattactgaattttgaacttaaaaaattctaagtagtaggatttttctttttttaagagcctgaaatattttcataaccgtgttttctgtggcttttccagtttggaaaacattcagtttgagagtagatgaagacaatatagtaattgagtagtttctaggttctcagatttctttgcaggcaagtataccttcttgaggtacagtgtctgccccctctcttagatctatttctttgacaaagtatggcctttcattgctatgctataagtgtgagtaagttaccttgaagtcctagtaatagctagtagtctcacaggtttgtttaaataagggcttttggctgggtgctgtagtttgcacctgtaatcccagcactttgggaggccgaggtgggcagatcacttgagcctaggagtttgagactatctgggcaacatggtgagaccctgcgtctacaaaaaaagaaaaagctgggcatgtagtcccagctgctcgggaggctgaggggaaaggatcccctgagcctggggagtttgaggctgccgtgagccgtggtcatgcctctgcactccagcctgggtgacagagtgagactctgtctcaaaataaataaataaataaataaataaataaataaataaataaatatcaagtctttaaaaaaaaaggaaaaatgctgggtgtggtggctcatgcctgtaatctcagcactctgggaggccgaggccagtggatcacttgagaccaggagttcgagaccagcctgggcaacatggtgaaaccccgtctctaccaaaaatacaaaaaattacctgggcatggtggcacacacctgtaatctcagctcctctggaggctgaggcaggagaatcacttgaacctgggaggcagaggttacaatgagccgagattgtgccactgtactgcagcctgggcgacagactgagactctgtctcaaaaaaacaaacaaacaaacaaaaaaaaacacaacaaaacaggaaagaaagaaagaaaatagaaggacttttgacagtagaagaattcctaagttctgctgagggataatttggtactgtctttacttactctgtttagctgggaaaaatgtttggtgtttagaaggtgacatttaacttttttttttttaattgacagaatctcattctgttgcccaggctggagtgcaatggcacaatcttggctcactgcagcctccgcctcgtgggttcaaacaattcttctgtctcagcctcctgagtagctgggatttataggcacacaccaccatgcctggctaatagttttttgtatttttagtagagacagggttgcaccatgttggccaggctggtttcgaactcctgacctcagatgatccactcgcctcggcctctgaaagtgctgggattacaggtgtgagccatggtgcctggcctaacttttcttagtagagataagggaatatgtatttggggaattaagaagctttgggaattaataagtctttaaaatttataacatattcctgtgaaaacataagtaggtataggccgggagctgtggctcatgcctgtaatcccagcactttgggaggccgaggcgggcagatcacctgaggtcaggagttcaagactagcctagccaatatggggaaaccccatctctactagaaatacagaaattagctgggcattgcggtgggcgcctgtaatcccagctactcgggaggctgaggcaggagaattgtgtgaacccgggaggtggaggttgcagcgagccaagattgcaccactgcattccagcctgggcaacagagccagaccctgtctcaaaaaaaagaggaaaaaaaaaaaaagcaggtacattttttgaaagttgaactgttttttaaagataagttactttctgttgtactgaggactacctaaaatttgggttttagaaacttgaagtatggaaaataaatgttgaataaattcaaaaggttagaaaatagccaggatatattgatctagtcctacagaacacagtttctttgattctgtttcattacagtatttggtttttatgagttattttgagtgctatctattaacctaggaaaaatacagttctgaattgaactgcattaggattaggatttcacaaacttttatgtagaaaaaaataaagcagattttttattaatatctagactgtaagctctgtgaaaacaaaattgtgtctttcttggtcaccactatgttctcagtacctagaatcgcttggcacataatgggtgctcaataaatatttgttgaataaatgaattgaaacttaattaattttaaatatatatagaatgacatctactggtacaatatgagactgctacctggtacgattgtatgaggtgacaactcagaaagtgtttacccagagggatagtaattccatagctgtatgttgatttagtattcaaagagaagtaaatgactttctgttcttcaattgggattataaaatccctcattaacatagatatgcaaaaattgtatatgaagaatagccagaaaacaaggaaatgtttaacctgattaaaaaaaaatgtgtagtcttcaaatagttgagggctgtcttgaataggggaactgtataatgttttctctaatcttgagggtgaaaagggctattaattgtgtcagaacaacaagtgcaaactaaaatcatctcagttaaaccaggaagtctggtttctctgtgaaaaaggtagttagggaagagacttgcatgctaatatcctcataggatataactagaaccaaattagtacaaattcaagagaaacaaattattgctcatgataagaaataccttttgagaattagcatattgaccaaaggtgtgctagattcctttagatcttaagagtttcttgtcatttgagacattcaagtgaaggctgaaagattgatcattgggatgctatagaatgaactggatggaattttacattagataacttttaattatttctttgatcctgcaggtttatttacatagtctttgtgtagcaatagcaggggagagaagaaattagcggaaaaaaaactctgatgggatgaggaggatgcattactattattttaatataagtttttatagacatgggtgcaattctttttgttgtatttgtgtggtacgaatatacgggatgtgcttatatttgtatgtgtataaagattgtttatatatggtaatttgtaattgggttagaagagtctagattggtagtttggtagtagaatgcccaagtgctaagagagtttctgagaaagatcactgttgtataacttctctataaaaagtataaaggagcccatagtttagtatacagtaacgtaccaatgttactttcctggttttgatattgaattagaactatataaggtgtcaccactgggggaagctgggtgaagggtacatgagactctttgtactgcagcctcctgtgagttaaaacaagaaaagggtaaggggaacattgatgacttgaaacccagagtatactaagatttgattccctcatggccagttaactcttctggtttgtgagtagcctgagtcattctgtgtgtacatgtgtgtatggtattcacaaggaagatcggtgaagatcgtatatctggatcgcccaaatttattgtcactgaaaaacaacttaaatatgctttgcaagtcatcgttataagagatgccacacactttgtaagtctatgactatttactaggtcagatgccttcacattttgtaatcaagatagcttcccaactttatctgatgcctgccaggcagaattcttaagttgacttgccattggaaaaatgtaggcatttctattctgtagctaaaatataattgagaaaatgtgtggaaattgctcaaattgagtagctgttgaaaaactggtacttattttttaaggtacctaagtaatatcttctctgataatatgtggaaaaacatgtatttggaacacagaagcatcaatattcaggtatttgctcattaagggaacactggattgaactggattaaatcaaaaggacatagcacaacattttttaagtgctaaaaggaaagaactatcaaccagaattctatatcctgtgaaaatacctttcaagagttaagggaaaataaaggtattctcagatgaagaaatgcaaagagaatttgttgctgaccagcctaccctaaaagaataaagtgcattctctaaacaaagtggaaacaatacatgcaagaatcttgtcacgttaggaagaaagaaagaacattggagagggtaaaatacaagtaaatacaatggactttctttctctttagttttggaaattatcttttatggttgaagcaaaaattctaacactctctgatgtagttctaagtttatgcagagaaaatatttaaggcaattataaatgagggagagtaaagggacataaaggaaggtaaagtttttatgcttagcttgaaatggtaaaatgatgacaccagtagtttgcatgagttatgtatatataatataactagagcaaccactaaaaagctttttaaagtatacactaaaaaatgctatataggttgggtgcagtggctcacatctgtaattccagcactttgggaaactgaggtgggtggatcacctgaggtcaggaatttgagaccagcctggccaacatggtgaaaacctgtctctactaaaaatacaaaaattaaccagcatggtggtgcacgactgtagtcccagctactcaggaggctgaggcatgagaatcgcttaaatctgggaggcaaaggttatagtgaaatgagatcatgccaccgcactccagcctgagcaacagagtgagactccatctcaaacaaacaaaaaatactgtagataaaccaaaatggaattctaaaaaatgttcaaataacccacaaaaattcaggaaaatggaaacagagagaacaaacagaacgcaaaatataacatgcaaacttaagccctaacacattataaatataccagttaaaaaaacagagattgatattggtttaaagatatgacccaactttatggtgtttataagaaactcacttcaaacataatataatgagatatatatatgatatatatacatatatcatgatacatatatatcgatatatatgatatatatattttatatatcacatgtttgaagtgagtttcttatatatcatgatttatatatcatgatatatatgtatatatatcatatatgatgcatatatatgacgtatatatcatatatatatcatgatatatatcatgtttgaagtttcttatatatcatgatatatatatatgtaaaaagtaaaaggatggaaatgacatgtcatgcaaacattaaagaaaacaggagtggctatattaatacaagataaaatatgcttcataccaaagaaaattatgagagacagagaggacattagataatgataaaaggacaatctaccaagaagaaatagcaatcctacaaatgtatataccagacatcagaactgtaaaatatatgaagcaaaagctgatagaaagtgaaaggagaaataggcagttacaggtggagacttcaactgtctcaaaaactgataaaacggttagacagaaaatcagcaacaatacagaagaactccataataccatcaaccaacaaaatgtaactgacttttatagaacactctacctaagaacagcagactacacattcttttgcagtgcccatggaacagaccatttctagggccgaaaaacctcaacaaatttggaagtattgaaatcatactgagtgtgttctctgaccatgtctgaatcaaattattaatcagtaacagaaagataacaggaaactcgccaaatacctagaaacaaacagttatactactaagtaattcatgggttgaagaagaatctcaaagggtattaaaaaaaaatgcatatagttgaatgaaaacaaaagcagaacataccagaatttatgggacacagctaagccagtgttcagagagaaacttataacactaaatgattatatcagaaaacaggaacagtcaaatctaggttcctaactcaaaagaactagaaaaagaacaaaataaacctaaagcaagcaggaggaatgtaaagagcaggaagcaatgaaattgaaaataaaaaaccgtagacaaaaatttttgcgtaaagctggttcttttcaaagatcaataaaattgataaacctctaacaagagagacaaaaaagagaatacaccaattattactgtcaggaatgaaacaggtatggatcttgcctacatcaaaaggataacaagggaatactacaaacagccctacacatgtaaatttgataatttagatggaatggaccaattcatagaaaagtacgaattaccacccaaaataaatagataatttgaatggctctttaactattaagggaactgaatttataattaaaatactactaagatgaaatcttgaggctcaaatagtttcaccagagaattctaccatacttttagagtcaacaccagttttacacattttcttcctgaaaatggaagaaagagaaacagtttccagttcattttatgagaccagtattactctgatatcaagacattagaagaaagaaaactatagaccaatattctcataagtgtaggtatagaaaccttcaacaaaatattagaaaatagcaacaaaatctaaaattaattctataccatgaatttattatttaaattcatttaaattcattaatttcattaaattcatatttatcttttcaagaaaaccaacttttcatttcattgatcttgtattttttttttgcctcaatttgatttatttcccctctgatctttattttcttctacaaatttgaggtttggtttgttcttactttctagatccttgaagtacatcattaaattatttgaaatttttcttttttaaaaaaattgggcatttattgctataaacttttctcttagtgctgattttgccatagcccacagattttggtatgttgtatttccattttcatttgtttcgagaagttttttaattttctcaatttcttcattgacccattggtcagtcaggagcatattgtttaatttccgtgtgtttctgtatttctgacgttcctcttgttattgattttgtgttttatcccattgtggtcagaaaagatgcttgacatgatttttttaaaaattcgctcatacttgttttatggcctattttgtggtctgttctacagaatgtaccatgtgctgatgagaagaatgtgtattttctaactgttgggtgaaatattctgaaaatgtcagtaggcctattagatttagtgtgtagtttaactctggtttctttgttgatttgccgctggatgatctgtccattactgagagtggcagttagagtctgctactattattgtattgcaatctgtcttttctttattagatctattatgtttattttatatgcttggttttacaatcttagatttgtagtctgttttatctaagtagagctactcctgtgcttttttgttttccagttgcatagaatatctttttccaccccttcactttcagtctatgtgtctttataggtagggtaggtttcttgaagacagcatatagttgggtcttatttctttattcagccactctgtgccttttaattagagaattaaggcctggcacagtggcttatgcctgtaatcccaccactttgggaggccaaggtgggcaggatcacctgaggtcaggaatttgagaccagcctggccaacatggtgaaaccccatctctactaaaaaatacaaaacttagccaggcatggtggtccatgcctgtaatcccagctacgtgggaggccgaggcaggagagtcacttgaacccaggaggcagaggttgtagtcagctgggattgcgccactgcactccatccagcctgggtgacagagcaagactctgtctcaaaaagaaaaaaaaaatttaaattcagtattattattattattgataagtaaggacttactttattttaacaatcttttttttttcctgcttattttctggttattttgacactcctgtcttttttcttgtcttcctttgtggttctgtctgtctttgtgggtaagtacttttctctggtagtatgttttaatttgtagctttttattttagggagtgtcttatgggttttgtgctgtggttgccagttaccatgaggcttacaaaaaatatcttacaaatataacaagagacagttcatcttaggtcacaaataataagaatagaaacaaaggcaaaaaaaaaaactacacaaaaataatctgcagtttaacatcatcacccccacattttgagttttagttgtctcacttttcattttctatattacctgatttgataaaatcaggtaatttgataaaatcagtggattttgcatcactgttaacagtagtataggattctgggtttgtttatatacttaatttcaccagtgttttttctttttttttttaaaccttttttttttccccttcaaattgaagaactccctttagcatttcttataatgtagatctgatggtggtgaattctttcagctttagtttgagaaatagtttctctctccttcatatctgaagtataattttgctgaatacagtattctcggatggcagttttatttttggtttgttttttaagcactttgaaaatgttgtttcactcttgtctgcgtggtttctgttgagaagtcttgtcagacaatgtggaggtcctttatatgttatttgcttcttttctcttgttgtttttaggatcctctctttgcccttgacctttgagggtttgattattatgccttgaggtagtcttacttgggttgaacctattttgtgttctgagatttttttgtatctggatatgtatatctttcggaaaaatttctgttatttctttgagtaagcattctagcccttggtgttgctcagctccctcttgaacactaataattcttagctttggtcttttgagataatttttaatatcttataggcagcttcattcttttctactcttcttttttctcttctgatcatgtattttcagatagccagtctttgagctttccagttctttcctctgcttcattcatctgctttgagagcctccaggaagttcttcagttcagcaaatgtgtttctcagttcgaagacttctgtttgattttttgtttttcagacagcgtctcaccatattgcctaggcttgactgcagtggcacaatcatggctcatttcatcctctattgcctaggatcagtgattctcccatcttagcctccggagtaactgggaccacaggcttgtgccaacatacctggctaattttttttgtagagatgggggtcttcctatgttgcccagactggtcttgaactcctgggttcaaacagttctcctgccttggcttcccaaagtgctgggattataccatgcctagcctctgtttgattttaaaagattatttcagtttcttttttttaaatttttttcttcttcttcttttttttttttttttgagacaggatctcactctgtcacctaggctggagtgcagtggttcttggctcattgctgcctccacctcccaggttaaggtgattctcgtgcctcagcctcccaagtagctgagactacagacatgcgccactatgcctggataatttttggcatttttagtagagacggggtttcaccatgttggcctggctggtcttgaactcctggcctcaagtgatccacctgcctcggcctcccacagtgttagaattataggcatgagccactgtgcctggcctaatttcttttttaaaatttctttgataaatttttgagttgcttttgtatgttatcttggaggtcgctgactttccttataactactattttgaatttgtggttagagaactcacaaattgctttcttgttaggatcagttgccggatttttgttttgtccttttggggaggtcatggttccctgtttgctgttgtttcttgtgggtatattttatgtctttgcattgaaggatagttattaatagatatttatagaatagttatttattctagttttttttctgtccatcttgttttggtttctactggatatatttgcttagtgaatctttacatctaggtaactgcctctttttagctctaggaggtaccttaagcttgggttgacctcagctctggtaaatgatcagagtgatgcctgctctgaaggtgagaggtcccaaagggattaggctggcagtgtgttaaggctagctagaggtttgtgcccaggagtccatacctcttctgctgagcagcctctcagattgggcatctctgtttgctgagtagcagagcagactttccagggttgggggtgatagtcccacctcctgtctttgtctctgcctgtcctcaggagtatttctccctttaggcagtcacgatgcttcccatggattaaggtggggacaagtctcctgcttgggaacccaagatgttggggaacctggatgaccccctcagtcttaccttttacagttatagaaatgtagttgggtggagggagggtgagattttctgcttggtgccaggcagaatggagggggaggggtgtcacagatgtggaggtctgattcccttgccatctgttcagagttgttttttgtttgtttgtttgtttttttcttacttctccacggccccaggaattatctcattctcatatttgaattccatgttgttactggtaaaaatcttggcacttacatatttgtttgtttgtttgtttttctattggagaggggggcgtgaaaacagcttgcacttatatttctatgtatgaacaatgcacacataaaaactggaattaaaaatacaatacctttataataatattgaattactagatgtaaatataacaagacataggagcttttatgctgtaaacttcatagcactgatgaaagaaatcagaggtctgaattattggagaaacatatttattagcagactcaccatagatgtaaattctttccaaattgatacacagttttaaacagagtttctatcaaattttccgcaaggttttttttttttttaaatgtaaatatagacccgattattctaaaacttatttgggaagttataggaactataatagctaaaatagttttcaaaaaagagtaaggtgggagagtcactctgtttgatttcatgactttacagtaatcaagattttgtggtgctggtatagagacacacacatagagaacagcatacaaaatgtagacatagtcccacaaatatggctaattgatttttgacataggttcaaatcagtataatgtaggaaggttaatatttccaacaaatattgctagagtaactgggtattctctagcaataaaagtgtaccttggccaggcatggtggcttacgtctgaaatcccagcactttgagaggccgaagtgggtggatcacttgaggtcaggagttcgagaccagcctggccaacatggtgaaaccttgtctctactaaaaatacaaaaattagccaggcgtgatgatgggtgcttgtaattccagctactccggaggctgaggcaagataattgctttaacccaggaggcagaggttgcagtgagccgagatcatgccagtgcgctccagcctgagtgacagagtgagcctttgtctcaaaaaaaaaaaaaaaaaaaaagtgtacgttgacatatcctcacacttcttaaattttttttatttttaatttttgtgggtacatagtaggtgtatgaatttatgggttatatgagatattttgatacagggatgcaatgtgtaataatcatatcaagggagatgggtatccatgccctcaagtatttattctttgtgttacaaataatccagttatattcttttagttatttaaaaatctgcaattaagttgttattgactatagtcattctgttgttttatcaaattctagttgttattaattctattttttgtacccattgtcccttcccacttccccttccgaaccctacacgatcctttccagcctctggtaaccatccttctactctctgtctccatgagttcaattattttaatttttaactcccataaataagtgagtacatgcaaagtttgtctttttgtgcctgacttatttcacttaatgtaatttgacctcagcttctatccatgttgttgcaaatgactgaatctcattcttttttatgcctgaatagtacttcattttgtatatataccacatttttaaaatccgttcatctgttgatggacacttagattgcttcaaatcttggctattgtgaatagtgctgcagtaaacatgggagtgcaagtatttctttgatttattgatttcctttcttttgggtatatacctaagagtgggattgctggagggtaaggtagctctatttttaggtttttgtggagcctccaaactgttctccatggtggttgtactaatttagatttccaccaagagtatgagggctcccttttttccacatccttgccagcatttattattgcttgacttttggataaaggccattttaactggggtgagatgatgtctaattatagttttgatttgcatttctctgatgatcaatgatgttgaacagctttttatatgcctatttgccatttttatgtcttctttttagaaatgtccattcacatcctttgtccatgttttaaattagacttagattttttcctatagagatgtttgagctccttatatattctggttattcatcccctatgagatgggtaggttgccaatattttctttcattctgtggattgtcccttcacttttttgattgttttctttgctgtgcaaaagctttttgcttgatatgatcctatttgtccatttttgctttggttgcctgcgcttgtagcgtattactcaataaatttttgcccattccaatgtcctggagagtttcgccagtgttttcttttagtttcatagcttgagggattaaagtctttaataatcaattttgatttgatttttgtgtatggtgagagatagggattcagtttcactcttttgcatatggatattcggttttcccagcactgtgtattgaagaggttgtcctttccccagtgtattttcttggcaccttttgtcaaaaataagttcactgtagatatatgactttatctgtgggttctctattctgttccatgatctttgtgtctgtgtttatgccagtaccatgccattttggttactatagctctttagtataatttaaagtaatgtaatgtgtttcttccagttttgttgtttttgcttaggattgcattggctattctgggtctttgtggttatatataaattttaggattgccttttctatttctgtgaggaatgccattagtattttgataaagattgcattaaatctgtagattcctttagtgtagttattttaacaatattgattcttttaattcatgaacatggaatatctttccctttttttgtgtgtcttcaattttcttgcatcagtgttttatagttttcatcgtagagatctttcacttctttggttaattcctaggtatttaattttatttgtagctattgtaaatgggattactttcttgatttctttttcagattgtttgctgttggcgtatagacatgctactaatttttgtatgttgattttgtatcctgcaattgtactgaatttgtttgtcagttgtaatagttttttaggggagtctttagatttttttcaaatgtaaaatcatatcctctgtaaacaaggataatttgagttcttccttttcaatttagatgctctttatttctttctcttgtctgattgctctagcaaagacttctggtactgtattgaataacagtggtgaaaatgggcatccttgttatattctcgatcttagaggaaaggctttcagtttttcccccattcagtgtgatactagatatgggtctgtcgtatatggtttttattatgttgaggtaagttttttcttcttttttttgagatggagtcttgctctgtcgctcggctggagtgcagtggcatgatctcggctcactgcaacctccgcctcccatgttcgagcgattctcctgagtcagcctcccaagtagctgggactacaggcacgtgtcaccatgcccagcttatttttgtatttttgtagatctgcccgattcagcctcccaaagtgctgggattacaggtgtgagccactgcacccagctgaggtaagtttcttctatccccagttttttgagggtttttatcatgaagggatgttgaattttgtaaaatgcattttcagcatcagttgaaatgatatgggttttgtctttcattctgttggtatgatgtatgacattaatttatttgcatatgttgaatcatccttgcttccctgggataaatcccacttggtcatgatgaatgatctttttaatgtgttgaatttgctttggtagtattttgttgagtatttttccatcagtattcatcagtcatgttgttctatggttttcttttttttgatgtatctttggttttcatatcggggtaatactagcctcatagactgagtttggaagtattcccacctctgtttttcagagtagtttcagtaggactggtgttctttaaatgtttgggataattcagcagtgaagccattgggacctgggcttctcttgctaggagactttttattatgctttcaatctcattacttgttattgatctcttcaggttttggatttctttatggttcaatcttggtaggttgtatgtctctaggaggtttgtcaatcttgtttaccttttcagaacaccaactttttggtttgttgatctcttgtattgtttttctcatttcaagtttatttctgctctaatctttattatttcttttcttttaattatgggtttggtttgctcttttctggttaagatgcatcattaggtggtttattttacatttttcttttatttttgatgtagacacttccaggtgtaaactgccctcagtactgcatttgctgtatcccatagattttgggatgttgtgtttccattatttgtttcaagaaatttttcagtttttttcctcagtttctttgtggacccactggccattcagaagcatatttcttaatttccgtgtatttctgtagtttccagaaatttctcttgttactgatttctagttttattccattgtggtcagaaaagatgcttcatattattccagttttttttttttttaactgttttgagacttgttttgtgacctgccatatggtctgtccttgaaaatgatccacgtgctgaggcaaagaatgtattttctatagccattggaaggagtgttctgtaaatatctgttaggtccatttggcctataacacagattaaatttgatgtttcttttttgattttcttttttcttttttctgagtcagagactcgctctgttgcccaggcagcagtgcagttgcactatcttggctcactgtaacctctgcctcctgggttcaagtgattgtcctgcctcagtctcatgattagttgggattacaggcacatgccaccatgcctggctaattaattttgtatttttagtagaaatgaggttttaccacattggtcaggctggccttgaactcctgaactcaagtgatccacccgccttggccacccaaagtgctgggcttacagacgtgagccaccatgcctggcctctttgttgattttctgtctgaagtatatgtctgatgctgaaagtggggtattgaggtctatagttttttttagtttttatttttattttttctgatggagtctcactacgtcacccaggctggagtgtggcggcaagatctcggcttactgcaacctccacgcttaaacgatcctcccacctcagcctcctgagtagctgggactataggtgcgcaataccatgcctagctagctttgcattttttgtagatatggggttttgccatgttgcccaggctagtctcaaactcctggattcaagcgatctgcccatctcagcctccaaatgtgctgggattggaggagtgagccaccatgcccagcctacggttattattgttttggggtctatttcttcagctctaataatatttgctttatatatctgggtgctccagtgctgggtgcatatatatttacaattattacatcctcttgctggattgacccctttatcattatataattacctttgtgtcttcttatagtttgtcttgaaatctattttgtctgatgtaaatatagctacttctgctctgcatggtttccattggcatggagtatctttttccatctctttattttccgcctgtgtgtctttataggtgaagtggttttcttgtaggcaaagcagcattgggttttttaaaatccattcagccactctgtgtcttctcattggagagtttaatctgtttatgttcaatgttattgttgatagtttaggacgtacttctgccattttgttttctggtgattttgtggtctttccttttttccttccttcctgtattcctgttagtgaatgtgatttttctctgatggtatgatttaatttcttgcttcttactttttgtgtatctatggtaagttttttgatttgaagttaccaggaggcttgcaagtactgccttataacccaggggtcccccatccctgggccacagacaggtgtcactctatcgcctgttaggaaccgggcctcacagtaggaggtgaacagcaggcaagtgagcatttaccacctgagctctgcctgctgtcagattagtggtaacactagattctcataggagcgcaaaccctattgtgaactgtgaatgcgagggttctaggttgcgtgctgcttatgagactcttaatgcctgataatctgaggtagaacagtatcatctcaaaaccatgccctacatgtaccccctgtccccaagagaaattgtctgaggtggaacagtttcatcccaaaaccattacccccactagtctgtggaagagttgtcttccatgaaactggtccctgatgccaaaaaggttggtgactgctggtttatataacattcttaaaatgacaaaattatggaaatggagaacagatctatggatgccagtgtttagattagagatggtggaggagagaagggtgtgtgtgtgttagggggtgatttgcaagggatagcagcagggagaggtttgtggtgatgcaacacttttgttttttaattttctagtttttttgtttttgtcccttttggagaaaaggcaaacacatttatttaacaggagaatcacagagtgagcatcctggtggaacacttctgggtcttgattgtgcttgtggttatgagaatgtatacaattgataagatgacatagaactattaatatgtacacacataataccagtgtcaattttctgcctataatagtatactgtagatacatacaatgtagcccttagagaaaacttaatggaaggtacgtgggaattttctgtacaatgtttgcaactttctagtgactctacaattatttctgaaataaaaagttttaaaaattcgtaacgtgtttattggtctgtcttttaaaattatttcaatagtttttggagaacaggtcgtgtttggttccatgaataagttctttagtggtgatttctgagattttggtgcatctatcacctgagcattgtatactgtacccattgtatagtcttttctccctcactgcccttccagcctttctcctgagtcctcagaggtcattatatcatacttatactgttgcgtcttcataacttagctcctacttataagtgagaacgtatgatgtttggttttctattcctgagttacttcacttagaataatggtctccaactccatccaggttgctgtgaatgccattattttattatttttatggctgagtagtattccatggtgtgtgtgtgtgtgtgtgtgtgtgtatatatataccatattttctttatctacttgttggtaatgggcacgtaggctggcttcatatttttgcaattgcaaattgtgctgttataaatgtgtgtgcaagtgtcgttttcatataatgacttcttttcctctgggtagatacccagtactcaggttgctggatcaaatgttagttctactgttagttctttaaagaatctccatgctgttttcgataatggttatactagtttacatttccactagcagtgtagaagtgttcccttttcaccacatccacaccaaaaaattatttttttttgattttttaattatggttattctttcaggagtaaggtggtattgcattgtggttttcatttgcatttccctgataatttgtgatgttgaccattttttcatatgtttgttggctatttgaatatcttcttttgagaattgtctattcatgtccttagcccactttttgatgggattatttgtttttttcttgctgatttatttgacttccttgtagattctccgtattagtcctttgtgggttgcatagtttgcagatatgttttccccctctctggcttgtctgtttactctcctgattatttcttttgctgtgcagaaatttttagtttaactacatcccatctatttatctttgtttttattacatttgcttttgggtacttggtcatgaactctttgcctaagctaatgtctagaagagtttttctgatgttatcttctagaatttttatggtttcgggtcttagatttaagtctttgatgcatcttgagttgacttttgtgtaaggcgagagatgaggatctggtttcattcttctacatgtggtttgtcaattatcccagcaccatttgttgactagggtgtcctttacccacttcatgtttttgtttgctttgttgaagatcagttggctgtaaatatttggctttatttctaagttccattggtctacatgcctttttttgtttgtttgttttgagatggaattttgctctcgttgcccgggctggggtgcaatggcgcgatctcggctcactgcaacctccgcctcctgggttcaagcaattcttctgcctcagcctcctgagtagctgggattacgggcatgtgccaccatgcctggctggtttttgtatttttagtagagacaggatttctccatgttggtcaggctggtcttgaactcttgacctcaggcgatccacccgcctcagcctcccaaagtgttgggattacaggcatgagccaccgtgcccggcctctacatgcctgtttttataccagtattatcctgttttggtaactatagccttgtagtacagtttgaagttgggtaatgtgatgcctccagatttattctctttgcttagtcttgttttggctatgtgagctcttttttggttccatatgaattttaggactctttttttctagttctgtgaagaatgattatggcattttggtgggaattgcactgaatttatagattgcttttggcaatatggtcatattcacaatattcattctacccgtccatcaggataggatgtgtttccattttttcgtgtcatctgtgatttctttcagcagtgttttgtagttttccttgtagagatctttcacctccttggttaggtgtattcctaagtatgtatgtatgtatgtatgtatgtatgtatgtattttttgtagtcgttgcaaaaggtgttgtgttcttgatttgattctcagcttggtcactgttggtgtataagtgctgctggtttgtgtacattgattttatatcctgaaactttattgaattcatttatcagatctaagaactttttggatgagtctttagggttttctaggtatatgatctgtctgttttgtctgctatataagtagttactcctgcttactttcggctttcatttgcagggaatacctttttccatcccttttccttaaatttatgtgcgtccgtatgtgttaggtgagtctcttgaagacaacagatacttggtggatttttattcattctgccattctgtatctttcacatggagcatttaggccatttacagtcgatgttagtattgagatatgaggtattgttctattcctgatgctagttgttgcctgaaaaccatggccttttttttcattgtgttacggttttataggccctgtgagatgtatgctttaagaaggttgtattttggtgtatttcgatgttttgttttaagatttagaacttttagcatttcttgtagtgctggcttggtagtggcatgttctctcagcatttctttgtctgaaaaatactttatctctccttcatttatgaagcttagttttgctggatacagaattcttggctgataattattttgttcaacaatgctaaagatagaaccccatttccttctggctaatagaatttctgctgaactatctgcttttaatctaaataggttttcttttataggttacttgatgcttttgcctcacagctcttaatattgtttcctttgtcttgactttagataacctgatgactatgtgccttaggtgatgatcttttgcaaccaatttcccaggtgttctttgagcttcttgtgtttagatgtctagatctctggcaagcctggggaagttttcctggattattccctaaaataagttttccaaacttttagatttctcttcttcctcaggaatgccagagagagtaggagggaggaaggaagaaaagatacaaaatgtcaaaactcaaatgggaagaatagactactgagtaagtatgtatattttcaagaaactgaatcaataattaataaccttccaaaatagaaagcaccaggaccagatggttttactgttgaattttaccaaatgtttacagaataaattatatcagttatctgcaatctcttctagaagacagaagtagagggaatacttctaactcattatatgaggccagcattattctattaccagtttttaaatttacccaaataaaattaaaacttcagtcccctcaacatacatccacccaagactgaaccaggaagaagttgaatccatgaacagaccagtaacaggtcctgaaattgaggctgtaataaatagcctaccacacctccccatcaaaaaaagcccaggaccagatggattcacagctaaattctacagatgtacaaagaagagctggtatcattcccactgaaactattccacaaaattgaggaggagggactcttttgtaactcattttatgaggtcagtatcacccttataccaaaacctggcagagatacaacaaaaaaggaaaacttcaggccattatttttgatgaatatcaaggcaaattcctcaacaaaatactggcaaattgaatccagcaccacattaaaaagcttatccaccacgatcaagtaggctttatccctgggatataaggttggttcaacatatgcaaatgaataaacatgattgattcatcacataaacagaactaaaggacaaaaaccacatggttatctcaatacatgcagaaaatgcttttgataaaattcaacatttcctcaggctaaaaactctcaataaactaggtattgaaggaaatacctcaaaataatacgagccatccatgacaaactcacagccaacctcgtcctgaatgggcaatagctggaagcatttcccttgaaaactggcacaagacaaggatgccctcccttgccactcttattcaacatagtattggaagtcttggccagggtaatcaggcaagagaaagaaataaagggcattcaaataggaagggagtcaaattatccctgtttgcacagtgctatatctagaaaaccccatagtctcagcccaaaagcttcttaagccaataaacaacttcagcaaagttgcaggatacaaaatcaatgtgcaaaaatcactagcattcctatacaccaacaacagtcaagccacgagccaaatccagaatgtaatcccattcataattcccacaaaaagaataaaatacctagggataaagctaactagggaggtgaaagatctctacaaggagaactgtaagccattgctcaaataaatcagaggtgatgcaaacaaatgggaaaacattccatgctcatggataggaagaatcaatattgttaaaatggccatactgcccaaagcagtttatagataatgctatttctattaaactaccattgagattcttcacagaactagaaaaaactattttaaaattcatatggaaccaaaaaggaacctgaatagctaaggtaatcctaagcaaaaagaacaaagctgtaggcatcatgctacatgacttcaaagtatactacaaggctacagtaaccaaaacagcatgatactggcataaaaacagatacatagaccaatggaacagaatagagaacccagaaataagactgcatacccacaactatctgatctttgacagacctgacaaaaacaagcaatggggaaaggattccctattcagtaaatggtgctgggataactggctagccacatgcagaagacagaaactagactccttccttacaccattttcaaaaattaactcaagatgaattaaagactaaaatgtaaaatacaaaactataaaaacccttgaagacaacctaggtaataccattaaggacataggcactggcaatgattttatgtcaaagatgccaaaagcaatggcaaaaaacaaaaattgacaaatgggatctatttaaactaaagagcaaactttaaactgcacagcaaaagaaactatcaacaaacagaatgggagaaaattttggaaactatgcatccaacgaaggtctaatatccagcatctataaggaacttaaatttacaagaagaaaaaaacagccccattgaaaagtgggcaaaggacatgaacagacactttttaaaagaagacatacatgcagccaacaatcttatgcaggaacaggagaccacataccgcatgttcctacttacaagtgggagctaaatgatgagaacactcagacacatagagaggaactacagacactggggcctgtcagagggtggcgggtgggaggaagaataggttcaggaaaaataactaatgggcactaggcttaatacctgagtgatgaaataatctgtacaacagacccccttgacacaagtttgcctatgtaacaaacctgcacatgtacccctgaactttaaaaaaacaaacttatgttcatacagtatcctgcacaaggatgtttatagccactttattcataattgccaaaatgtggaaacaaccaagttgttcttcactaggtgaatgggtaaatcaactgtggtacatttagacaatggaatgttactcactggtaaaaaagaaatacctatcaagccttaagacatggagaaaccttaaatgcatattactaattgaaagatgacaacatgaagaagctttatattatataattccaattgtatgacttctggaaaaggcaaacccatggagacagtaaaaaggttagtggttaccagatattgggcaggaggtagggatgagtggtggagtgcagaggatttttagggcagtgtaactattctgtatactagaatggtggattgtccaaatctatagaacatactacagcaagatagaaccctaatagaaactgtgtactccagatgataatgagtcattggtgtaggttcatcagttgcaacacatgtgccactctggtacagaatgttcttagttgcggaggttgtgtgtgtttgaggccaaaggaactttttattttctgctcaccatttgtatgaatctaaaattgttctaaaaaatgaagtctgtttaaaaggagaaaaatcaatacagtcactgccatgtttggtgaaaggcatgtggtaccttcaatagtgtgccttcatctaaaattgtgatactatagttgatgttaaaattttaagagatacaggagaaattttgagctgagtgtcccagacagctggctagctattccagatgtgggacagaccactgtgtttctaggtggtttttagtttgcttggggtcaaagtcttaggattacatattatgtgtacaccatgcagaattctaagctctctacataaattatttaatgctctcagacagtttgcagataaaaaacctgaagccagagagcttaagtgttttgtataaacacactaagttacagatcaagggtttaaactcaggtctctttccaaaactatagctctttatcattattcagaactgaatttctttgattattataacatttatattccttctcaacttactgtattacagtatcattattcattaaacttcctttaaaaaatcagtgtgccctaattaatgaatttacaatatgaataatagcatttaaaaaaactacagcagctgggcgtggtggctcattcctgtaatcccagcactttgggagactgaggcaggtggatcacttttgagatcaggagttcaagaccatcctggccaacatagtgcaaccctgtctctactaaatatccagaaattagccaggtgtggtggcgggtgcctgtaatcccagctacttgggagtctgaggcaggagaatcacttgaactcaggaggtggaggctgtagtgagccaagatcgccccactgcactcaaacctgggcgatagagtgagactcagtctcaaaaacaaaaaacaaaccaacaaacaaaaacaaaaaacaaaccaaaaaagacatcagtcaaaaccccctacagtgacaaatagggttaattgaatggctgagttagggtcttattttatccttactagacaccatcattgtgtgttttataaatacctcgatgctttcaaaccattttaaaagacaaaaatattttaattatgattgtatttattgattaaaaaattaaaaatgggaaacatataacattattacgctattctaaatgctctttaatggtctcatagttttctactatgtactgtggtttatttaattcgttctctttaggttgttttcctctttttttctgcctgtgatgaatattcttagaggtcagtcatcttatgttttctttagtatattttttcagagttggagattatgggtcaaacagtatatatgcacattttaaactctccagaaatattacagtgttttaaactcctactagtagtacagattgagtttcctttatctgagatgcttgggaccagaggtgtttcagattttgaagtttttcagacttggggatatttgtattatatatatttactggttgagaattccaaatccaaaaatttgaaatttgaaatgctacaatgagcatttcctttgagtgtcatgtcagttctcaaaaagtttccgattttggagcattttggattttgcattttcagatttgggatgctcaacctgtatgtgagaaggtttacttcctcgtatccttactgacaacatctgccatttgctgatgaaaatttggatttcactgtcattttaatgtgcaattttaattgttaataggatatatttttaaaattttttattgactgtgtttcttcttttatgaaatgcctgttttaagtccttttcctaaatttttttattagaggtttatatgttcttactgaattttcagaagctctttttataagaatatgtaaacttttgtcttgaatatacaggggtattttccttcaagacaaaaattttctgtttcttacatgttcattatagaaaaatcaaacaataagctaaaaaaaggtataattcacctataaccctgctacctactgagaattatttttacattttgatttatactcctgctgtcttctttctgcacatatatacactgttaagggccccattagcctgtgttttcacataaggtcataatgacattaacatataaattataaagacttggtagcttttacctgttaattagcgggatgtccttttctacctttcccatcccggaagtatttctgagagcatggtctcaaataagtttgagaatgaatgtgtgtctgctggaagctcctattcttccgccattttccagtcctccagaagtttcctgatggtccatgtctgaattagacacccctcttctttgttccagttgcacctgtaattcttcagcatagtacttcttaaactgtttttaattgcctctcctccatgctaaactttcagctcttgtagagcacagaccctatctgctgtgttcatggtttttctttatgtctgatatctgtgtgtacatagcaggcattcagtaaatatgtgttgaattgacttttgttgaattttaatactcgattggagagttagacaccttcctatttgcacactttcccatcatacatccaagtatatgtataatgtcaatttcttttatctttttatgattttcctttatggtttgcctttgatgctattaattagtttctttttaataaccagaaagataactttttgtatcctttatttgtagtacaataaagtttgttttccatgttggtattcctgaaaaatctcattttagtattagagtatgctggaatagacaatataaatacctctaaactctcacttatagcagcctaaatctgcacgtgctgtaaggaaaacatttttaaataatttgccattaaacaatttctaatttaattgtcactttttttttttttttttttttgaggcaggatatcactctgtcacccaggctggagtgtagtggtatgattacggcttactgcagtcccgacgtcttgggctcaaggaatccttctacttcagcctcctgtgtagccaggaccacaggtgtatgccagcatgcctggctaattttttaattttattttttgtagagatggcatctcgctttgttgtccagggtagtctcagtctcctgggctcaaggagattcttccacttggcttcccaaagtgctgggattacaagcataaaccacaatgcctggcctcactttttataatggacttaaatcagtttggttgttttaaaagtaccctagcatttagcacatgaatacatctcattttgattagtggccaaagtatttttgggcattgtgagcattgtactactcccaggctgcttatggtatgttatagtatcagatacatctctttggatccatgctctaagtagaattgtgttgtataccttgcttaatccattaaatttttacctgtctgtttgagtatcaccaaaagaaagttgctatcacaatgtactttctactttttaatctactctactgattcattagtacacagccatggtgagacacttgagatgttctgctgaagacaattgttacatattgggattctggaaggacagcaagctagataaagataagtcatgcttttaagagtcccatggaacatcagtcattgtgatgtgaagaaagtgataaggtaatgcatgaagcagtttgagtcactatgatgtggatggtgggaagtagccctcttaatcaaagctttaagaacgaccaagaacctaaggaatagttacttataccaccagattatgcagataatgttaataacaacaaactcatttatatatatagatatatatatatatatatatttcaaaagaatgtagcagtcccataggttttatatatagaatcagcatagtatttgattataattaatgatatcatcttaaggacttcatctaatatacttattttgaaaataagatgcaaccatatatttttgacataaattatagttatttttcttcaattcaatgctttgatattttattctgtatccctatcagttaaatgtatatattatttaaagttaagagtatacaagttaaatatctcttattcgaaatgcttgggaccagaagtgtttcagattttggtgtgttttctctttattttggaatatttgcattatatttaccagttgagcatcccaaatccaaaaatcccaaatctgaaatgctccgatgagcatttcctttgaacatcatgttggtgctcaaaaagttttagattttagaacattttggattttggatttttagatttgagatgctcaacttgtatatacagtgcattctgtacttgcatttgaatactatatttggatttgtgggtgtttttattccaaagagctcaaattcccttagtatttaaagcacggtttcctaacatttttagagatagcattgtatggacacttttataataggacaacctttaagtaattttgaaataaaaggactagtttccttttacctcctagggcttgggttttataatcttaggattagaaagggctttaaggttatctgacccagtgcattacagatcttgtggtctatctacagtgccccattaaatggctcttcagcttcagggccttttatttatcaatttaacaaataccttttgaatgctgccctggggcaggcactgtgttaggtgctggacatattacagtatatcagacatggttcttctttttagtctagttggaaagatataagtaaatacataagttgtaaagcagcacagaagaggccataaaaaagcatgaaaaaagacagagccacttaatgtcacaaagtcatttcattttacacagttcaaagtcttagaaagtccttttttctcttgagccaaatactgcttctttaggtctaaataccgcccttctccagtgatcatctttcagttatttcaagatagttaagttatatttctgattggtattgtttgtatgttaatttcttttatcttgcttaaaattggcctaaattacaatttgttaaatatttttggatcttccttgtacaaaattttttctcttggggttcatatagtgcttctagggccaggtgtggtggctcacacctgtaaccccagcactttgggaggccaaggtgggcggatcacgaggtcaggagtttgagaccagcgtggccagcatggtgaaaccctgtctctaccgaaaatacaaaaattagccgggcatgctgctgtgcgcctgtaatcccagctactcggcaggctgaggtaggagaatcacaactctgggaggcggaggttgcagtgagctgaggtcacaacactgcaatccagcctgggcatcagagtgagactcactatatgtatatatatatagcttctgtggaataaatatgccaccccaaaatacactgctttggcatattttgagatggctattcagaaaagctacagaaagaggaatagctctgaaaagctgtccatttgtgggggagatttgcatccctggtagaaatccacactaggaaagtaaacagcagacagaaatggactttctttgagaatcccttatctgccttatttggatttaggaaaaaactaactcaggaaaagagactgaaggtctgacactgttaaaggtgtgacagagaaactttttcaacaggctaccatctattctttctgagggctgctacctgagagatttcatttgtaatacaaaatagcttttgttcagcttgcatttcctcccctcacccttccacaacctgtaagctatcttcccccactctggagctccaagcccctgactcttttctgtattttctgtatggtataaaaacttcagtcatttgtcccttcttagagtctcatattttgtgtggctcccctgcacatgtgcgtgtttataaatttatatacctttttttttgtttgtttgttttgagacactgtgtcactctgttgcccaggctggagtgcagtggcgcgatctcagctcactgcaacctctgcctcctgagttcaagtgattctcctgcctcaggctcccaagtagctgggattacaggtgtccacctccatgctggctaatttttatatttttagtagagacagggtttcaccatgttggccaggctggtcttgaacgccatacgtcaagtgatctgcctgcctcagcctcccaaagtgctgggattacagtcatgagccaccgtacccggtcttgaataccttttcttctgctaatctgtctattgtcagtttgttttatagacacaaattatcaaaccttcagaagggggaggaattaaaattttctttgctcttgtatgttactttttcccccatttgcgtattcttatatgtatctatctctgtctcccaaccctctgatggaattttaaaatatctctcaagtacaaacacctcaaataatccatcagatatgtggtttcctcagaagcttctcttctggattctttcattattctgctcaagtttgcattggtttcctctcttggcatactacctagctctcctctttatacttccactttttgttattctgggaatctcttcaccagtcttctgtattacttttcaattcctgattctttgtatgtgacttgtttttctcctcctttgcctttctctttggaggcctgtaggattttctttttgtccctggtgttctataatttcacagtgatgttgtggtgtggaaatctttctcattttttgagctgtgtctttgcttatcttttttccatttgggtaacaatctagatgttttgttgggagatcaaacaaatatcagtatctgcatgttttatctcttgggccaattggttttcttagagaagaacctcataatctgctcagggagttagtttaagaccagcatcattgtgggagcccagtggtggaagcaggaatgatgtcctcaccatttggtgtacaggttttcacataatgcctctgttttcagtaccactcttcagtcccacctttagctgtttgtagtatctgtctcattccacatcttcagaggttgaacctttagtcttctgcttgtgtagaaaagggtggctatcttgctggctgtgcagtggcatagagtatatatactttttccatgtcctcctgtttttaggagataatttcaggatatacttaaaatctaaaaccttttcacagttttaagggtaaagtttgaacttcaagctaagcctataaagttctttgtgatctagtccttcctttctctattggttcaacttggttcttccccttctggatgaactaagaccacaccacaacatactatgttggctacagcccgttgaacttggagggatacaaacgcatcacatttcacatgtgatgtacccctctacctggagtgccttcttttccttttcttccacaatttcttattcttaattgttgttttctctcagtagccccgctcactttcatctactgtctgatttaaatatcttttacctgtattcctttaccacctcaaacttatctttgatagtgttaccagaaagggatattgatccaaaccccaagagaggattcctggatttcacgcaagaaagaattcctggtgagtccacagattaaagtgaaagcaagtttattaagaatgtaaaggaggccaggtgtggtggctcatgcctgtaatcccagctctttggtattctgaggtgggtggatcacctgaggtcaggagttcaagaccagcctggccaacatggtgaaactccatttctactaaaaatacaaaattagcttggtgtggtggcccatgcctgtaatcccagctacttggcaggctgaagcaggagaatggcttgaacctgggaggtggaggttgcaatgagccgagatcatgccactgcactcctgtctgggcaacaagagcaaaactccgtctcaaaaaaaaaaaaaaaaaaaaaaaaaaggaatagaagaatgccactctgtaggcagagtaggagcatgggctgcttgactgaggatacttaacggttatttcttgattatagaaactgaacaaggggtaggctattcgtgagttttttgggaaaggggtgtgaatttcccagaactgaatgttcctactctttttagactatataggacaacctacaggcattgccatggcatttgtaaactgtcatggtgggagtgtcttttagcatgctaatgcattataattagtgtgcagtgagcggtgaggacgaccagagttgacttttgtcattatattggttttggtgggttttggttggcctctttactgcatcatgttttattagtgggggttctgtgacctgtatgttgtaccaacctcctatctcatctgtgactaagaatgcctgacctcctgagaatgcagcccagcaggagtcagcctcattttacccaacccctgttcaaggtggagttgctctggtttgaacacctctgacaataatatttatctatattatacagtagtttttgatgttatttctgtgccttttccaataagccttcagatttctgaagtgtacttgaccaagtatacttgttgagtaagtttgaaggtaacaaaaagagacaaaattgtgtcttaacatttcaaataatctgtaaatctgtgcctcaaaatatattacacttgaagcatcagagcaagaggatattacaaactgaaaaccgtccaaacattcctgcttctcctgtttccaccttttctcacagagtgtacctgtagactgttgacagaatactttgttgcagtcgatgaacttgtcaatttgagaatgagtattgtgcctttgtgtttcatatgtgctttaaaacattttggaatttttcagaacatgaacacattgtgttcttatactcaataaattttctaggtcatttaaaaataatgttaaattttaatcaataccagaagtttggctccatctgctacaaaagtacaaactcactgaacacatttaaaaataataacatttaaagcttccttgcccttgaggcattttcttctgaattggaatcaggctacctttgacattggcaacttagttggatatgtattgatcgacttaagaatgttgcttctgtgtctgttatcattatgagagaacatttattaactgtctgactacatactgccctgattctataaacgagaactatgtggatgtatttggtgctttttagggacttattttaagtgtatttatagagcacatctagcagcggacagaaaatattaaactagggtatgaatggacagtgaaatagtttacatcagcatcagagtatttggtttttctagcaaatgcaaataaggaactaaagctaaatacaatagactatacttttaattgaattaattttcatctaaatttaacagtgtcaagttatcatcccaggtgaacttcagaattcaaactagaaaaatagaatacatgtattcattatgggattgaatggcatgagccgaacttgggcctataaaaccagaactttagagttttaacctctctttagcataatccgtttatggccttgggcagattcttcacaaaaacagaaaacagacaatcaaaatgagaatgacaaaggtgtggagagatctagcttttaaagcatttggatctgagaagagcctcctaagtggttgtttcttctagctctttagcaattctgttttaaacccaatttctctgtcttttatattctgccttctgctatatttatatccattttccttacaaagacacaccattgtcctttggaagcaggttttataaagtaatagatgtattggcctagaatttgaaaaattatacaaagtaaaattctttttacatacatataaaagatatttctttgataggtttattgttcactaaatcgttaacttcacattttagtatgagacatcattgaggaatggcttatgttcattgacatttggctcatatgaatatgagagattttaaatttgtgtttgtagtttatttattggagaatgacctggattttgcatcactttagtgcaggacttgttttagttatttgtgtaaagatgtgtaatccaaggatctggccaagtgatttttagatgggaagtagagaagcattttgttttttaagactgttttttgagggcagttttagggtgacagcaaaattgagagagagacagagtttttccatgtgcccccttgaccccacccttgcatagcctcccctattgtcaacaacccccaccagagtggtacatttattacaattgatgacctttcattgacgcatcataatgacttacagttcatagtttatattaagatcattcttggtgttgtacattctgtgggtttggacaaatgtataatgaccatgtatccagcattataatatcatacagagtattttcactaccctaaaaatctctgtgctctgcctgttcattccctgccaacatgtggtaaccactgatcttttttttttctatctccacagttttgccttttccagaatgtcatatagttggaatcagtatggaatcagtatgtagccttttcagattggctttcttcacttagtaatatgcatttaaggtttcttcatgcttttcatggcttgacagctcatttatttttaatgctcaatggtattctgttatctggatgaccccagtttacccattcacctattgaaggatgttttggttgcttccaagttttggcaattatgaatgaagtttctataaacatccatgtgcaggggtttttgtggacatgcattttcagctcctttgagtagacaccaaggaatgtaattgctggttcatttatggtgagagtatgtttagttttgtaagaaactgccaaactgtcttccaaagtggatgtgttattttgcatttccagtagcaatgaatgaaagtttctgttgctttatatctttgccagcatttggaggtgtcagtgttcgggattttggcaattctagtaggtatgtagtgatatcttgtttcaatttgcactttcctgatgacatgcaatgttgagtatctttttatatgcttatttgccatctgtatatcttgtttggtgaggtgtctgttagtctttggcccattttttaatcaggtttttaaaattattaagagttctttgtatgttttggctaatggtccattatcagatgtatcatttataaatattttctctctggcagtggcttgttttctcattctcttgacattgtttttcatggagcataagtttttaattttaacaaagtctatcttatcaattgtttctttcatacgagtgggttctgcctttgatattatctcagaaaagtcatcaccatattcagagttatctaggttttctcctgtgttatcttccaggattttaataattttatattttacatttaggtctatgatccattttgttaatttttgttaagggtgtaaggtctgttctagattcacatttttgcatgtggctgtctagcaccatttttgaaagggctctttgctccattgtattccctttgctcttctgtcaaaagcgagttgagtatatttatgtgggtctccttctgggctctctgttctgttgcattgattggtttgtctattctttagccaataccacactgtcttgattactgtggctttataggaagccttggagtcaggtagtatcagtcctccagctttgttcttcagtattgtgttagctattctgggtcttttgcatttctacataaagtttagaatcagttcgttgataaccactagacaatcatttaaaatttttctttatctttaatgatcctaatattagtctgtcaaagaaaaacattgccaatcatatttcactggcccttggaggaatgaaacaatgtaggaatgacgcttttgaattttgagtaaattttatttgtaaatctgttttagtactatcaaaatatgcttattttctttttctaatattattcataatctactcatatcttggaagataaacttaactctggtagcatttgctctgttttcagctattatcacaatgacaaactatgatttttaaaaaaccatcatactggggcagttccaagatggccgaataggaacagctccagtctacagctcccagcatgagcgacgcggaagacgaatgatttctgcatttccaactgaggtactgggttcatctcactggggattgtcggacagtgggtgcaggacagtgggtgcagcgcaccgagcatgagccgaagcagggcgaggcatcgcctcacctgggaagcgcaaggggtcagggaattccctttcatagccaaggaaagagatgacagatggcacctggaaaattgggtcattcccaccctaatactgcgcttttccaacggtcttagcaaacggcacaccagaagattatatcccgcgcctggcttgaagggtcctacgtacacggagcttcgctcattgctagcacagcagtctgagatcaaactgcaaggcggcagcgaggctggggaaggggtgcccgcccttgctgaggcttgagtaggtaaacaaagcagctgggaagctcgaaatgggtggagcccagcgcagctcaaggaggcctgcctgcctctgtagactccacctctcggggcagggcatagccgaacaaaaggcagcagaaacctctgcagacttaaatgtccctgtctgacagctttgaagagagtagtggttctcccagcatggaccttgagatctgagaatggacagactgcctcctcaagtgggtccctgacccccgagtagcctaactgggaggcaccccccagtaggggcagactgacacctcacatggccgggtactcctctgagacaaaacttccagaagaacaatcaggcagcaacattggctgtttagcaatattcgctgttctgcagcctccactgccgatacccaggcaaacagggtctggagtggacctccggcaaactccaaacggacctgcagctgagggtcctgactgttagaatgaaaactaacaaacagaaaggacgtcgacaccaaaaccccatctgtacatcaccatcatcacagaccaaaggtagataaaaccacaaagatggggaaaaaacagaacataaaaaactgaaaattctaaaaatcagagcgcctgtcctcctccaaaggaacacagctcctcaccagcaacggaacaaagctggacagagaatgactttgacaagttgagagaagaaggcttcagactatcaaactactctgagctaaaagaggaagtttgaacccatggcgaagacgttaaaaaccctgaaaaaagattagacgaatggctaactggaataaccaatgcagagaagtgtttaaaggacctgatggagctgaaaaccatggcacgagaacttcatgacgaatgcacaagcttcagtagccgatgcgatcaactggaagaaagggtatcagtgatggaagatcaaatgaatgaaatgaagtgagaagagaagtttagagaaaaaagaataaaaagaaacgaacaaagcctccaagaaatgtgggactatgggaaaagaccaaatgtacgtctgattggtgtacctgaaagtgacggggagaatggaaccaagttggaaaacactctgcagaatattatccaggagaacttccccaatctagcaaggcaggccaacattcaaattcagaaaatacagagaatgccacaaagatactcctcgagaagagcaactccaagacacataattgtcagattcaccaaacttgacatggaggaaaaaatgttaagggcagccagagagaaaggtcgggttacccatgaagggaagcccaccagactagcagctgatctctcggcagaaattctacaagccagaatagagtggaggccaatattcaacattcttaaagaaaagaatttttaacccagaatttcatatccagccaaactaagcttcataagtgaaggagaaataaaatactttaaagacaagcaaatgctgagagattttgtcaccaccaggcctgccctaaaagagctcctgaaggaagcactaaacatggaaaggaacaaccagtaccagccactgcaaaaacatgccaaattgtgaagaccattgaggctaggaagaaactgcatcaactaacgagcaaaataaccagctaacatcataatgacaggatcaaattcacacatgacaatattaaccttaaatgtaaatgggctaaatgctcaattaaaagatacagactggcaaattggataaagagtcaagacccatcagtgtgctgtattcaggaaacccatctcacatgcagagacacacataggctcaaaataaagggaaggaggaagatctaccaagcaaatggaaaacaaaaaaaggcaggtgttgcaatcctagtctctgataaaacagacttttaaccaacaaagatcaaaagagacaaggccattacataatggtaaagggatcaattcaacaagagctaactatcttaaatatatatgcacccaatacaggagcacccagattcataaagcaagtccttcgagacctacaaagagacttagactcccacacaataataatgggagactttaacaccgcactgtcaacattagacagatcaacaagacagaaagttaacaaggatacccaggaattgaactcagctctgcaccaagtggacctaatagacatctacagaactctccaccccaaatcaacagaatatacatttttttcagcaccacaccacacctattacaaaattgaccacatacttggaagtaaagctctcctcagcaaatgtaaaagaacagaaattataacaaactgtctctcagaccacagtgcaatcaagctagaactcaggattaagaaactcactcaaaaccactcaactacatggaaactgaacaacctgctcctgaatgactactgggtacataacgaaatgaaggcagaaataaagatgttctttcaaaccaacgagaacaaagacataacataccagaatctctgggacacatttaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagagctgaaggagatagagacacaaaaaacccttcaaaacatcaatgaatccaggagctggctttttgaaaagatcaacaaaattgatagacagctagcaagactaatacagaagaaaagagagaagaatcaaatagacacaataaaaaatgataaaggggatatcactaccgatcccacagaaatacaaactaccatcagagaatactataaacacctctactcaaataaactagaaaatctagaagaaatggataaattccttgacacatacaccctcccaagactaaaccaggaagaagttgaaactctgaatagaccaataacaggctctgaaattgaggccataattaatagcttaccaaccaaaaaaagtccaggaccagatggattcacagccgaattctaccagaggtacaaagatgagctggtactattccttctgaaactattccaatcaatagaaaaagagggaatcctccctaactcattttatgaggccagcgtcatcctgataccaaagcctgacagagacacaacaacaaaagagaattttagaccaataaccctgatgaacatcgatgcaaaaatcctcaataaaatactggcaaactgaatccagcagcacatcagaaagcttatccaccatgatcaagtgggcttcatccctgggatgcaaggctggttcaacatatgcaaatcaataaacataatccagcatataaacagaaccaatgacaaaaaccacatgattacctcaatagatgcagaaaaggcctttgacaaaattcaacaacccttcatgctaaaaactctcaataaattaggtattgatgggatgtatctcaaaataataagagctgtctatgacaaacccacagccaatatcatactgaatgggcaaaacctggaagcattccctttgaaaactggcacaagacagggataccctctctcaccactcctattgaacgtattgttgaatagttctggccaaggcaatcaggcaggagaaggcaataaagggtattcaattaggaaaagaggaagtcaaattgtccctgtttgcagatgacatgattatatatctagaaaaccccattgtctcagcccaaaatctccttaaactgataagcaacttcagcaaagtctcaggatacaaaatcaatgtgcaaaaatcacaagcattcttatacaccaataacagacggagagccaaatcatgagtgaactcccattcacaattgcttcaaagagattaaaatacctaggaatccaacttacaagggacgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatcctcatcaagctaccaatgactttcttcacagaattggaaaaaactactttaaagttcatatggaaccaaaaaagagcccacattgccaagtcaatcctaagccaaaagaacaaagctggaggcatcacactacctgacttcaaactatactacaaggctacaataaccaaaacagcatggtactggtaccaaaacagagatatagaccaatggaacagaacagagccctcagaaataacgccgcatatctacaactatctgatctttgacaaacctgagaaaaacaagcaacggggaaaggattccctatttaataaatggtgctgggaaaactggctagccatatgtagaaagctgaaactggatcccttccttacaccttataaaaaaattaaatttggattgaagacttaaatgttagacctaaaactgtaaaagccctagaagaaaacctaggcaataccattcaggacatagacataggacttcatgtctaaaacaccaaaagcaatggcaacaaaagccagaattgacaaatggtatctaattaaactaaagagcttctgcacagcaaaagaaactaccatcagagtgaacagccaacctacagaatgggagaaaatttctgcaatctacttatctgacaaagggctaatatccagaatctacaatgaactccaacaaatttacaagaaaaatgtaaccccatcaacaagtgggtgaaggatatgaacagacacttttcaaaagaagacatttatgcagccaacagacacatgaaaaaatgctcatcatcactggccatcagagaaatgcaaatcaaaaccacagtgagataccatctcacaccagttacaatggcgatcattaaaaagtcaggaaacaacaggtgctggaaaggatatggagaaataggaagacttgtacactgttggtgggactataaactggttcaaccattgtggaagtcagtgtggcgattcctcagggatctagaactagaaataccatttgatccagccattccattaccgggtatatacccaaaggattataacacatgctgctataaagacacatgcacacgtatgtttattgcagcactactcacaatagcaaagacttagaaccaacccaaatgtccaacaacaatagactggattaagaaaatgtggcacatatacaccatggagtactatgcagccatataaaaggatgagttcatgtcctttgtagggacatggatgaagctggaaaccatcattctcagcaaactattgcaacgacaaaaaccaaacactacatgttctcattcataggtcgaattgaacaatgagaacacatggacacaggaaggggaacatcacacaccggggcctgttgtggggtggggggaggggggaggtatagcattaggagatatacctaatgttaaatgacgagttaatggatgcagcaccccaacatggcacatgtatacatatgtaacaaacctgcacgttgtgcacatgtaccctaaaactttaagtataataatttaaaaaaacccatcatatttacccaaagtactaaatatttataggtatgaattgaattcagatgggatatatacacacacaatacagtattgtattgtagaaatattgatatttacattcaacaggttatgtttgtattaatcaggtttaaatgtagggtaagataaatgtcctttattacaacaatttttatggtacattaatgtttaataatgccctatctttaaattagtttataactaattctctgtggaagcattgtagaatctaaaaatctgaattaagatcagaattaacacaaaaaaattgcatctgttgccattttatgtttttgaaatggagtctcgctctgtcacccagggtggagtgcagtggtgtgatctcacctcagtgcaacctctgcctcccaagtttaagtgattcttgtgcctcagcctcccaagtaactggggttacaggcatgtgccacctcacccagctgatttttgtatttttatagaaagagggtttcaccatgttggtcaggctggtctcgaactcctggcctcagcaatctgcccgcctcagtctcccaaagtgctgggattgcagatgtgagtcactgtgcccagccttctgttgccattttaaaactaagagttaaaagatgcttttgtataattttctagaaaatatcttttatacttattttcttctaactacatttaaaatacattttaaaaagcagaaagcaaaaatgaagtctaagcaaatttcccgtgaatacatttcttttacaataaatgtatgccagttattcagtgttagaattgaatatagttagattcttgagattctgtttttaaaagacaccacagtattttgtttttatatgaagtattatggtaaatgtgatcattaccttaaatatatggcatcaggtttttaaagtggtattttgtggattttgttaaatctgtctcaaagtctattttctcatgttatgtttgaagtatgggtatgatagtacccagaaaaacaggcctttcaaaacaaaatactctacttttatgactccataaaaaatacaatctttattattatccatagactgaataaaacatcttacattttatgtttcattttattcaccataatgcctattttcaataaaattacaggtgattttaaatatgactagacttttttttttaatagaaagatcacataatggcttaagtatattccattaggagtagtatttctcttgtctttttgttcagccattggagtcccctgtgaccttgggtactttttccataggcgaactgatgcttcatgacgttctgtgttttctggtagcttgcctgttgcctgcctctgggttcgtcatcccccttatgctgacttaggcaatatttcttcagtctcttatcttggggctttgatgcatatgttctgaaggtggccacagtgactttgggtagcagcagatggtaaaccttcaggctgccaccagctaaactggtgttaagttggaaagttaacgtttgatgaagaatcagtagtgcatatgaaagaactttcactgctgaaatatcttttaattaaaaattagcatactaaaacctttgtgaatgtctgggcatttaaagaaatctacaattagttgtgttcttatagaagtatttatttaccagtttagtcttatgttacttgctcttcctaacctggttctttttcctctgtttctaccccagtttgttggtagttaagataaatcagataactacataaattgaaatataggttgtttttaggaatcttgggtgtttgcataaacaaagtatattttgaattatggcattttggattttaataactaagaagagatgtggattttaagtacaatcttcatataattctggtagatttggtctgttttcttctacctttgaaggtatttctggatcaaataggagcctgaagaactcaacctgcctcaaagagatatttccttttgttctaaattagttggtgattcttgactctgccgttcttaactttgttaactttgcagaaattgatgcagcgacttctgatgagctaaagctgtaggcacaacatattttgcttttggagttactgagcagtgggtacagggaacattgctaacctttttggattatttgttcacttcatgataatctgctatgtgggaagttctagcacaaatgaaacattggtaaggctccaaaggattttctttgttacccataaatcttgggtaccttatatacttttctcaattgaaaatgtatccttgagagtaatagctgaaaatatcttgtagactagagttataagtatccctgtcaaattttactctttatgcttgaattttcatcagtggaaaacttatgaaaccaaggacagattggtttcatggcataacatgagagaagcatctctgcatggtctgttcatgctaatgctcttgatggtgcagcttctgatggactgaagctgtaggtgcaacatcttttgcttttggagttgctgggcaatggtacagggaacattgctggccttctgatgccaaagaaagagaagttagaccccagttgggagaattgttgatattaaagcccaccgagtactattccttgttttctagtagttgaatttttataaagatgcctcatgagaataaggtgtggaattaagagtagaaacacattttggatgttttaagaatacaaaatgagatttattttagcagaaaatatgaataacatttgataattatgcatggtgttaggggaggaaagcaaagttttaatgctctaggtttgttgttcaaatccatttctatagaaggataacattaccagctcttgtaaatttgcccatctggttaaaaattcagatctaatactagtcaagtatggattacctttgaaagagagtgtagcaagtacaatcatgttcacatgaaagtatgttgggaaaaacttatttgcaaaatcggtctagtactattttctctagtttctttattgtgttgatctcattctttctgttgtcattatttatatgtgaattacggggagcatgacttacacagttgatatctcatccagattataagcagcaaacacaaatccggttatatgtgacaccattaagggatgctctgtgtttgtcctgtagtctttttgtttcttttctttttttcaatagtttttggggtactggtggttttggttacacagataagttctttagtggtgatttctgagatttaagtgcatccattactcgagcaatgtacactgtacccaatacgtagtattttatccttcacccacctcacaaccttccctcctgagtccctgaagtccattatatcactcttacgcctttgcatcctcatagcttagctcccacttacgagaacacatgatatttggttttccattcctgagttacttcacttagagtaatggcctccaccttcatccaagttgctgcaaaagacattatttcatttctttttatggctgagtagtattctatggagtatatatacaccacattttctttatccactcattggtcgctgggcacttaggttggttcggtatcattgcagttgctaatcgtgctgctataaacatgtatatgcatgtgtctttttcatataatgacttctttttctttgggtagctacccagtagtgggattgttggatagaatggtagttctacttttagttctttaaggaatctccatattgttttccatagtggttgtactaattttctatagacttaagcattattttaacttgtattaattgttctggagtcccatgaagtaactggcactaaagtagagacagacagtccctgaaattacccaagtaatctttcttttaaaaggaattggagctgaagttattttcagggacttccagacttccagtgtcaacatttaaattaaatatctaaaaagattcatgaatggggagacactgaatccccactgaagggaactctccacacttcttcaccacagtcgtagtgccttcatagtagcatatctcttttctcttctccatattatttttctttatttgcttaaaaataatcatcatttgatacttttggtgtaccccttctccctcttttctttgcaaagatggttgcctacttaaatattagtcctttcttaattctagttaacaaatagactcaaacctgtaatcagttggagcttttcctactactattatgacagaaaagtgggaaaagtgaaacttgtggaattgaagaacagatgaggctaatccttaaggaataagttgcctgctttttcttttttttcccccagttaggagcagttatttcatgtattagtatgggcaaagatgaagtaatttcttctgttagaccatatgctaatatagggctgataagtaagtgtgaaaaatgaaagggagaaatacattaattgtattctttcaataaggtatgctatccaaggtaattatttcatgacagttttagttatagtacttgttttatcatgaaataaaagattgttttaggagccttttattggaaagacaattgtatcaagctagtacaaattagatttttgtctttataaaggtgagcaaacccatgagcagtttttaaattgatgtgttttagtctacacatgaacaaattctgtttgagggttaaagaagctattattttgtcctttatgctgacagtttcattacagattggcctactgttggcattaaaaaaatgtttggctccttatgatctttgtgcatgcaactataatattaatgcagcaccatagcactgttcattaagaaatgactttaaatgaggttgaagcgtgtaaatttggaaagatacagatgttaaatgcagtcgtttctctttgtgtacagctgtatggctaataatttccaagcagctaaagctcttgttagcaggagtgctggtgtgttaagaatggctctataaataactttaagaactgaagttgaaggtgcttcttttaaagactattgttaactaaacattattgccaaacagatggaaagcattcaccagcctgatgtttttgggtctaattatattatcaccagccctgtacggctcagttgaagaggtatatccagaggccaatttataatcatttagccaacacctgtttgggagaaattgacagtcaaagggcacatttttaaaaaatcacatatgttcttgtgtttattgcctcaatgtgaacgttgtctagttgcacacaaactttgtaggagaagaaagtaaatataaacaaagcagcatttcccagccatgtttatccatcttaatttgcttttttttttggagatggagtctcactcttgctcaggctggagtgtggagtggcgcgatctcaattcactgcaacctccgcctcctgattcaagtgattctcatgcctcaccctcccgagtagctgggattataggtgtccaccaccatgcccggctaatttttgtatttttagtagagacgaggtttcaccacgttggccaggctggtcttaaactcctgacctcaggtgatccacccaccttggtctcccaaaatgctgggattacaggtgtgagccactgcgcccagccggtttggcctttttatctgatctgcttcatgcttcatgactaagtgagatcagtaaggaggtatcactcctgatttgtgcaggtatattttgttgagtcaattaaggggcttttaatagggagaagttctttcctttggttatacagcttccatgccttttacctagtgagatgtgttctactttatatagatatgtcttgttcaaatagaattggctttctggtaagtgacttaaaagtcacacctcatgtaagctgggtgtggtggctcatgcctgtaatcccagcactttgggatgccgaggcgggcggatcacgaggtcgggagattgagactatcctggctaacacggtgaaaccctgtctctactaaaaatacaaaaaattagctgggtgtggtggcgggcgcctgtagtcccagctactccggaggctgaggcaggagaatggcgtgaacccgggaggcagagcttgaagtgagcggagatcgcaccactgcactccagcctgggcaacaaagcaagactctgtctcaaaaaaaaaaaaaaagtcacacctcatgtaaaaacaaatgagacttaaggaacactaaatgtcttcacagattcaacagatgttcaacagatatttattgagctctcctttgcagaaggaaggccatggtgcctccttttacattcttgatatgttgatttaactcttaaagttcacaaatgtgttttcatgttttggaggctcaagatttgtgttcattgtaactcaaagggcagctatggagagaataagtctatcctatctgaaaaataataaaagtcaaaccctttgtttcaactgatgataccactatttcattttagtgtttttccttcttctgacagactttactattgaaaggcttatatatgtcacctctattttcttatcactcattatgaactctgtgcaatctgcttttatcctcagttcattgtacagtgaactgtacaatgctgtattgaaagttacacatgacttcctaactgccctaaccagtgatggtttctcagtccttattcttcatggcttctctctgttgtttagcatagattacactcatcttaagcattctctttctctgtcacctgaaccactatgttttctctttgtacttttctcattacacttttggttattgtcttatttactcacaatatttcaactatgtatattttcaaaattcagaaataaatagtatcgcttagcaattaaagaggaagaaacctggagccagactaccctctaccacttattatctttgtgagtatggacaaagtcctgaggttaaagaagttccagtgtttcagagtgcactccagagagtacaatcagttttatgcttatttccttatctgtaaacttgattaataaaagatacctacctctttggattgttgagagaattacatgatttaattccttaaagcccagcacagtgcctgatataaaggaagtgtcccagtgggattcattcttgtgtctttagtttttatctttatggagaatgctcaaatataaatcattagtaccgacttattttctaagctctattcccatgtcgtcatctaccttacaaacttttagagttgaattcactaaccgtatgtttattaaacatttactgtgtgagaacagtgtgttatgtgatagaataatttttatgctgttggttttctgttgctgacataacaaattaccacaaagttggcagcctataacaactaaattattaaagttctataggtcagaagtctgacacagttactgggttgaaatcaagatggtggcaagactatattccttactggaagctcaggagaggaatctgcttccaagctcattcaggttgttggctgaattctgttcttttcatagagttgtaggactgaactctgtttctttgctggctgtcagccaaggactgcgctatactcctagaagttgcctaggttccttcttaggcttgctatgagatcctagaagcctctctccagttcttgcatgtgggcctttgccacctgagagccagcagccatgcatccctttcatgctttgaatatgatttccctttcagccttatcatttctgtgctttgcctttcttttcatagacgatagttctctgtttttgaaatggattcatgtgatattttggaacccacccagataatccagtgtaatctctctgttttaaggtctgtaccttaattacatctgaaaaggcttttttgccagtaacataacacgttcacaaatgttggggattcttggggtatgaacatctttggggcccattatcctgcctttacagcatgcccataaagagctcgaagtctcactgggagacagacccccaaatcgaagggttagagattctataatagatgttggtgctgtgtaaaacagcagaagaaaggaagaaagtagtcagtgttactgagagctagagtgacatttgtgctgcatatggaaagatgcatacttgtttgataagtgcctgggggaatatttcagggaaaaacaagcaataatagtgatagcagtaatagcaactagctgtacttttataagattatcttactgaaatcctcacaagtgttagatactgttaccgactattatagcttctacataataagaatgccttatgtccataagaagacatgtctgtagtgtcttctaatgtagaataggaatggtaaaattatttcactgagccagacctggtgacttatccctgtaatctcagcactttgagaggccaaggcaggaggattgcttgagcgatcgcaggagttcaagatcagcctaggcaatatggtgagacccctgtcttacaaaaaaaaaaaaaattatccaggcatggtggcacatgcctgtagtaccagctacttgggaggctgaagtgggaggatcgtttgaacctggaaggttgaggctgcagtgagctaaaaatcacaccagagcactctagcttgggtagcagagtgagacccagtctcaataaaaataagataaaacaaaataaaataaaataaatcattggctttttgggaggattaatattgattacacctgggtaaagtatagcacatagtaaatgcttaaaacatggcagattagagaatacagggtggataagagaagtgcttaggaggtagaattgatttgattgatttagaattgattctaaatacttggtattcagaaggtgctcagtgtataattgttgaatcctggatcagtcacttgttctgaaggtgggagacaggagacagttcagagtaacttagaccacgtttagtttcagagcatgcatggaagatggtcttagtactataggaggagcagcaggctgtttgtttgtttggtgaaggcagggccttgggaagaggatatgaggtacctgtgagaatattgtattgaaattaatggaaatttaaatagtgtaggtcaaacagaagacaaagatgaagttgtcactattttttcaactttaatatctaaaatggaattttccatcttctcgaactggtttcccatctcaacttccttgtttcttctcaccttttaaaaattcttctatttttttcaagcttaacatctttttttttcatccttaaattctgtctttccttacccagtggtgggctggtaaatgtttgacagccagctctctggtagggggaagaaggctcatttgcagtgtttgctgatttctgtagtacaaatcctcctcccatggccaatttcagtctgtggctgcttttgttctataatgacaaagttgaaaagctgtaacagagactgcataggcctgcggagcctaaaatatttacagtctggccctttaaagaaaaagtttgccaatctttgctacagtagtttttccaaaataataaagctttaatagggtaggataatttcatacttctgttaatttattttatccatcaagatgaggggtgggaatgagtagtttaggggggcaatgtgtgagaggttatgaagggtcttgaggtcattttatgggcttaagctttttctctcagtgagataagaagagtgccatgttctaacttatgttttaaaaagaaaaccctggccgctgttttgaggatagacaacagggcagcaaagatggaagcagggagatcagttggaacactgtagttacaagttaggtaagagttgatctttgcttgaatcagagtaataactgtggaagtggtaaggtgagttcagattctggatacattttgaagacagagctgacaggatttgccggtggtggaaaggggtgttaaggtgaatccagggtgaagagataccaaaaggatgccttaggctagagcctgagttattgagatcacattatagcaagttgctacataggagattttaggaagaaaattgagacttgaacaattttttttgaaccacttcctgttgatcatatatgttccaagaggaaaaactctgtttaaaatagtatttcctttacttctaagaaatacattttaaaatactttaggaaacagtaatgtttctaaaatacggcatttttagaaaaggaaaccataataaaacctattttggataagattattttgatcctataatttgctgacttaaaaaaatttattcagaaatgaacaattttggggaggggattaaatttcagccctgccctactcttaaagtttagtttaaagctaagagttaatgtttcattgtattgttaataaattattactcgtgtcttttatgtaggttttacttgtaatggacacaaggacagaacagactttcattttaaaagtaagtaaaatttgtagccaggcgcggtgcctataattccagcactttgggagactgagataggcaggtcacctaaggtcaggagttcgagactatcctggccaacatggtgaaaccccgtttctactaaaaatacaaaaattagccgggtataatggtgggcttctataatcccagctacccgggagacttaggcaggagaatcgcttgaacccaggaggcagagattgcagtgaaccaagattgcaccattgcactccagcctgggcaacaagagtgagaccctgtctcaaaaaaaaaaaaaaaaaaaaagagtaagtaaaatttatatgtttaatgaatttaaaatttgaatttcaaattatgcttctgaaagaaaagttaatattttagttaatatttagttaatattaactaagtagttaatatatcccccccctaggttttgaatgtccttttatgttgtttctggtgatgtttatttacttttctttctatcctttcatcacggttgatagcatgcatttaacaacattgtttttgatacagagtatggaggaaataatttggataaactgaagaaccattttgtgttgtttgaatgtgtagtgtgttgtttaaatacatctcaagaacattttgtttaattgtgaagactacacacagtctcaccttcgattatcactacagttcttaagagctaaaattttgccttaaaatctagttacaggtattttgggaaagtgtatctacattcctggtcctctatttgatctaaattcaattttgattctatacataatgcaatttataactaaatgaataaggagagagagaaccctcaattttgaaattttgaaattgtatttggaatggactgtgatagtacatattctgaaaatatcctaatttaagcatttccacagcattcagaaggtgaatttattaattttatatttctttttctgttgctttttcttttgctgataaggcatggcagtaggtcacattgacacatactgaaacacattttgtgtgtgtgtgtgaatatactttatcattgacatttctttaaaaacagagtatgacaccagaaaatagacaaaccttattccttgtaagaagacttaatattgtttgtacttttgggggataggattttaaaattgcctgcttaatctaagaataccttttgtgtctcaggagtttgcattggtcttacaatgtctactgctttaaagatatagataagtaaaataaaacttaagaaaaggtcacagagaaataactgtgtgtcatcctgatgacttagtttgagagcatctctaataaaaacactgacccacgtaattgattttaatggcagctttgtggcatcttccttctctggattcacgccagatgccatcagcagagcctccagggactggggggcatagagcagcagatgagtggtttctctgaagcccagagtaactcggatagattagtttggttgataaacacagagcacagcaggctccaaaggcaactgaggatgcaactgaggatacaactgacctttttgttctctgtcagggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggttggtttgtagtttggattgtttatgcagtgaagaatgtcacctacttagcttccagtttctctctgtcatttcatgagcagatagaatatatgaaacacgtttaagaaaccatttcctattcctctgctctacctccctactttgagttgtgagggaaaatgaaaacccaggtgaacaacagatttcatgtgaactatggtaccatttgtagatttacttcactacttactttctcatggaatttacctaatataatgagaactttaatatgaatgtgtgctaagagagctagattttattttagtggtattttgttcgcttgttccctgctaaaaggatacattatgttagatgactaaaatgaaaagcatcccctgaagaattaattaattacctccttcttttagaaggcaagggtgttggcttaacatttgacattacctagtcattctgatctgagtttttatgaatacagccattggcatcacatatgggtacaaagcagaggcacagttctctgccttcaaactatttatgaaatttcagctctttgtagagggaacaggtggcaaaaaatataatgttttgatttttttttgccctttaatacctgaatttaaataagtagtcttttatttaggatgactgaaaacagcatataaatataaattcatttaatacatattgccatttggcttttaagaggtgttcgtaaaatagtaaaaaatttttaaattgttttccgtatctcgtgaaggcattgttatttttgtataactattgtactttactaataggcataacatttgtatttaatataattttttaggaaaagaagtcattgctttctggaatgaggtctcatgataatgaatgcaagatttttgatgggggcagtaaacaattaatattgtttattgtgaagtacagcacaagataactacagatggagggaagacctccatatgcagtatttaataggaaattcaaaaggggctctgtggtctctcaggtattaagagagttaattgtgtgtgtgaattggataactaattcacctttgttcagacattatagacagcttttatctgaggataccagtgcattacagacattattgaattagaggtcatgtcatctgatagcgaaatacagccacctctggtgtggaacaaaataacttgcgtagtaataatccataataatttagaacaaggtcagtaggatgaatgtaattatagtcaatattctattacccagtgtggattattcatgttggagattatctatggcaaaattttcagtcttaacttacctgttatttgtagcaatatcttcctcttcttcctcttccttctccatatcatttttcatttttttctaccatcttctcaccatcccatatacctcttgaaactgatgtttcaattgattttacttgaataatgtagaaaatttgtataatctcttaaaatcatagacttacgacttttaaattttctactattttagatccttctttactatcgagcatacctgactttgaatgctcacatgaccataaaatttgtctcttttgaccattcattttaggtgtctattgtttatttttaagatggttttataatataaagatagtaaattatagtgcaaatagggactctggattaattaaatattcagcaaatttattgagcatgtactgtagagtaggctcctttttaggtgaacaagacaagaaaattctctctctctcttttttttttttttttggttggggggtagttagggtcttgctctgtctcctaggttagagtgctatggtacaatcatagctcactgtaaccttgaactcttgggctcaagtgatctcccacctcagctgggattacatgcgtgcaccaccacatctggctaagttttaaaattttttgtagagattgggtctctctatgttgcccaaattggtcttaaactcctggcctcaagcgattctcctgcctcagcctcccaaaatgctgggattgcaggggtgagccaccacgccaggcctgaaacttaaattcttgttgtgaaaagtcaaacagaaaaacaaaaagcaagagaacattggataataaaaggaactatacagatctttaacaaagggagatctaatagataacaactgggggactatgttgaattaagtagtagagggagccctctctgagaaggtggcatttaagagaagttctgaatggcaaaagaaacaatcatttgaatgtaagatacaggtacagggatgagtataaaaacaaacttgggatgtttgatgaccaagaaaggtatcatttggttggaatggagcagagtgaggacaacgtgaggcacatgttggtacgtgaggctgttggagaagtaggcaggagccttgtacagcagagtaaggactttgacttttgttcaagtgcattgggaaaccattggacttcttaaggggtgacagaatctgatttacattttaaaaaggtcactggctcttgtatggggaatgggttgtagaaaggcaagaatagaagcagtaaaaaggctaatacaggaggctagtgaaaaggtgctgctggcttggccttctggggcaccagtcgagatgtttgagggtagagtaatgggacctgtaatggatttgagattaggaagaggaaaatctacagtaatttctcagatttggcttgagcaatgcagtgaactggatgatgaacagtgtgttttcttttacacatcagtggcacctccgtagattaggaagttggcctgtgtcatagaaaagtaacttttcatatgtgtgaatagttattactgagaaagcaaaccttgaacagttgttttctccataacatgaatgctttgaatacttacgatttgtggctttagctttccactgcttacagaactactcatgatttatgtgagtctcttggactctttctttccatttttaattcatttcattagaaatgtattgagtgcttgctgggacacagacatagttctaatttggcagtgaacaaaacagaagactttgcctgcatggagcttacattacattacattatagaggcagaacagacaataagcaaatatttaagtaaatatatgacagatggaggtaaatatgctatggagaaaaattaaaggaaaggggaagggaatgccaaaggggtgagaggggtggtttgctattttatatagggtggtcatcttattgagaagggacatttgaccagagaccttcaggaagtgagagagggagcattgtggatatgtaaggaaaggatgtcttggcaagagaaaacaaataggtccacaggcttagaggcaggggtgtgcttggtgttcaagaaacagcaggatcagtgtggctggagcagaacagaaagagcagtaggaggaatgcttagagaagtgaggaggcaggcaggcagatcctgtatagcattgtaggccacgttaagaactggacttttattctaaatgagataagatgttattggggcatgctgagcaaaggagtgatgagatagggatcattggcctgctctgtggaaaacagaatgtaggagagcagaaggaaaagcagggagaccaatttggaagttgttgcagcaccccaggtgaaaatgctgatggcttggacaaggtattagtgtgtaggtcaggggtctccgggccacagacgggtacctggaggtgagtggcggacaagtgaacattactgtctgagctccgcctcctgtcagatcagcagtggcattagattctcataggagcacaaaccctattgtgaactgcacatgcgagggatctaggttgcacactccttatgggaatctaatgcctgatgatctgaggtggaacagtttcaccccaaaacactttctacccccacccacacccctgtccccatccacggaaaaattgtcttccatgaaactggtccttggtgccaaaatggttgggaactgctggcgtaggtcgtaaagaatggttattagagtctgaatgtattttgaaggtagaacggcatgattctgttttacatgatttcaaagtttttggctcaaattgaaataatggagtttccatttgctaagctgtgggagaagtaagtttagaaggaaaatcaaggattccattttggacatgtgaatttgagattcttattaaatattcaggtgatgtttagtagacaggctatatcagtcaggattttaggagagaggtttaaaatatttactattgcttttaataaagccctttcttaaactatttgagagagaaaggtggggaaacaaaatgtattcagtcaaggccatgagagtttaagtttctaagattagggattatataatattcatcatatgtatgatgaattagcaaaatacttggtatttagaaggtgctcagtgtataattgttgaatactgggtcagtcaaagatgaaagaccaaattaaaagacagaagttgcaaaagtctctgactgtggatatacaaaacagaaaggaggtagaaaagaatttctctccaagttacttaaggccccaaggagtaaaatgattcttttattaattagttttctaaaattataaaactaatttataaaataaattcaaacaaaatagaagtctataaagtaaaaataaaaattatccctccctattcactttgttgcccagacctattccccagaaataggtactcttttaacagtaattatatatcttccaataactttctatgtttataaacattcactccctatctgtctgtttttaaaaaacttaaatgggtgttacatattgccttgagcttgcattttttcccccatctcaaaagtgtaccttggacgcctttagtatatctttatgagtatatttaggtccatattaagagaggcatacactatagtgattaaaaataaggactgtggagccatgctatgtgaatgtaaatgctggctcaccattactagtgtgactttgggaaagttatttaacctttctgtgtctcaatttcctcatctgtaaaatagagataatattaattacctaccttatagggttgatgtgaggattaaatagttgtatatgtaaaatgcttagaatagtacctggtacatggtaagcactatgtatttgcaaatggctattattaattgatatttaaattgtttccagtactcatataaatacatgtataaacatgtatttatacatacatgtttttgttgtattttttgagaattatatgtaggacagatttttttcaagttgaattgcttggccaaaagatgattttgattactgtgatagcagtgttttatcgtacatatgaaatttaagtcctaattctgaccaagcaaattaacaaacttactttgcaatcttatagaaaaacaatagacttaaaatctgaggagagacaaagagttttaattaaacattatgaattctaatttttaaatcttaaaatggttcaatatctacaattttatgtgcttcaaaaagacttagaaaagtatcatttacagtcttagagtgttaaaaattagacaaattttatgtaccttagcaataacaggttttttttaaggttaatatatgtctttggaagaacgtacggcccccaaaatgacattatacttatagatccttatagattcttacttatagattcttttccttgaaaggttttcaaaaaatttgtacagatgttatctttttataactcagtttaataaatatttaatacctgttttacatgctagatagaatcctctgcctgcagctattaagactttacagtctcatgaaggagataataaaagcataaaagtaatattaatatgatgtaaatgtcataaggagtatgaaggtggatgatagaggattgagagaatgtatatatgatgtccagttaagggatacaaagaaattggtaaaagagaacagattctgaaggaccttcaagaataggtaagattttcacaagtggatactggggaaactattagaaaaaaacattccaagtgcaagcatggtatggggaaaagcccattatgaattctttgttgagtagggggagaggaccaaatcatgggttgataactgtattactcaggagttcaaatgcctatgcggagttggtatatgattcagtagatggagggaacttggcttcttgaatgcagaaatggcataagatctgtgctgaaatagaagattaattaggcagcaattagtagggtagagtgatacaagagggacttaaagtaaggatctagtcgtagttatagcattatccccaaaaatgaagactttaagtacattgaattttagatttcagtagtttattcaggtggaattggcctaggaatgaatgaagcttttcttagaactttattaaaaggtaccatttcttgctggtcagtggaactttatggattgcttatacggtacatctcatcatctgatttaacaagcagtgacttttatgtcctgcacattgtgtaggcagtagacatacaaagatgaaaaagacttgatcctttcctcaaagtagtcatcatctaggagaattgaaaaccacccaaatcattttatttggattgcatacaagaatcttagttttaggttcaagcattgttagagtgccacaatataggtatttgtggtaagagaatgtgagtattgttgtcaatagactaaagaatatagactcaatgcatagctccttttaaacttcagttgaaatatggagaaatgtgaaacactgagtataaagaggacagaaagcattagctaagaaaaaaatgagaggaaaaagttaaatgccataatatcctgtaccactaactggtatcaaaatggggaagatgatacaaaaattagctgggtatggtggcacacgcctgtaatcccagctacttgggtgactgaggcaggaggataacttgaaccgaggaggtggaggcttcagtgagctgagatcccaccactgcactccagtctgggctacagagtgagactctaagaaaaaaaaaaaagttaaataaataaaatagagaaggtggttaactagatcgctgctacaaagaggtgtatgagaatcctaggattaatattatgacaattagcctttattgagcatttattctatgctaggtaccatgtcaggtgctatgtgtatttattgaatttctcaaaatgaaatgtgaagtaggaagaggtatttttgatgtttccgttgacttttttacacatgcaattgactgtcagtggttattttccttaaggtttaggtacccttggcatatgatgcttaatgattacaataaatatgtgctgaaaaattgtcttctttatatgaatagagggatttatttttaacacattattcttaatttttcatttctttgcaactacaattctgtctccgcaaagtatacttctgtagttactgcttttgagatttctggatcaaatttaattaattattctttcttataatactgtttctaatcactactgttatagcaggtttttggtacttagccataattgtttaacgtaaaagttataattgacaaagggattgaggtgttttaatggttaaaataaaagaaaactatggtgaaataataactacaagtattgctgataaaatactggattttttttatttctctgatttacatgaaagtgatttttatgattttagttttaaagatatatgtcagaatacacagtcggaatttccgtagcttgctttattaatggttgcccaattaattttcctcagtagctttacttatataacatattacatgtaaggctgggcataaaaggggaaatattaatatgtcatttataaaggcataattatataccacatgccaaattcctccaatcctggactggacattttcaaaatggaataatattgttgatttttccccccattgtagtatacaattttaaacagcacttatttatgtatttccacttgaccaaggggccatgcgtgaaaaaattattatataaacagaacagaacataatcagatgtttctaagactaaatgatatttaactttagagtagaattttagctgtgaaatttcatactagtatgtgttataactaatttcccttcaaaggaagaaataggttgtcacttaaaaaaaaaattgatatcaggagatatgcttgaaaccgtactcaccagtcagcaataacaagcattttattaaatatgcttatcttatggcacacgatattaatggatattattgacttgttttgattgatttttaagatagtttttgtttttctaatggcttaaataactgtcaatttggagatcttaatacttttgtttgttttgttatacttgttcacaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggtcaggaacttttgcaaatgcatttctttttattcgctgttgcttccaattaactgagtaggcgttttatcttgtaattagtatcttcatttcctgtctagagcttcattatcagtgcagcaaattcacccccagtaatagcttctagtacttaatgatgccattattcttaatgatactgtttttagctacaaaaggagtaattacagttcacttctgcagaaaatggaagagaaaaatgttttgatttctcctgtcgttttgtttttaggacacattcagctaacgtattttagcaggtggagtgaggttgaagattcctgtgacagcgatgccatagagagaatgtactgtgccccaggttagagcaatctcctaaaatgtttcacttgaaaaagtggttcggcagctctcatttctttatagaagttgtatttttgtattgttcactagcagtttacatatgtgttggatttggttatctgtttaacccttcaaaaaagaaaatttggggctaaaccaattaagtaattcataggtatatatgtgtatatatgtatgtgtgtccacatatttattattgttaaatgagtttaatacctcattaagaactgcagtgaattcttagaaatgtcttaacttcttagtgtttacaaggacctttaaataccctgaccctctttagatgcatgatttttttctttctttcttttttttgagacatacctcactctgtcacacaggctggaatgcagtggtgctgttatgtctcactgcagcctcccaactcctgggctcaggcagtcctgttgcctcagcttctgagtagctgggactacatttgtgcaccaccatgcctggctaatttttttaaaaagcattttttgtagagatgaggtctttctgttgcccaggctggtctagaactcctgggctcaaggtgctgggattacgggtgcatgccattattcctggctaattaaaaaaatttttttttttttaaatagaaacagggccttgctgtgttgctcagactggtcctgaacacctggcctcaagcaatcctcctgccccagcctctggaatagctgggattgcaggcatgagcccatggtgcctggcacaatggaggttttaaaaatgcaatatgattttagtgatgtgccaacctggcattttataacaaatttttatagacaaaacagttttatcttgcctttactgtattgtctttattttttaaaaattagagatttattctgtgggtattagatcttttattgacaattataggtagcataagcatatgaattgcatttgagttggtttttctcagtcatcagtgcagatggggctgtattatgaatccaaagtttgttcaccttttgcttaccatttagcctctttggatggccagagtcacttcacctgttgccccattggccttcaaaggagtttcaagctgatttttttttgatatagtctgcttaggtgttgatcaatatagtatttaatacttaacagctaactagtgtattgatgctaaccttgtttctctgcataatgggaagtgatgataataaggattaaaagagctagattgtttctagttacaactttcattgttaagaattatttctgcagtagagaataccaaagttttccaacctataaaataaatatcctaaaacgttcctgaaagcaactattagggttttcttttctttcctccttcttccttcaaattaagactgtttggtttttgtttattgttagagacaatagagcacacttacatttttttttctcaaatagataatgtgatgttatgttttgaaatcatgttagtaaataggataaaaaattgcatgttgaattcactttattacagttactcgattaaaaaaaaaaaccagatcctccccactttctaatttgataagaaataacattttaggttccagtgtacttagaaatatatttgttaattataatgaatttggaagttttagaatcaaacttaatttgggagtttttttgagtcaagcctgttacatgctaaagtgaagtacagtgggaaccatataacaaaacaaaaccacacatttatggaatattgtttaatatttgtaagtagtttcttatttcttatttttgttgttactttcttttttttctcctggttcctagtaagtgtatatattgttacttattggaaactatctgtaaatttgtgcttgaacattctagcagattatttttctttattctcaagcacagtcatatttactttaatatccataacatgttggtatcctgagagttttaatatatgtggaacagaaccatattacattcatcaacagatacacactttcaatttcatatactgaaataccgaatttaatacagatcggtttctaagttctaatttttaagccttgtcccagaaattacaattctcttagttgaccagcaggtggcagtctaccattaatggattttgctgtcctcttccaggttgtccttcactagcatttgaaaaaagctgtagtctgaagaggtgctttgttgtcattatttgcataaaagaattgtacttccaagctttgtgagttgcaaaagtgttctagtgttgtggcatgctttgtgaacaatgtggaaaggctttccattcattgggcctgttaattttagcaaccaggtaaaacaaaacgagtaatggccttaacagaaaagtaataccagtgttcttattaagatgaccttaaatctagagagttatagaacttggttaagtctatgtgctcgtaccccttacttataactcaagggaaattggagcaaaaatttgtgaattactgtttgctccaaaagttcataggcagtgctactgataaatcaaaactacagataggttttcctctcctcaaaggatggaagcaatgataatatgttaatatttcaatacttaaaaatacaaatcagtaactacatgggtcatagattgtttaaccaccttttgatctacccttaggaacactaaaggttgaagtaatttcctttcatgtgatcccctccctcttacttcccaagtctaaccttagtattattgtccaagtaactctaaagcatgttaagcagctgatgtttggttagaaagaaaagttgtcacaagattatgatgagagcaactcacttctgtttaaacagtgtgcaccctctaccctgccacttcacctcctgggaatccttatcacatatttgtcctgaaaacattatccacctgccctgtgctttataatatcagcagtatatctttttatcttgtggatgatgtgcctttatattttgagaaaaatttccagtaacagatttgatttgcatggacagaaacttgagcaaatgccaaactagcaggggggccattattctgctctataaataagtttaaaaaagaaaaaacacacacacagaaacctgtgaatcaacatgttttggtctaattgaggggaaaagcaagacagataaattttgaaatgcaaatgatcaccttctgttatttaagtatagtttctgccaacttagtgatcctagattttaaaaagtcataattatttcaacaatgtatactcccaaggatgcccaagattcacaagtttctataacaaaactgagaacttttaaaaaagttgccacttttttatattaaagaaaacaaatccaacaacaaaaagacaaaaaccatggagctttctctggctacatctgtgaaaaagccagcgcataaatggctgcagctgcagacccatcaagagggtcttgagaatacgaattcactgatcaaacccagccctgttttcaaagtagaagccattccttttaggttcactttgtatccttagattatctaggatgattctctagaaaggttttattttaaataaacatcattcatggtaaatgggttcctttcataccacagaaacacagaatggagttcaggaagagaaaaggcaaaagaaatagtccacaaagtaggaacagattgtatagcatgacaatataaatataacactgtctggtttccacattaggagacttgtagatactttattaggatacttttacacaggttcttctgctttttttgttgtgagggattagagaataaaaactggagtaaattggttatttttctctggaggactttcttctggttactctgattttatatctgtttttacacacatacacacaaaagttttagccaaaagattttatgtgctttatcatttgatttattaacttatgataataaagaataaacctttgtttatagtgttttaagtataaaggaaaaataaaatgtcaaagtacttttttttactactttttttcttgactcttatcattcaaaaacagctagaaaatagaacctgtactactaagcatataaaatacaaaaaaaaaactgagtctgaggtgggaggattgcttgaggctgtgagtatgagactgcagtgtgctatgatcatgcctgcgaatagctactgcactccagcctgggcaacatagcaagaccttgtctcttaaagaaaaatacaagaaaatgatatttgaaagcttaatatacaatctgagacaagtgcataaaattatttgtgttagttaacctaatatagtcacttaagtttcccattctagtcttgaacaagttgatatggtatcctatcagtgtgtgtccttcacttttattttctgccctattatgagtctttaattttaaatgcttgaaatttacattgatatttgtcattgaatacttttcacacttgagaatttataggtgcatatgtgtgtaaattgaagaagtccaaaatgcttttcactgcagcccgatctccatgctcccagatgtcaaatgacagctttgcttcctctcttaggcaatttcacacttggaaacagctcacagctgacggtgaaaagtgaaacatagaaaaatcatgctgaaaactatctgtaaaaattcagttttagagcatgacatttattgactacctttctttgctctcctagcctgactttatcaaataatccatgaatatattttggggaatagtttcccctgcccttctccataaacatgctttccatggcatttgtttctttttaggcatggagctccatgtaatagttatgtatctgataattaaaactaggactcagaccatggatggagtttaaaatatcttgaggctatcagaagtttttaaggtttagaacatttagatggaattgagaactaccaaacctgcatattgtcccagatcatgtattaactgattgcttgacctcgggaaatttatttaagactttctaggcctcagtttaacagtagtaaaatagatttgttggatataagtaaaatcacagatgtcagatcatctgacatcctccttacacaaaatgtactcaaaattgaagttcatcatattaaggcaggattttccccccaagggtaaatattgatttcttatctaatgttagtagagttaaaaaattatttcattaggatgactgagtatatatttttactcatttatagagtttgtacataaagtatatcatgtagaaataagggatttatggaaaatactttcatttagaggaatgaagccaaaacaacttttgtttggggtgaaagttgaatgtcaagattctcaacaaacaaaattgtttaaataagaaagaaatatttagatgtgataatttatgggacctgggtaatttcagcaaacatgagaaatctaattttaagaatgtaagattgatagagaaagcaaataaatatagatgtatatttcaaaataataatgacataaccaggagatactactttttttcctaaaacagaaagaaggtggcagcaagagggaactataggaataattttgagtaaaatatttatggttaatatttaaatattatgtttcagacagtaactgttttatttacccttaagcaaaacttcagcaatagctagctatcttgtacatagtattttaatgttttccttgaatgattaacaagtatgtttagtcctttgccctcagttcttatcgtcataaaaaccaaatctatttattcttcaggagaaccagttaatttttcagtttgccatagaatagtgagacttttccactgaagaaaatttcttgatacacttcaccactgtatatccatgaaacttgtaacgtgagtttagagtacaagcaaaaaaggcctcaagttaacacaagtcttaccttgtctaggcaaggcccttgtggtgcaaagaagattaaaggatcactttaggaggacttgagggtctagaatgctggaatccatgggccagtcaccatcacatctcagttaaggttgctccatattgaaacagactattctgaaatcatgattctcctatcaagccagaatgcgatttgtctctagtggtgagaatgagacaaagtaagagcaaagaattcagtcccagttatttggcatcttagcaaatgacacattagcacatcccaagagaagttcaatgaattgatgttttgatacagaagaggtgaaaaacaatgtctctgtacatttcataatactacctgatatttggagtgaagggtttatgtcaagctttagattattaaaaataagttaatcttaaccttttatttaccccaaaccttttttcttgatgatcttgggcaaatttctttttcagaagaggaacatgagactagagacttatagtttaaagtattagctacagtgtaatgctttttatttttcgtatctcagttgacttttgtcaactattcagtaattggcctcaccactgcattattataaagaagaaagtgaactgtcttttgcctttgatgtttaacaaagatgtaatactgagtcttaaacattatataccagagcaattggctaactatttttatcaaatcatcagtttctgtatcccataacattttgtaaattttaatctccattaggttaccaggtcttattccttctgagcagttcttcacaaattcttccttcgaataaatgtttaaaaatgctaaggtttttaaaaatgagtgaggataaggcaagtaggatttctgaagctcctttaatagccatgcgtgtagctctctgcctaacacagcagcagagcggcagagagagagcgcaagcaagcgagagagctatgcctgtcattctcacaattttcagttagcctttttctcatcaatcaactgtaatggctttggttgggtaacactgtgacacctgatggctactcagaatggagttgttgtgatatgatcaatggaaaatggggcatgctgttggttttttcctactagaaatacagggtgagagagtaagcaagattgtttacagctcagaattataatcggtcaaccagaagtcatgtggtagttactcgtttcttattttatctcacaagaaaaccgtatagtaatgatacctataaactcccttgaacaagtaattcttggctctggagtgccgaatcaagtgaaattaaggagttttgacttaagttgtacagataattgcaggaaagctcagaacatggttgccaggtcaccacgacaacaagaaattcagagctaggtagtgggagaaaagtggaattagacatgtagccaagcctagcctgaactagctgagtgtggtctgcactcacgtccagttccccacaatacagcaggcccagggattcaggtaattgaattacctaaaaaccaactgaataaatgatgaggtggtggcaggaagcgaggctagagactgaggtgagccgaaaaagcgaatgcgtattagggtggagcagcaccacatatcccctgtcaccttgcagcactgggagaagagtgggggccccagctgctgcagacttctctctctggaaagtgccagtctctgtcattggtcttctctggataatacgctaattagagtaatgtgattccaggaactttcaaacagttcatgtaccctgctcaacaaatacagcatttgaataagcaattgagtacaatgctggaggactttatggaatatagaatggataattaggcagtcaatgttttctgaaatagtataaaataagaaaaaaggagcaaaatgcccatttgaaaggatgggctaggaaatgaaaattccaggctctagttagtctatcatgtaagaatgaagatctgcctcagaaatgtgagactatagggaagtttcttctgtctgacttgactcatttcaagtacaaggtccctgtgaacagctttgcgcctttgaacttgtaaactttaagctattaaactttgatgttttagtttataactattagaggagcattccgaacctggaattaaaatgaaattttattctcatagttgctatggcttttagttttgctttcggttgtaacattttccattgtcatatacaaaaacttaaaaaaaattgtctctgtatttaaaataataccatggctaggtagtgtagttgtcctacaatacatttaaatgaatttgtttttgataacatttaaaaaatatttgtaattgatacaaatgatctcaccagcccaccagccaaatagaaccagcttacaaatttgtggcacattttatggaattaggtgcctaaattcctttaattgaacagggatagaaaaaaccttgagttatctcccagtcctgtcttctttattcgcccaggtttttcagcttttttttttttttttttttttgagacagagtcttgctctgtcacccaggctggagtgcagtggtgtgatctgggctcactataacctccacctcctgggttcaagcagttctcctgtctcagtctcccaagtagctgggattacagatggccaccaccatgccctggctaattttttgtgtttttagtagagacggagttttgccatgttggccaggctggtcctgaactgacctcaggtcatccacctgcctggtcctctcaaagtgctgggattacaggcgtgagccaccgttcccagcccagctttcttttcttgatgtagcacacgccacctgtgccagagcaaactgtaccttccagaggcagtcattgtgctttgcatggggagcactggaaggtgtccattccaccacctgagtttaggctgccttcatctcttgcctggaatagtgcagtcagctgactggcttccactctcaccctctaatctttgtttcttcctgctgctgagtatgctttagataatgttttaaactctttagcctacaacttgtaaaagtgcaaaaggacttgatgtagatctgcatgctcaatggaacttaaagaaaacaaatgtgatgagggctttggaggtgctttgaatgccttgaatggacagtgctacaaaatacaagattgatatatttattcaacaaacatttattaaatgcctcctgtgtcccaggcactgtgcctaggagccagaaataaaagacataattggtataatattgacagttacttttgaagatttacatgaaaaggagtctacccaaacagaagaaatatacaattggttaactaggatgttaatagacctttataggtgaatagttgtatttatagaatggtagttttctgagcaaacaaaagacatgcttagctgtcccccttcccacagtttagttccatatattgttggatacaaaaaatgctttcttctgtgtttctttctctttgctctttagtcatcggctgcagtggaagactaatgctcagcccctgcatagaaaatctttatacacagcaagagctggtgagagaaattgactaggattttgtaattctagtccctttcaattagcaacagatgctgcagggaaagattgtctgtgtaggaacacagtactaatgtttctgtgccctagctgacatggaatgctcattgcaaaaagaaagatgttcttttccttggtcgaagttgtcaccaatgacagattagatttttttaacctttctctactcctaaatccattaatgaagtctgattcccttggaagaaagttaaattcttgaccaattgtaacaacatttctaattgaacacttaaagaatttatagaaagtttagacattccagctgcctttctgatagtataaaggtatacattgtgcttaattttaaggtttgtaagaatttgcctttgttcttatgttgtcttatttaccagagatctttttttgatcctgaaagttaatatatttttgttccttatggtttttttcccccaaagagaactttggaatccttaaggtcagatatttaaagtgaaaattttttattattttgagaaaaaatcctgtggcattagaaaactatatttatctttcaccttcttccctagtgtatttactactgattatcattttaatgtgttgtatggatcttgtggccttaaaattggcctatcattctgctatttggataaagcattatgttacttatgtgataaattcttccagcatctaactattggtttattttgagtattacataaacactttatttacaatgatggctgctttttaattaaattttctatgacttcttaataacagttccacagttgctataactttgagagtaaaaagaaatgagtcttttcatttaaaaaagcctagttaagaaaaatagtttaggagttctaaattacaatagaatttctctataagtgaaattctcttctaagaagattctgaacatactgtatttcctgctgtatcttggggagagaagatagcaacaacagaatatattgccagaaggaggttatggacttgtctctgggaatttttggaatggggatgggtaactatattgttagtaaaggtaaagtgaagaatgagatgatctatgtggtgctcctttagtggaaaaaccagggaactgagtcagatggcctcaccagtctgacggtgtgtcttaacacatatctgtaaatgtggaatatcagatttccttattaagcattttaaaagtgatgtcttttaaagaaaagtaaattctgaatttgggatattgaaggccccacaattgcttaaaatgcaagatggttcatgtttttaaaactttatggaaacgttttcgattaaagcttgagtttaacttgcagtttctagttttctcaattttcgattcaatttccagtataatgttagatctgtctttggttatttttgcgtcatgtctttgacaaatccatgcagtttaaattgtataatcttaaaaggcaaggcctgtacccttagataaacgtatgtcatgaagcatacatcatgattttagtatgttggaatcacatagtctctccaatgtctttcagacttcctcaagtctgagagtgtgtactgttcttctttcctttcctttcccatcgctatatagacatcttatggttgagtccaagctttctgcttttttgctcctttacttttgggagccaagcttattatagttgcagttctggatttagggtaaacattattattttggctgtaagagggagacttggaagactctgaatatcataaggactataaaactttgttattctgtgttttagcaagctctttggcaatatgggctaccaagacagcattatttttctgaaaaatatcttggcttattgaagagtgttctatgaggtgttaaacatgagtaaagcaaaggtaggcaaagcacattttatgttttgatatctttgttttatttaatcttatttattcacttgtgaaatatcatagtttgaatcattagtattaatcagtaagagtctatattgtagttagaatatcagaatactgaagtgaaatttctagaattttactaaacagtttgcacatgtttgatgtcctttaaaatttatggatgagttgaaatttaatcaggagctgattctgtgtctccattacattaaaagatgataatggttagatttagtgaccctgattcatttcacttaccaccaggtaattaatcttttagggaaagagaggagtggctatgtatagaaaggagaaaaggaagaagattgaggaatgcttgctcatcttagcataatccactttttgggcatcttaggttaatggagggagaagaagttatgagaaaggctcatgagtgcttttgaaaacactttcaggatcataaaattacagattataagaggctgaaagaatgttagaggtctggctgttctcattttcagagaagcatagtgatatactcagccaagctcaagcagcagcataaccagagccctggcaatacatctgtttgacttaaggacaaaaatccaggattctttgatatcaccatctctttttgagtttttgtgggaataaactgagaaattgttttctgaggtaatagtttgtttttctctgatcatgtttcttaatgcctgtagtgtgccactacacttgtggagaataaggatactgttttaccaagcctagaaattgcaattatagaatgtagcggtagggaatggggcatgcccagaaacttaacaccttgtgttttataggaaaaatgttttgaaaattggcaaaaaaaaaaagtggtagaatttatcctttaaaatatttttctaggccaggcgtggtggctcgtgcctgtaattccagcattttgtgagaccaaggcaggagaattacttgagcctaggagtttgagaccagcctgaacaacatggtgaaatcctctgtctacaaaaaatagaaataaaaaaattagccaagtgtggtcccatgcctgtggtcctgggacccatgcctgtggtcccagctacttaggaggctgagatgggaggattgcttgagcccaggaggtcgaggctgcagtgagtcatcatcctgccactgcactccagcctaggtgacaggatgagaaccttaaaaaaaaaaaaaaggaaaagaaaacaaaatgtttttctacttgtttctagagatttttcaaatttgaggtaggagttaaaggggatttctcaaattcactgtgttagtcttttaaaatagcctcagagacttacatggtatttcttttcattctctacttttgattttaggtacatatacctgatgtttatagtaactatcgtgttgctttatatataaatcagtgttgttggtttatgcttagattttttatatagagtttgcaagtaaagtagttttgatagccacacaacctcaggcttctttttggcaatacagtttcagtgtgtatcttaaaatttttaatctaagaattactgatatttaaggatgttaaaagggcaaccaaataaagtcctttgttctgataattgaaagaattttttttctgttttaacacctataaagaaattctacaactgcttaccttcacctgttctaatatttaagcttcctagctgttaggaagttcttctttatatcttacctaaatacagcctaaatgcagaactctttgtcgtagcttagagtcatgtatgaaaatcaaggacagttggtcatgttaccaatttcacattaattaatgaatcactgcttgatataaagtcattttgaacagtttcaagctgcattgttaaggggatggatttaaaaattattcaatgtcttcttttctggtttccatgaaaaaccaatttacctttttacagttcttatccttctctactactccagtcagattaaagatgacattcagcctagctgccttcatagtttcaaaagcagttttccttagatgggaccagcagtgtctttaggcctaagtgtgttagaaagctgaactaatcatatctgagaggaggcaagaaagaaagtcaatggggaagaaatgaagcaggctgtccgtggaagagaggagatgaagatccaggaaagatggaaaatggggagtgaaagaggtagactgtggttgacagcttagctaaagtgtctccagcagttatctcaggtgccacttcgtgtcttggactagctagcaagcccactgaggagtgggaatgtaagtaagctttgcaggggtgtccaatcttgtggcttccctgggccacattgaaagaagaattgtcttgggccacataaaatacactaacactaacgatagctgatgagctaaaaaaaaaaaaaagtcgcaaaaaaaatctcatgatgttttaagaaagtttacaaatttgcattgggctgcattcagcccacaggttgtgggttgcacaggcttcctctaggggattcttaggtctcttgctgctgtctgtgttgcctcccattcagattggggctcatcagacactgtggcaatccacatttggagcagtacattggtcattatttacctgttatggaccctggcagaagattacttagggatttcaaagcagcataaagcctacttcttagactctgcagttgagcaagttcacagaaaccaatacaggaatccaccttgtctgtcttatgaagtgcctctcaaatttttctgcttatgtacttgactgtagaggtgatacgaaatgagtatcccaggggaccagtgaaataagattctgaggtttctttgaagtctttttatcttgcaaatccatgcaaattttacattgtgttccataataggtctatttattttaaaaaatagtaatagtaaaacaatactccatcccctccccacatacaaaagtctctgaggctcaggaatatggactgtgcttatcttgtggcttcaagaacacactctccctcggcctccccactaacacatttcatctggggtgcgtgttccctgcagtgctgtggaaaacaaacataacatgtagcttttgaggatctaggctacgttgttggtggcactttggaccttttgctgaatttaaaaggtacctttataagtatgttagccatcgattagacagacccatctgggcaatcctctgctcagttttaacgaggaacctcatgagcagagacttagaatggggctttagtctagagctccttagcacatgttattagaccctataaaccatctcattaatttttacatctctaagctaactggatcagatgtcctgcttcttcctgggcacataaatacaatattctctcccaaagtcaccatacccaaataagttcttccataaggttgcttagagattgtaaataattcatgtaaagtattaaacatggtttcttacatgtagtgagcagccaggaaatggtagctgctattttattattgctgctatcattattgcaatgtgtacctactgtgaacaaagcagcattataaatggaaagtaaagctggttggtggcacattcaaaactgatggctgacagataactttggatcttgaattgtaaacaggtaaaactttttttttttttttttttttttttttttttttttgagatggagtcttactctgtcgcccaggctggagtccagtggtgtgatcttggctcactgcaacccttgcttcctaagttcaagtgatcctcctatctcagcctcccaagtagttaggactacaggtgcacaccaccacacctggctaatttttgtatttttattttttattttttttgagatggagtctcgctctgttgcccaggctggaatgccgtggcatgatctcagctcactgcaacctctgcctcctgggttcaagcaattcctctgcctcggcctcccgagtagctgggactacagatgcgcgccactacgcttggctaattttttgtatttttagtagagacggggttttaccgtgttagccaggatggtctcgatctcctgacctcatgatctggcctcccaagtgctgggattacaggcatgagccaccgcactggcccatttttgtattttagtagagatgcggtttcgccatgttggccaggctggtctcaaactcctgacttcaggtgatccttataatactaagaagtatacactgcttgtgatatgattaaagaaaatggagcaaatgaaattcttgaacaaaaagatatttaagaaataaaaccactaactatactaggggaaaaactgattttagcttcacataatttaacagtgtggccaaagcatagaattctatggaggaatagtgcctagtacagtgcctaatttgtgctgcttcatgtgtgttggttgaatgaatatgatgggttgataccttattatggaagccgaattgtatatatatacctgattaagcaaggaatttgaatgttatctaatggtcagtgagaattttgagcagggaaatgatgtcattcatcgcttgttttagactggaaggaaatgtacaaaaggttatattttatgatagaactatgataaatttcccttttactttgctaacatttctaataacacacaccctttataaagtctaagagtacacttccaaaggtgatagtggctccctgtgaaatgggaatgggggtgagggttatgtatttgaatctgggaggggtagcatatgtactttgaaagagagcacccagggatatgtccttcatgagtatcattattttagagaatccttgagtatcaaatcatagagttcctagagcccctcagctctaaccctcatgttatagatgacatcaagtgaattccttgactcaacccaggactcctgattcctagttcattgttctttctcatgcattaaagttgtggaaaaaactatgcagatgaacagaagggaggattggtttacgtagtttttcttccctgctccagagtaacttttccaacaagcctgaatgttttcatatcatcttgctgtactttaaaaatttaaacatttgtgtcaattacatattcatgtaggtaataaaaaaatctcactggccgggtgcggtggctcatgcctgtaatcccagcaccttgggaggccaaggcgggtggatcgcctgagctcaggagttcgagaacatacagggcaacatggtaaaaccccgtgtctactaaaaatacaaaaaaaattaactgggtgtggtggcacgcacctgtagtcccagctacttgggaggctgaggcaggataattgcttcagccccagaggtgaaagttgcagtgagccaagattgtgccactgcactccagcttgggctacagagtgagactccgtctcaaaaaatactcaccaccccagaggcaaatcagtaaaacatcttgtcatgttttcttaccagtcttttttctaaatgtgtacttttaaaattagaattgtattgttttatagctttttatatgtttatatatacaaacattcacttaagtatatgtaggtgttgtttttttaatttttttttttttttttttttgagttggagttttgctcttgttgcccaggctggagtgcagtggcctgctctcagctcaccgcaacctccacctcctgggttcaagcgattctcctgcctcagcctcctgagtagctgggattacaggcgcttgccaccatgcatggctaatttttgtatttttaatagagatggggtttcgccatgttggccaggctggtcctgaacctctgacctcaggtgatccgcctgcctcagcctcccaaagtgctgggattataggcgtgagccacctcgcctggccctatttaaaatggttatgtagtagtaatccatcatacagatgtgccacaacatatatgattaaatctctattgttaggtagttctcaatttttcaaacaagcaactattttataaatgcaaatagttctaagaacgttaggagacttcgagtcattcacatactagttcgaattagttaatatctggtttctttttactacctagttgagagcagctagttggagaatggaaattgtgatttggcatgaagcacttcaggaagagggtgggcttgggaagggctgtgaaggggtagagttccatataggctgtttgaacctcagaaaaagggatgtagaaaaaggttgctgaatggagtaatttcagtgttttgcacaggaatggctctttttctttttctggtccgtatgacttttgctttaagactattgctcaagctattttgtaagtttggggttctcccacacaagtacattgactaagcattggttaaaaggctaggcacctgagtaccacttacatgttttactttccaagttccaacctaactacttataaacttgaaagtagttatgaattgtgggttacctatagtcaaatagtagggtttttttttttttcagtcaattggaaatgaaagggcaggtattggcaaggcttcgggactaatttaatgccattaggaaagcacaagataatgtaagggctaaaagcctcaaaaaaaaaaaaaaaaaaggtgaaatgaggagttgttgctgattggtgcaggaacctgaaagatgacacctgaaaactcaaattacatttcaggaacttgtgctggcgagagatagggataacacagataaaagtgtaatttgtagatattctaaaatcccttatcttagccaatagtttcagccgtggcttaaaacaatatatctatctgtactttagcaaaatgggtggatttgcatttcacatgctcctcctttggttgaaaacaactgattacataggaaagggaagatgatactataaactaggtcttcgttctcctacaatgtgacattggacaaggcatttcgtctctctggtttctaacctgcaagtaaaaggatgattaatattggtttagataatttttaaagttcctttagaacctgaagggtctttatttctacaacaaaaaaatcacccatgaggtagaattggctatacattctcaaatgtaaaaaattaagcaaaatgctgatctagtaggttcacataacttttaagtaaagcatcttgaaggtgtccctctatcaactgaagaacaaatgtctgagtttaatatatgactgcatcaaaaaaaaaaatatatgcaaccgcagtaggtgaccaaagggataagtaactttcaggaattttgaaagcccagtagtatttagtatatgctctctcagcattaaaaaggtcaccttgctaatacatgttaattttgaaagtttaattgacctttggaattttaatatcaaccttttttggtgtggttagaggttggagcaatcactgaagaaactgaagcctgtgattggtggagtttgggtgctgtcctctttgaacttctcactggcaaggtaagcagtggcctggacgtttaataaatttactcagatgctaccttgatttcaaattaagaacattagccttcacccttagtttttaaatcagggactaagcaagaaaaactttgatatcgaaagcaagtagagaaatgcaagtttatcaagagtccagattttttttaaaagttggattgcattacattgaataaattgatggtaaagttattttatgtcacaatatttcatagtgaaatatgactaaaacttttttcttttaattttccatgattcagctttaacagggtcaaatctgtaaggtttatgtaaggatgtattaaaattctctggatgttttaaacatattgtctgaaaccaggagagaattcttatttaagaaaattaacgtagatattaaagttaacattatctttttctcagtaccataaatttttcctatctgttctagcttaaggacagaaattatactctcagatgaatgacttttgaatatgatgtttgagttagtagactttaataaagtattgtgcagattgcctcctgggaagaaaatgaaggaaatgaaggaaatgaacagttacacttttgtaaatagtcatctacctacgtgtgtagataatactgacctaagattgctggggagtttacaaatcacctttacatacatttaaactgtaaagtgctatatatgtatgtaaagtattatgactaacaaattctaaactctgtagggtttttaaaacattaaaacattttaaaggtatcaaatctctttttagttttgcgtataatttaagcttttctataatattctgagccattaattttataactaaggacgacgggacagtagcataagcttatgatgtgatcatggtgattgtcttcatttcagttaaaagttctataggctcacagccctcatcctaaactgcttaggcggcactgtgttgattactacacttccagttaaaatggttgttgagctctctgtacttgctgtccataaatcctatgatagaacaaaatatgatgttatttgggataagaagtgtacctgattgattgtttcagactctggttgaatgccatccagcaggaataaatactcacactactttgaacatgccagaatgtgtctctgaagaggctcgctcactcattcaacaggtaatttaactgacctattggccaggtttatcaaccatgcagattagcagagcccacaactccaaaaccttaaaaagagattagtttggagcaagaaaaacccatttaacgtaaaacaaagacacgttcagaattaatactgtatattttcaggctttgctatcatcaaagtattgatggggtcagagagtatagttaaaacttcttggtattaatttttttcccaaaaatttagggctcacagtcatttctgtatatttgtgtaactctgtgatttgagtattgcttttagcttgtctgaggctgctctaattttgcagttacattttgtaaccgtatatgaatggctattttcaatttttaattcttacttataagtttactcaggtatttataaagctactcaggttgcttaggagagacatattagaaaatcttgtcaagttagatacttcatcattggtggaacttgggcattggtgtcagtgattatatttctggtggctttgaagaaagagaccattgataattaaagttcagtatcccagagacaggcttggaactccagtgaacttcttagattgattcctcatacttaaattactcttctagtttcgtgtagtgaattttgctgatattgagggttgttagtactctggtgtgacaggcccattgctgggctatcagcaggaacaagaaggcctgggatccttatgcttttatgaaaaatataatggaaaaagttccttgaaaaatatcaagaactaaaattatgtaatgaaacatggatttaaaaaaaaaagtcagggaaaacaaaaattaaaagagggcaggggagcatatattaggaagataattgactagtattctcttgaagagtgattttgctttcattcaacaaatattatatacaaggcacagtgctataagctacaaaggtaagacaggtaaataaccataccacatggaaattgataaaggctgtcaaagagttttaaaaaatactgtggcaagtcaaaagaagggggcggatataatccgtggagtggtagtattaggggaagtttttgtggaatggatgctacttttgctgggccttaggatttcagcatggcaaggatgtggggagaatagtcttggtggaatgaatggtttgaacaaaggcaaggaaggagtctgaaagacccaagtttaggaaacaaagtttgatttatctggaatagagagataaataaaggtatgggtgataggtgagcataaaaaaataagttggggttttcttatggggttctatcatcacaaacacaagagtaatgtgataatatttaattcattaaaatttgagatttggagtttgtggagaagagtaaacagtttagagttgtacttcaggaagattaatttgcccagagtatgcaaactataaagaaacaatcaggttggaaatgttgagatgagaatacctagagcactttagattaagaggtaatgaagagatacataaaacatttcattctaatggagaaaaaaagaacagctattcatttgatttcatcttattcgttgtggcacgagataaattccaagtattttttagtaagtagtttaggaaagactggcaactgctattttttgtttctcttccttaaagaagtagtcattattatataatattaaaaatggaattcctcataataagttaccaagttctgcttttgtctttattagaagttaggttgtaaaggaatctaggcttaagatatggtaagtccccaaactcagatatgtatagcttatatagtaaatcagcattgtgtcattggcctgcctaaggaaactaccactcatgttgaggaaacatcatcaggaaagggaaaaggggtctcttggcatgattagcaatttgtcattttgactttccttttccactacctcacaggtcatagaggtcactttaaaaaaaaatcacaaaatgatttatatggaaataattctacgtgggggaaattttctcctctttggtcttttagctccttgctttgttcttagatctcataatcccctgtacccctggttcagttatctgtccaagtcaagcaaatggtgccaaagtaaacataattacattttaaatgcaatcttaaaaaagtccctcagagcatgtatgtttgtgctttagcatgtacattagttaattatgacacagttgcttggtcagttttaagaaattatgtgaggaaaagaccaaaacaaattttcatgccctcattgctcagctctgttgcctattcttcaggagaaaggaggttggcagctgctgtcttggattcattaacttgaatgtgccactggctgacattttcttaagcagtagaatctttgtgtgacctctcttgaggtgtgctatagcctttaaaatggcagaataagcaagatagtcatagttaaaacaattatacttttgcctatagatttatacttgcagatatatagaggagttcatgaactaattaaattgactttagtaaaagtcaaaatatgaacctttagaatttcacatttaaagtatattttagaaagaagccagttatttataatgaagaagaaagaacttacatgtttatgtgtttcctgaaatactaaatataattgtcattgcagttaattcttaaaaatatttgaaatgttagatttatattaaaatgtttggtgccttccacattttagtcagtagacataaattgtctgattgtgaaagtggatttgatatatgtgggatattcctgtgatgtttgttttataacaatagcttttctcttaacaaatcgtagcaactactaatataaaaattctttgagcaattaggtttaatcaacagtgtagtatggttcaatttgagtgctagaaataatttcaggtaaaagactgttagtatagtcttttgaagtgtatgtttcactccccttatggatttggtaatacccaagtgaagtaatagattcttagcatttgcagatctcacttttgtgaggcagtgtaatgttgttgttaagacatggattctggaatcagaatgcttgaattcaaatctttgccacttactacctgtgttatcttaaacaagttacttaatttccctgagcttctgttttctcaactataaaatggagataatagtagctattcatagagttgtgagttaaatgagttaacctatcataagcacttagaataagtacctggcatgtgataagtgtcgtgtatatctttgttattattattgataggacagtgacgaacattcatgacacagtaatttgcaatttgatgaagcatatattggaattatagggctactaatgaagaatgaggctattgctattgacacaggtcaacaaaattccaaaaaagtagtggactggcatataataggcaaacaattgatacttatacaaataattgaattatgaatgaaagaaaaattagaaataatgaaaaagagaagaaatagaagttttggttaacatccaagagtggaatttcctatatattggactacaaatgttgtaaataaataatttaatatttcagttgcacttgactactttctgtggaaaaaaaatatgtactgtgagtattcttaaatttgagtggctgtggcttcatgagttagttggcagagtttctttcccccaaaaagtatgaagttagacagatttggtaaaaaaccagtcatttcagtgctctggaaatggatcaaaggatacaacaatctgaaaggtgtttatgcttaaaaaacagctgaactggccaggcatggtggctcatgcctgtaattccagcactttgggaggccgaggcgggtggatcacctgaggtcaggagttcgagaccagcctaatatgatgaaaccctgtctctactaaaaatacaaaaattagtcggtcgtggtggtgggtgcctgtagtcccaggtacttgggaggctgagacaggagaattgcttgaacctgggaggcagaggttgcagtgagccgagatcgcgccactgcactccagcctgggcaacaatattgaggctccgtctcaaacaaacaaacaaacaaacaaacaaacaaacaaacaaacaaaaaacagccgaactctgggcaagaacagtgggactcttgactcaggcctgctttcaatctccccttcctgcttggtcaggtgcaaaggttctgccagggtagggtaaaccatgaggactgatcctgaggctgtataaatgtgcacaggaacagggagtgggcccagcagaaagtaaaagccagggcagatgtggttttgtggcctaaactttgaatgtgttctgctatgcgttggcagagaacagaagcttgaagggctgagatatttgaatacaacctctgttcagtcactggttgacccataggctatacagacacaggggtgaccccgagaaagccaactttaaaaagaaaaaaaaatgtggaaagttgtcagcagctgcacattacaatgcagtgggaaggggacttagcagctttacagatctaactgaaacaagttaccaaacaaagaacaaacaatccaacagcaatgataaacttcatggggaaaaaatcagactctagagttgctaaaatatactatctaaaatgtcctgttttcagtgaagtgtagtgtaagacatacacaaaaacaaaaaaagtatgtcccatattcagaaaaaaaatcagtagaaattgtctctgagtgtacccagacacaggatttatgaagactttaaagcagctattgtaaatatttccaaagaactaaatgaaactgtgtttaaattattaaaggaaagtatgacaaaaatgaatcaacaaagagattctgtaataaggagacagaaagtatatttttaaaaaacagaactaagtagaagtcacaagttgaataatacaatgactgacatgaaaaattcactagaaaaaaaatgactgaagtggctaacagcaaatttgagatagaggaagaaagaataaatgaacttaaattaatagaaattattgaatcagaaaaatggacacaaaaattgaaaaaaatgaacaggactatggaaatctgtaagacaatagcaaatgtaccagtatacatataatgatagtcccagaaggagaggagaaagggaaagggacagcaaaaagaaataatggctaaaaacgttccaaatttgattaaaaacattaacttatgcatccaagaaactcaacagaccctatgtaggaaaatacaaagaggtctacactgcaacatatttagacatatccacacttaaccaaattgttgaaaggtaaaaacaagaaaattttggaaacagtaaaaggaaaataacttacatagaaggaagcagtaatgtctaactaattatcaaaaacatggagatcagaagatattggaatgacacagtcaaagtgctgaaatcaagaagcagcagtaaaccaagaattcagcaaaattatccttcaaaaatgaaggtgcataaagacattcccaaatatagaaagactgggaggatttattgctagcagaactgccttacaagaaataccacaggaattccttcaggctggagagaaatgacacaccaggtagtaacttaagtccaaggaggaaatgaggaacactgaaaattgtagatatgagttcatagaaaagacaaaaaaatatatattttatttatatataatttatttatatatttatatattgtatatataaatatatattttttatttaaaagacataaaattgcatgtagcaacaattataaaaccatgctattgggattaacatatatagaagcaatatctaaatatgacaataatagacaaaggaagggggctatggtagagcaaagtttctaccttttgctaaattaaagttactattattttgaagtagataaatgatcttataagataagtgatatattaagtgataagatgcatattgtagggatacagcaaccacttaaaaaaaaacctaaaaactaaatactaaatgaaaattagtagagaaactaaaatggtacagcaaaaagcatttaacacaaaagaaggcagtaaaggaagaacaaataagacagtaaatctagaaaacaagtagcaaaatagcaaatataaacccaccgtgtcaataaagtgaatatctaaacatgccaaaccaaaggcagattctgttaagctggatcttctgtgcgtgagagacacaccttaaattcaaaaacacaaacagattgaaagacaaaggatggaaaaggataaaccatactaacagtaaccacgaaagagctggagtggcaatattaaatatcagacaaaatggatattaagatagatttactaggatctgacacatgtttcatagtgatagtacaggggtagctgtaacagttacaaatgtatatgcactaataatgacctcaaaatataggaaacaaaactgaactgaattgaaaggaaaaatagacaatttagtaatagtaagtggaggctcaataccccattctccatgatttatagaaaattagcaaggacattgaagacttgaacaaactgtaactgacatgtatagaacacttcacccagtgactgcggaacacacattcttatcaagtacacacaaaacaatctccaagatagatcacatgctaggccataaaacaagttttagcatttaaaggaattgaattcatacactgtattctgaattacattgtacactgattataataaccataacaatcaaagtagaaatcaacaagaggaggagatctgctaaatccacaaatatttgaaaattaaaacagtatacttctaagtttaaatgcctatatcagaaaaaaagggaaggtttttaatcagaatcttagcttgcaccgtaagaaactatgaaacaaagctagatgtggttgtgtgctcctgtagtcccagctgcttgggaggctgaggtgtgaggatcacttgagtacaggagttcaagaccagcctgggaaacacagtgagaccctgtctctaaatttaaaaaagaaagaaactatgaaaagaaactgtaaaaagcaaagtaaatccaaagcaagcagaagaaaggaagcagaaatcagtaagatagaaaacagaagaataagaaaagtaaaaccacaaggtagttctttgcaaagatcagcaaaattgggaaacctttagctggttccaaactgtgcataaaaaggcaaaggagctataatgtccaaaacaattttgcaagagaacaaagttggaggacttacactatctgatttccacaccaactataaaaccacgatagttttaagaccacagtgtttttctaacaaatggcactgggaaattgaatatgcacatgctaaaaacaaaatgaacttagacccttcatactgtttgcaaaggttaactcagaatagctcatatatttgtatataagagttaaagccataaaaattgtagaagaaaacaaaggagaaaatctttgatgttgagttaggcaaagaagtattagatgtgataccaaaagcatggtccataaaaggaaaaattgataaagtagatttccttaaaattaaaaacttgtgcattcaaaagtcaccattaagaaaatgaagacaatagagtgggtgtggtggcttatacctgtaatcccagcactttgggaggccatggtaggaggacctcttgagcccagaagtttgagactagccttgacaacatagtgagaccccgcctctatgaataaataataaaaatataaaaattttaaagaaggaaaatgaagacaagtcacagactgggagaaaatatttgcaaatcatgtatctgataagggacttatattcagaatatataaagaactcttgtaattaagtaagacagacaattcagttttaaaatgggcggaaagttagatatttcaccaagaaagctatttgaatggctaacgagcacatgaaaagatgctcaacattattagttgttaggggatgtaaattaaaaccataacaagatactactaacatcaggagaagggctattatcaaaatgacagtaccaagagctgaggatgtagagaaaccgaaatcctcatacataaaggtttgtgggaatgtaaaatggtacaactactttagaaaagtttggcaattttataaaaagttaaacataagctcattatgtgacccagcaattctgcttctagcaatgtaatcaagaaaaatgaaaatatatgtctacacaaagacatgtacatgaacgttaatagcaacattattcattatagccccaaactggaaagtctaagtatctaaaaactagtgagtggattaatgaaatgtggacatccaaacagtggaatactaagaaaaaggaatggcctgttgatacctgctacagtgtggatgaatctcagaaacataatgataagtgaaagaaggcagcgtcaaaagactacatattttattattttacttatatgaaatgttcagaaagggcaactttatagagacaaaaggcaggtcagtggttgccgagggctggggatgggggtggggattaactgtagatggcatgaggaaactttttagggtaatcaaaatgttctaaaaggccgggtgcggtggctcacgcctgtaatcccagcactttgggaggccgagacgggcggatcacgaggtcaggagatcgagaccatcctggctaacacggtgaaaccctgtctctactaaaaatacaaaaattagccgggcatggtggcgcgcgcctgtagtcccagctacacgggaggctgaggcaggagaatgacgtgaacccgggaggcggagcttgcagtgagtcgagatcgcgccactgcactccagcctgggcgacagagcgaaactccgtctcaaaaaaaaaaaaaaaaaaaatgttctaaaactggattgtgatgctagttgcacaactctttaaatttactaaaagtcatcaaattgtacacttataagggatgaatttatataaattatccttcagtaaagttgttaacacaaaaatttgacattattaaaccacaaaatttttttttacttattttacacatgattcctatttctgaagaaaccaaaacttgtttcattcattatattaaattatttcatttgtgtcaactatgccaaagactagtgattttggaatactaatcagcttattcacactttaggtaaagtttagtctcaatacatacatagttgattaggggtcgaaagatttactgtgcttcccaaattttctaatcatgaaggaagtaactggctatctcagaatctagtgcaatatctaattaatgtcatggtgtacttttggggtaggaaattgataggtataactatcctattatattacatgaggatgagggaaacaaagtaagttactcaaggccatgtttcccatcagttgaaaagccataaactcagttcaggtgtctctcacaccccacagctagaatggtattagacatagctccctttcaagaaaaatggtcacttggctattaatcaagactgcttgttaccagggttgaatttagaagttgtttcttttcaaatattggttttcctttgatttgccagttggattcctgttactcactaagtccgtctttttttagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaagagaacaattcgtttacaattacaagatattagctaattgtgccaggggctgttatatacatatatacacaaccaaggtgtgatctgaatttaatccacatttggtgttgcagatgagttgtaaagccaactgaaagagttccttcaagaagttcctctgataggaagctagaagtgtagaatgaagttttacttgacagaaggacctttacatggcagctaacagtgctttttgctgaccaggattggtttatatgattaaattaatatttgcttaataatacactaaaagtatatgaacaatgtcatcaatgaaacttaaaagcgagaaaaaagaatatacacataatttctgacggaaaacctgtaccctgatgctgtataatgtatgttgaatgtggtcccagattatttctgtaagaagacactccatgttgtcagctttgtactctttgttgatactgcttatttagagaagggttcatataaacactcactctgtgtcttcaacagcatctttctttccccatctttctattttctgcaccctctgcttgttccctcatattctgttcttccgactcctgctaacacacatgcaacaaaaaagggaagggagtgcttatttccctttgtgtaaggactaagaaatcatgatatcaaataaacatggtgaaacatta

SEQ ID NO: 800 - DNA, 222222 bp, Homo sapiens; identical to SEQ ID NO: 799

SEQ ID NO: 801 - DNA, 305497 bp, Homo sapiens
ggcaaaatcagccctccctcctcccgctccttcgccgcggccctcccctcctcgcgctgctctcgttcgcttggctcagctcagctcagctcagcgcagctccgcggccgccaagccgaggcgggcacggtctccgagtcgcggacgccagctccgagctccctctctccgccgcgcctccgccaggtcgcgccttcgtcgggaccacttcgggcaggagtcgcgtggcgaaggcctgcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcggtaagtggccgcccggcgtggcattaggagagcgggacccggtccccggagggcgccgacctcgcggtgccggaggagggcgcgcggtctccgggcgcgtggcgcgggtgcagcccggcaagggcccttctgtcctggctgccctcggcccttgcagtcgcgagctcggcgcggatcataatccagcgtcccgggccgtcgcgggggccgcagccaggagaggcaccccgcgtttccgacgcgcggttcccaggcggaggatgtaactgagccacacgtcacgccggcctgactgcaagggaggctcgcttctcccccggccgtctgcaggagggaagtaaaactgcctttctccaaatcggtctggaggggacccaggcttctcttggtcgggtcccgggcaaggcagccactccagctttccccgctcagtccctgaaggagagggtacccgattctcaaagactggccctgggcgggacagccactccggcttccctggataggtcccttcaggagaagggactttggcttctccctaaccggtcccggggtgcgggaaggaggggcagggacagcctaaagctcctcgaaagggtccttggaaagaaccccaaattattctctcgtggtcccagacgagatagagtatcttgggtttccagaacaggttcccagtggggacagggtcctcaaagagcttggggtaagctccgagctgcaaggggaattggatgaagatggaaagagaagccccgatgcccgaggcctgctccctggaggccggggaaccttggctccggcagctcggagtctccacgtcccagggatgtcgcgcctacgccgctcggctgagagtggggtttcgggagctcagggaggaggtgtccaagcaggtgagagcctcctaggcgggacaggcagttcgaccagcaccgatctgaagacgcctgactctgtccccacgcccgccacctcgctcctcagcagggtcatctccccagacatcgtttccccgtgcagcagcagccgctctccgggtgggggacaggtaaccaggaagggaagcgagcctgtctggcctcaccttagctcccgccagggagcgtgtcctctcaccctcgccccttcataagtcagctctggtgctaagcagggatgagcgggtcactggggcacctggtggggcaaatgggctcccagctgctgtactttcctcctcgccttcccagttccccagagagccttggacggaagcggtgggagcaacacaggagaaagtctggggcagcgtcagcgggcgccagggtcacgccggagaccaaagccaggggccacccttcttggagcgcttttccccctttcccgggtttgtgtccccgactttctccacccggagctacccaaagccggctccttggtgcccttggcaccttggcgtgctgagcactttgcgaggaacagtctgaccccggcgcgcagctccgcgggatcctgggtactccacgaagaaagattctgggcggagaacaccccgcccagcccgggagggagcgcgcggcttggcaccgcggctagagcgagccgcgccgacgggcggcgactgccactcggtgcagccgggaggcggccgatcctccctgtggaccgcagggaagcgggtatgacttcagtggcctattcggccctccccaaaactgaggacctgagttcacaggggaaactgtccccgctccacgtagcagagaaagaagtggctctggagtccaacagacttgggtttactcgctgtgtgaccttgtgcaagtcatttaatttctctgcacctatttcctagctggaaaaaaaaaaaagctgtttatccaccctctcttggtggtagggagtaaatgagtttacaaaggtgagtgtgcctgagctaaaagagattcctaataagcctaacagttgaatgtgaggcctttattggtttactaatggaggtaggttcttgatcagatttttgtttttgaagagtgttgtgcgtttgaaagcaggtttcctcagctctcctccagtcccattcatctaccagtggttatttgggtcctcatgaattaattgaatgaatgaatgaggtattttttcatatcaggagccttgcctaagactgttgctaatgcaagcccaggaagattttttcagtgacttagactagtctgaggttcaggccaagtgtacccagcgtctcttttcacactaatcctccgtgttttagttgagcattggcagctggtggccctagcactgggaaggagatacagctggtattcacggggccaaagaggtttcagaactacctaaacgtccagggccagcaggtggggaactgggactggatagggagtgtcctggactttcaccctacaggctactcctgcctaaacagccatctggactttgacaccccaactcaggctatagattgggcaatcatcttttctcccttcttatggctaaaagaccttggaagagatcttgcaggaaccatgctgaggttttccaagtaaatatcctgcaattagcaaacctgattctgccactcaaagtccgaaagaaaaggtactggcctagtttgtgacattttctgttggctccttctttcttagaataattatgttaaaagtaactcaaacacattctgctcattgtcctgacttaaggctgtgaagctggcattcccctggtgttctatttgctttttaattttttcatgaattaggattcctcacaatccttggaatcaatgacttgttttcctgcctcaaatctttgtccacagtattccagttcatccccaagcagcttctgttctttgtgcctgctgtctaagtacagtctttaggtactctagaccggaataaaatggtcactattaaaaaagactgaaacatggagtttcttccccaaaacctgaatccagttgagatcattattttgtcttttccaagttgttagtattatattgatttccttttctttcccaccacttctctctactctccctccctcttcccacagtcccccctccctccaacggcaataattgtgctttagaaagctctgaaaggcctgctctgtttctggccagggcctcctttgaaaaggagattacagtgattaaaaataacaagttgaggatcctcaaggggcttcccttatacaggaggacaattcgcaggaccagcctttcccagatcacaatttcaagccaaacagaagaaaatccactgaaatattcaagaattgattgaaaataaaagaggctcttttgtcttactggaggtctgtttattaggaaaataaagtcagactctggctaatgagagtggcttttcctagatgtattttaaagagacatttcaaggaacttgatgggaaaagaatgtccagtagaggtttcaaaagctggtccaacttcaagcataattgaggggtttatcctaaactgggaggtttggagacctccaaagctgcatggtttttcctttgtcccacactgagacacacactgaccacaggggtggacacctcagcctggtggaaagcgcacaggctttgatgttgggtgggttggtttcaggtcctccttggtcacatattcactgtgtgatctcaggaagccacttcacctctctgagccaatttctccatctgtaaaatgagggtgttttgattttttcccagcattcctgtgagaattagaaataattcatgtcaaaagaaattgtcacacagtggttgctaaaaaaatatgttatgagatgattattttggaaatagaaaaatacttagcagcaaagccctggataagatattgtgttaagttcttccgactcatctcacttattccttacagtactttgaggaagtttctgatcgttactgttttatggatgagaagactaaacctcagagaagtttattccttatccatggtcacacagctaataatcagcagaatcaggatacagtctcaggtctgtctgactcctaaatctgtgctcttaaccagtcttatgtgctgactcaatgaaattagttgggaatagaatgaaattcactcagctaccctcagccttctggatggtgagccttccttcaaggaaaacagaacaacaaatcaagatagtaactgacatctctcaggagaattactttatattactacaaagtaatataaagtgataaatccttattcacatttgctgttttctcttattggcttcagtgttgcatttccccataaactagaggattaatttagaaacatgaagaaccttgtcagcctttggccaattccttttgtttgtggggaaacaaaaacaaattggataggaaaaaaaaaacccagaaagaaaaaaaaaaaaagaaaaaacagatttgactgttgttttgtttttacatacagatgttatatgaccatgcctgtaaaattatatgtttggaaaggacatatttaggctctaagaaatttacacaagatgaggtcttttaaataaactatttcctggatggtggagtttttaaaaacttaagtgctgctgatgatattataattaagccacccctcctacctctcttcccttttttgcaccattccctgcttttttgttatgtaactatttctaaccattacttaagtatttagttcaaactgataataaaaattagaaaatgcaaacatagctaatgcttaatggttgtggagattgtttattgctctgagttttaggaaatgaaagaaataaaaacatacaaaaaagcatatcaaaatggaatttttcaaggtttaaaacttgagtactcccccatacacagataagctgtttcattacagctgactctttcagttgcatcaagaagctataatcactgatacgtttaccactatgggctggtatatcaggagcttttcactctcacactgtccatttgcttgttatacagactgtcacatatatataggtcaatatcaatttctgttgtgaggtggggggactcttaccatgttatattagtcatagtacaggctaagctcatgttactaacagaatccaaaacacagtgttttaaacaagaggtaaatgggagatccagcatgatgggaggctttgctccataaggccatccaggaaccaggctccttctaccttgttccctgacatcttcttgcactctgctgtgtagttggtggctacttagccgtgtgtagctatgaagtacttgaaatgtggctattctgaatggagatgtgctgtaagtataaaatacacaatgactgttgaaaatttagtatacaaagagtaaactcattaattgtgtattattacatattaaaattataattgtataaagtaaaatacactagttaaaactaattttgcctattttcacttatgttaatggatacctggtaacaaaattaatttcacccagcttgagcttatttctactaaacagcactgttttaagttgctgttctcctcagcaccgttacagccgaggagaacctctgcacacctgtattcagtcagcatgcagtggactggggggagaggaagtagaggacttcagttttcttttaataatgtgacccagaaactgcacccagcacttctaaacacactccgttggcaaaaattcagtcatgtggtcatacctagctgcaaggaaggctgggaaatatagcatttagctgggtagccacatgcccagctaaaacttgaagaatttatttttcaaaaagatgaaacaaagtaaatttctaaggatcatattaacggtctctgtcacatattttcatgcatagtcatgtaaaaacacaatatatcttactttctcagtgaaaggtcagctaggtgggtcaacttgacaacatataaactgatgttcctgctaagaatcagcagaggaagccagatgcagtggctcacacctgtaacctcaacactttgggaggctgagacaggtggattgcttaaccccaggagttcaaaatcagcctggacaatatggcaaaacccatctctacaaaaaaaaaaaaaaaaaaaaattagctggctgtggtgtctcatacctgtagacccagctactcaggaggctgaggcaggaggatctcttgagctggagaagttgaggctgcagtgagtgaagattgtgccagtgcacccagcctgggcgacaaagtgagaccctgtctcaaaagaagggaaaaagagcagaggcaggagtgctggggtgtgtatgtgcaagcttatgttgtggcttgttttgtctcattctcctttctcaataaaagaggaagcagcaaagaatgaaaggaatgagggtaaggtaaatcaagaaaacaaaggggtggtgtgggaagagaaaaagaaaaatgaaaacccactggggtatacattcagaatgaaaatgaaagaaaatatttgagtatggcagagtcccattaggatgggactacagggctagatacaagaagagccatggaaagcaaacatcacataagtcaaaattagtcctttgaaattatacgtaagatataacccagataccagcttcaacctagccttatctaaacaccctacccccaatattcctgtaagtgaggaatagaaacgaattggcatgtatcaataagtctagcccttctagtttccctccagcattggaagagagcaatgtttcctcagttgagtagcagataaacccttggtttgctctgacatgcaagtacaaaatcttcatcatgtgatggagtaagggagctgagaggctcatctcatgctcactcaggcacatgcatgcattgaatggagtagcaagtggcccaaatcatttaaagcattacattctctgttttttctcctccaatagtgtgcagttgtgtttgatttttaccaaatgcacctctcttggagcatctatggtgtcaggaagcttgctatatcacataaaaagctttttgtgatgcttgtcagctcctgctggtataaaatgccccacttttacagaatgttttggcagggatggagttggggtgcagataggacagggcaaggagttaagtgagaccactagaagtcctttgtgaggtctatgtagagcaggcttctacctttcgcagaatattcataaattccatgaaatgttcaggaaaacttaagggacctacccacatccactgattttcttgaggctaggagacccataggaaataacttgaaccctctctacagttgtggttgagatatttgccaatatgtctcatggactgggtgagagaaacagggaagagttccaagaacaagtcaccatctgtggggcaggagtgtgggcaggtgggcacagtcacagcaggatgaaccaaatggtgattctaggtgctacaggaagctcttttctcctcctcttcctcctcctcctccttgtcctccccccaactcctgccaacactatcctttgaattttccaaatacactaagctcattcgctccccagggccttcatccttgctcttcatgcctgggatggttgtcctcagatctttgcatggctgactccttgtcttttaagggaatctctttaaagaggctgctctcactaccaatttatgtttcccgtcactttcgcctgattttgttttcttcatagccttaaacactctctgaaattctctcgtttattgtctgcctcctacagctagaatacaagctttatgagagcaaagactttgtctttcttatttgccattttatcttcaattcccagaacagtgcctgggcatagcaggcattaaatcattatttgttgaaaaaaataaagtatcattgaagccccaagaaccctggtgtgagctctctaagagagctggatggaggaaggggaaggtatttctctctcagccagagagaaaggtgagcacccaagggatggcagacaggaggcaaggagctccaggtggtggcagcagagagaaaggatgccagtgccacaggggcgttggccagaggctgagggcagatggcctgtgtccagagtgcagaccactgggagggaagagagagcagttgcatcatggtggaagctgaaacgctgctgctgtggcatgaaaagcagagcaacagcaggcaaaagggcagaggcaaggggctgccaacctcagaaactggctctgagaaactggctctgagtatctggagaagtaggcctgaggggattattgagccatcaaacctagacatcaattattaaagtgacattccctagaaccagcacattgtggagtcatttgtagtactttccaaacctagctatgcctttggagagtgtaaaaactaaactaaaatttaatttaataaaaaaacttcctgggccccaccctaacaaaaggctggattccaggaatcttatattcttctttcttttttcactcttttaaaggaaaatgatgagacacaaagaaaaggtggcccttttcctatgagcatgcttccccatcaccacctctcctagccccagccccagcctcccacacactttagcacctggtcacatcattgccctatcctgttactatgggacacactcatttagtgaccagtggaatatcctcaaagccaacatgactgcaacatttcccgcttggcagtagggtgatggggagaagagaaccatgagttttccttaggtggccacaatcacagactggcgaagcttgagccagggctgacttgcttgtacttctctgccaccaaagtctgcctaccatgtaactttcacacatctgtccaaggttctgtcctttggaatcaaggaaaataaggtctcccctgggccatatgtcagcccttgagatgtttgtgaataaatagctgtcatggcttctcttctgactaaaatgccccatttctttaaccattctttgtgggttgcagttgcttgctcccttgtactttgtgccccagatgtggtctgttaggggcaggacatgatagaatgattatctccttgtcctggacattgtggttgtgtgaagcttgccaggtcttgtgtttgctattttggcagctgtgccgtagtctggaatcacactgagcttgcagccaactcaaattcttgcaattttctggaaggcctgcttccctctttaacctagactggtgaaaatggtccttgaacataaaatttgacatggtttatcgttagatttaatccagcatgtttggatccatccctgtagctgtcagccattcatgaatctgtatttggtccctgagtgatttattcacataatctaattttggattatgcacagtgttgataagaaggtcttgtaagtctttatcaatgaagttgataagaatattgagcaactcagagtctaggatagagccctctgacattccttagagtctttctctaaagctgatatttagctaaatagttttgaagtcaagagatctgctgtcatcccaatgacatttacataccaactgccacccccagcataagccacctcagtttagttctgaatactgtttcctgagcctgctggtgattcttgtagtttaggcagagtgttttctttctttgcttcaaaattagtcaggactctttccactgcaagtgataggaacaaagtcaacctaactaaagcagaaaagggaatgcactgattcccatatttgcaaagcccaggggtggctcttgcttcaggcataaatgggtctagtgactcaaatggggtcattccatctctctctctctctctgtcccccgttccctccttcgctctatctttttgtccctcgcttctaccttctctgtcttgctccttccatcctcaatctcttggctgtgttttgccctcattttttcttactacagataaactttctccaaatgacagggaggatagctgccagcaaccttcagtgaaaatcctcttagctcatcctgtgactaaaagaaaagcccctttccttctaactacaaactgaaacatcccagggaagattgtgattagtccagtatgggtcacatggccagggcaatggcatggagatagactggatctggatcacagtcacttttgtgacttgatatttgaggaaggaggatgaactgtgattggaagccccagtgaccacagggtcagagtaggggcagcagtgggggtcccccagagcttcctgccctcatccacattcccagctacgttctcttggctgacacatctctacctccccagaggcatccttcccattattcctcctgctatccacgtgttgttcagctcaggacccattcatctggctctgagctgttccacgacgaggtcacacaatggggaaaggattaacttttattgagctgctgcaatgtgcttcattgcattatctccttgaatcctcatgacaaatccacgagatgataattatgatccttatttcacagaggagactgatttatttttaatatattttattgatttagcaaatgtttttatatacttcctattaccaattcattaattgtcatgatgacaacaggaggtaaatactattaaatattactgctgttttacaggtaaggacatgtagacaaggagagcttgagtaacttgcccaaaattacacataataaacagggaaatttgaaccaagtctgttaactacgtctgttatagaaaaatgacccttacaaatttaagtatgcatgatcttcagtttgagtgggagaaacttcatctctgcctggggatgctgagagcactggctgaagaaggccatccaggggaacagcataatccaaccccaccatcctcacctgctcacttttggattctcagtcttgccttccagtcttccaggccatcaccagcaaatcttttcttgcctgacctggctaggtggcctgaattactgtgccaaatttttaaatagaaatatatgagttgcagctcctcagagctctggaagttgtgcagaatagaaaggggagcactgtgactaacttaatgtcccaacagtctttataactccatgttataagttaaagcagaagctgacgcgcattgtggttgaggtgtgtagcaagactggggcatttcagtaacacatagcaggtggatggcaggggctggccataggatggagctgggactcagggtcttctcattgaggttggagttctattaataattctgaaacccaagagacagagtgcggaggaagatggaactggacaagatccagtgagggtaataggcatagaagatgaatttgggtaatagtttattagagtttttgttagaaggttgacacaccaacatttgaaagacccagaaagctatttggtaattaggtagggtaagtgtacccaaggatggaaagaactctgccctgggtcgggatttgaggccaggctctagtgtgaaatatcagtcttcatataaataaggcaggcctttgttactgatgtggcttttagggcaaagctgtaattcaataattacacaacctccagcctgatcttcctaaaccataaatctgaatatgaaatgtcctagcgcaagcccttcagtactgcctcatcccccctccccagggtgatatccacacttcttatcaaggcattgaaggcctttgatcatcttccccctgcttatcttcctcaccaagccttttatcacacccttcctcccagaatgcaacttatgaaatacagaatcagttctggtttccagggccaagactggcccatcacacatttctgctacatgggatgctgttgattcccttgtccactggataaactcctattcttcattcaacttacaacacagatactacctcctccttgaagcctcttcgaattcacccagatagacgcagatgttctctcctctgcaaccccagaacacattgttcatacctccataacacactttacatgttataaaaaatatctgttgctatattttttcccccaggtactagactgtgtgctcctagagagcagacgccatgtcttttttactctgtgtctccagggatgtagcactgagctagtgtagaccaaatgctcagtaaagataaaaggatgagggaggttgatgtattgctcaaggtaacccatgggaactttggaaaagggaccagaataggaatgagaaaactatgcatttaagacaaataaaaccttttttgttcattcattcaacaagtatatattgagcatttactatgtgtaaagtggtatgctagatgctaaagatgcagtggagttcaagacaatttgtttctgcactcatggagagtacaggttattaggggagacaagcatttaacaaatagtttcataaacacgtatggaactgaaattgggtgagaggtattccagaaaaggggtattgtgtggaggtgaaaggggcagggaggtcctcacagggcactctgagtgtcatgggctgtaggaagccttgctttattataaggacttacccaaatctctccataacctgaacttgtaagaatcgtccccaaagccaattctctccattgcaatccttccagtggtccttcattggcacctactagagtttttctttggaggttcaatcattgttcctgaggaccagctctttgaaacacattgttgggtaatcagcctgatgagcattatgatcttttatcataatcacaaatttcatcataatcttcatccccaatatcaccatcaccactcaccaccatcaccatcaccatcataaatactaccaccatcattatcatcatcatcccttaaaattcttgaacagtttacatgttccaggcactgggataaatatttatttaactctacgttcctataagaaaggcgatatcatcaacctctttttaaaaataaggaaatagattaagtaatttaccagagatcacataagtggtagctctgggattctaatcctaaatgtttgctgttaatcagttccccggatgtactcacaagatggctctgaatggaattccttttttttaatccttcataagcatttttctttaatttcttggatctcttaatagcctctcaggggaggcaattgggaggagtcattagagagaagattctattatttactgccaagcagtcattttaggttattactgggactcagaacacactgcacatttgtacctttcagaaggaagttgtataatgaggttctctggaaagatagagtctcctctattccttcaaattatactgtgtaacaacatcatcaccagtgataattatggattaaaaccccacactgagttcagcttccagagccttcatctcatgtgttatatttaatagggttgtgtacaaccttagctttctagaacctacaggaatgcagtattatgggaagctgagtttatgattagccctttaagcacactgagcagatgtacaaaagttgggatatttatcattcagaaacattgtttaggaatcttttaatcaaaatataacttacataaggaaaagtttacaaatgatagagtgtggtgaattatcacatgttgaatatactcatgtaaccagcacccagatcaagaaacagatcatgactagctcttcagcagcatcccttgttctgcctccatgttgcactccctccctttcctgtacatgttactactgtcctgacctctagcaccatgaattactttgcctgtttttgagctttatgtaaatatatataaatgtaatcataccatttgtattctcttgtgcctgtcttctgtcacttgagattacgtttgtgagatttatccatgttgcatgtggcagtatgtgttcattttcctgcctgtgaggcatttggttatatgaatatgccacaatttatatacctattctagggctgaagggcatttgagtatttccacttggatgctactacaaataatgttactactaatattcttataggtatctttggtgcacatatatatgcatttctgttgatttaagatggtattgctgggtgatagggtaagagtatgttcagcttcagtaaacactgccaaagaatttagcagcaaaattgctaattttcacttctatcaacagtgtgtgaaagttctagttaacatcactggatattgttaattcttttaaatttagccaaactgttagatacgcagtactatttcattgtagatttaatttttatttccctattgactactgaggttgagagcctttgcatatgtttattggccattgggcaccttcttttgtgaagtattagtttgtgcatttgtctttcttatttttcttctgttgagttgtctgtctttttcttattgatctgaaatagttctttatgtattttagataaaagtcagtttctggttatatggttgcaaatatcttctttgacactgtgacttgcttcttcactcttaatggtatcttttgatgagcaaaagtttgatatcaccccatttatatatcttctcctttattgttagtgcttttttatgctctatgtaagaaatctttgttactccaaggtcattcgcattttatttcatgctgccttcttaaaattttgttttgcttttcacatttagctgtacaatctatgtggaatttactctgtgtatgatgtgagttaagggccaagatttacctttttctgcatggtcattcagttgtcctagcaccacttactgaaaagattatcttttctccattgctctgatgtattaggttggtgtgaaagtaattgtggtttttgccatggcaaaaccattaatggccaaaactgcaattacttttgcaccaacctaatacatcctttgtcataaaccaagcttctgtatatttgtggaactttcctggaccctaagctgatcaactggcccatttttcttaccttgctatagtccactggcttagtttctgtagctgtgtaagtcttgatatctgggagtataagcccttcaattttgcacttctttcattaagattgtcttggacaatcttggccctttgcatttccatataaattttagaaccagcttgtcaatatcacaaagagcatactgggattttaatttagattgatgaaacctatagatcaatttgaggataattgacatctttagcaatactgagccaaccagtctaggaacactcaagtaaatttaatagcacgtcaactccgcactggtcactgtgctgagcttagatgggttcttacccttgaacgtcttacaaatgtgtaaagaaacacataaacacaaaatataatctaattcgatactcttatcactgataataatgagttcatatttactaaggactttacacatattacttcatttatagcttgcactgatactttgaggtaagtgctgttactatgcctattatgtaggtatttttaatttcagtagggtccaagagaaaaggcatgcaggtctttatggggaaatcagaggaaacatcacacaaacggtggagatttggctgacttttgaagtttgcagaatggaggagcttgaccattccaagttatatgagtagctcatgaaaaaatacaacagggcgacatgacatggattttcaggaaacttctagagagtgaatccaaggattgaaatgtagtatggcaggggaatgggagcatggttagtgaagctggagaggcagagcctgagggcttcttggtctgcggagtttgagctttgtcctaaaggcagtggctgtggagcagggattatctgtcttggctggggttccccggaggctgattgtattcatttcctaggactgctgtacaaattactataaattgttggcttgaaacaacataaatttattctctcatatttctggaggctagacatctgaaatcaaggtatccgacggtgttttcttctggagggctctgagagaaagttggttccatgcctctcgcctggcttctggtggttgtcaacaggccttagctttctgcggcttgtaaatgcatggctctaatatctgcctctgtcatctcgtggcattcttccctgtgtgtctctgtgtcttttcttatagggacataagttgtatgggatttagggcccacctgaatccagcattacctcatcttaacaaactgcatctgcaaagaccctatttccaaatgagttcacattcccaagtatggattagaacttcaacatatcttaaaccgtaacacaagcctcagatgaggattcagatgaaagtgattcttttaaggaaatgctcccaggggaaactagtaagagagtaggggaagcaggacagcaactgggaaggtgtcctgccagcctgtgatcccaggcatggtcccttcaggtagtttcagtcagatcctgcggggccattttggagtgtaaagtgcctctaagaattgtcctcacctgatgcaaggcagctggacctttcatcttaggcagagtaggctccagtaacctgaggaccagggacacaagagccacaggggctggccacgggaagcagaaatatattagtgccagggtcacattaaaatgtaaaaaggtatttgaagaaatctggatgaagtatccttagtgtttgttactttgtcctctgttccctttcctccagaattgtgtataatggccttgaagaccacccaccctcaccctagagagtctaagactgctttttggctgtctgtctgtccttcagagattcccagctctgtcccctgacagcataaccaccattttttttgcttgacactgaacactacacttttcttactcttctttgctttattgtgctttttttcccctcattccttctttttttttttgacagagtcacgctctgttgcccaggctacagtgcagtggtgcaatctcggctcactgcaacctctgcctcctgggttccagcaattctcctgcctcagcctcgtgagtagctgggattacaggcatgtgccaccatgtccggctaattttttgtatttttagtagagatggggtttcaccatgttggccaggctggtcttgaaccctggcctcaagtgatccacccacctcggcctcccagagtgctgggattacaggcatgagctgccgcgcctagccccttctttctttttttctatctgatcttttacagacatcagtagctcctttacttttgtgggataaccggccaatcacagcatgtcatttaccttctttatgtcttagagttctttgctgtgtcattctgttggtggctcaagagcagccactacattatccaagacagtggttttatttgttggagttttagggtacttctttttattattattattatattttaagttttagggtacatgtgcacaacgtgcaggtttgttacatgtgtatacattagggcacttcattttcaagactaaaactagtttaaggaatttggaagactaaatgcccctctttaacaggaggctgcatatcatactcacaaatattatatgtcaaatgaattgattttttaaagtttaaaaacttaataatcagtcaatatttgtggaagatctataacatgatgaatatattcggtttgtgaagccttggatatagtgttaaactggggagtgggccttcaaatctgaccctaagttgcccactggatgattttatgatcttaggtgtgtctgttgacctttctatgttttactttcctatccgtgaaattggagagctgaattagaagatacttgagatcccttgaaggtctaatagtctgtaactccatatctaatgtccaggatcttagcacttttatgcaggcagtaaagtaatttaaatctcaatttacatcaatttaaagaaacttgaattgaacatctattagatgccaggctctgtgctaggttctggggataaaaagagaatgaaaacccagcccctctcctgtattagcacagcccagtggagaaggcaaatcaacaaagaattgcaattcagttcaaaaaaatactgcaataaaagatttccatctcaggagactgggggtccaatgggatggaggaccatgattgccatgttgagaagatccttgagctagattttttttgttgcttttgtttttgttttttgagatggagtctcactctgtcactcaggctggagtgcaatggcacaatcgcggcttactgcaagctccacctcccgggttcacaccattctcctgtctcagcctcccaagtagctgggactacaggtgcctaccaccacgcctggctaattgtttgtatttttagtagagacggggtttcaccgtgttagccaggatggtctcgaactcttgaccttgtgatccgcccacctcggcctcctaaagtgctgggattacaggcgtgagccaccgtgcccggccgagctagattttaacggaaaaatcgtttcctgggtagatgtaggaatgaagagtataacagacttataattccagctgctgtaacaggtggccctccacaacataagtttatttccagctcatgcgaagtacagtatggatgtttctggtcagtaggtgattttccgtggggttgtttaaaatccccagtttccttccctcttgtggttccacggccctgctcctgggacatcagagtcttctgctggaccctgcattaagcaggcaaaggcaagagagtgagagtgcagggtcatgtggaaagcttgtacaggtcaggcttggaagtagagtatagcagtactcccttatccgaggttttgctttctgtggtttcagttacctgcagtaaactgtggtccaaaactatcaattggaaaattccaaaaataaacaattcataagttttaaattgcatgctgttttgagtattgttatgattgtgtcttattagttattgttgatttcctactgtgcctaatttataaattaaactttatcatatgtatgtatgtatgtatgtatgtatgtatgtaaaggaaaaccatagtaagcatagggtttggtactatccatgatttcaggcatccatttggggtcttggcatgtgtcttggccttatctgcagggggctactgtatatcatgtctgtccatgacttccactggcagaacttggttataaagctgacttaactgcaaaggaggctgggaaatgcagtgtagctgtttccacaagaaaaatgaaatatgttttgaagaacacacagcagcctctgccacaaaggtcatcctacaggattttgtgctgtgaaggactagttttctcttgggccagtctaatggaagtgtaatgttagacaattgtgaagattgagtttctgaccagggactatctttatcaaattgtggttattgggagagagctcaccacacccctggttgggtcaagaatccccaagtaagatagcagctcagatatttaacaggttctgaaatgtaagagggagctgggtgaagagggtaagagttctcacctcaatggatgaaggcctcaacactgtccacggcctctgtaactcacaggtctgggatatcgatggagaactcaggtctatcccatttgacaaatggacaataattgattcttatacttaaaacctgcttttttctctctctgcagtaacactttcagctgctcctccctcctacttcagaggattcacattaattgccctcagagagaacagagagggtgataaggaagaagaccatgctgggaccttccaggtaagaccctgcctgggcttattcagtggccctccctgccctaggaggtagaggctggagaggtacaagtgtctcaggtggcttcccatgcagtcccttgaccgttggccaacgggggcaggtccatttgaaagggtcatcatggagcaagcagcaaatgccgcacacctatctgagcaaggttggccatggggcaggccttgttttgtctcagcagatcacggggctcttctctgggcccacagtgtccttcagcagccaagcgtggggagagcacttggagccctggctaggcctggctgttttgcctgcacaggcatttcgtgattgactggttaattctcaaatgtaaacggaacaagagctcgggaccgccaggctggagggagttcaaagcacaggagaaggactattaagggaatgtagagattgatttatgagggaagattaaaagaattaaacatgcttttcttggccaaatgaacagggccgagtttaagaggtggtaatggtctttaaatgtcagtcctcacagaacaacctcctcaaggggaagcttcatttgactttgcatgaaagggcacactaagacaaaagtgggtcaagaaaagaaagggaatcgcacagacaaggaccccgacagtgagtcatatttcactgtggaatattcttccaagggaagtggtaggaacgtcatcccctttcagaggtttagaaaagagccggcaagttgtcagaacacatcccagaaggactggagtgatcctaggaggaggcctggccaaatttgctgtaattacttctcatctcagatttccattgttctggaattcatttttatctggcatttgcaaattaagaagaaaaaaactcagagaatacttatacccatagctggctgctggagactctggtgcaatctgtgggctccgtggaggaccctgacccaaatacctcccttatccaaaggcatcttttaatccttgtggccaggttgtaatttttaatcctgtgatttaaattatttttctgctctctgggattctaggttttgggcctggtgagacttaattccacgctcaccgtaatgtccttctatggcaaagaacctcttggcatgtatctgaaagggtgacccaataataatactagcaacagccaatatttgttgggtacataccatatgccagacactatgctaagtgctttactttatcttagtttatcctgtctttgtttagtttatctttgtttaattctcaaaacaaccctagtatgtaggaactattatccccatttttggaccaggaaattgaaactagagagattaaatcacttgcctaagcttgcttattgcttgttttagtccattttgtgtttctctaacaaaacacctgacactagataatgtataaacaatagaagtttatttcacttacttgacatgagactgggaagtctcatatcaaggtacctgcatcttatgagggccttcttgctgcattatcccatggggaaaggcagaagggtaagagaaggtgagagcaagaggggtccaaactcacctttataacaaatccactctcaagataactaatccactcccacgacaaccacaatccattcacaaaggtagagccatcacgacttcatcacctcttattaggccctacctctcaacactgttgcattggggattaagtttccaacacataaactttgggggacacattcaaaccatagcagcactgttctggctaaattcagtaagttgatagtcttctctgactcacagttgtttctgcttagcttaatccttgttcttgcaactgattggtgaatacagggccctgctcatagtgggcagcgcataaatatttgctgaatgagtggataaacatttgactctttctgctagtgtccagacctcagtcctatttggaactgttgttgaactcctatctctgtatgcatcctcccttcttcctcctcttagagcttcagacatcctctcttgttacacagcagtggttctcagaatgcagtctcaggaccagcagcatcagcaacacctgggaacttgttagaaatgcaaaatctcaagcccatccagacttactgaatcagaaactctgagggcagggccctcacaacctgtgttttaacaagccttcagggtgaatctgatgcatgctcagatttgggacccattattctaatgagacatagaccagccctctaacaggatgtcgtccatcatcacgtcaacacatctgtctgttcctatctattctctcattgtttccaccagccctagagggatcaaagtgggataagaatatgaaaatgcctagcatatgataacgacaatagctaacacttaaacagtgcttgtgtgccagatactgttctgagtggtttatatttgttaactgagtttatcttcagagtgacatgatgaggtaagcattattatcctattttccacagaagagaaacttgtggcaaagaacaactaagtaactttcctaagatgcccagctctaagtgataaagctggggttcaaacccgggcagtctgtctctgggtacctgcctgtgaccactgtgtatgccatctctcagtgtatacctgttaaatgaaaaaataagggcccactatgacttttatgacagtctctgtgccaggtgctttatatgcattagccttttcttttttccccttaattcttgtagcaaccttgtgtggtcagtattgttatcttcatttttcagatgatgaaactgagtccccaaggagttcactaagttgactaagacagtccagcatctcaagggtccaaacactgtgccagtttcttatttctcaaaagttatctcctcacccctgccctgccctacccttgtgccatcaaaatgcacactccgcttgggttccaattgtctcagagatttgggggaaggaatcatagcccatgcccctcatcttacttcacctgctcctgtgatatgtggcccccatgctgtcccttccaaatctatcatgaaagtattttttctctgtaccaaagctgttatctttggagtccttgatttattcagcagcatttgttgagtgcctgctgggtgctaggcactgagttaggcattggggatagggtggtgagaaaaacagagatagtcctcatgaagcctaaggagtcctccttgtcatcatcccataaactgacctctgttgctgaaagtcaacaagtcacccattgaaacataagccaacaatcagaaagaacaaatgccattgtaattaaatatatatatatagtgatttaacaaatagataaagacttctgtttaacaccttcacttcaaatatgatgactttgagggcttaacaacaaccacaaaattctaatactcattcattgatacataatatttaacatatttgttggatacgtatgatattgttatatatatagaatgtgtaatgatcaagtcaaatatttcaggtatcccgtcactttgaatatttatcatttctatgtgttaggaacaattcaaatactctcttcttgctactttgaaatacacaatacattgttgttaactatagtcactctgaatattcttttttttttttttaagttctggggtacgtgtgcagttttgctacataggtatacatgtgccatggtggtttgctgcactcataaacccgtcacctacattagatatttctcctaatgttatctctcccctagcccccgaccccccgacagaccctggtatgtgatgttcccctccctatgtccacgtgttctcattgttcaactcccacttatgagtgtgaacatgcggtgtttggttttctgttcttgtgatagtttgctgagaatgatggtttccagcttcatccatgtccctgcaaaggacatgaactcatccttttttatggctgcatagtattccatggtgtatatgtgccacattttctttatccagtctattattgatggacatttgggttggttccaactttttgctattgtgaatagtgccacagtaaatatatgtgtgtatgtgtccttatagtataatgatttataatcctttggatgtatacccagtaatgggatcgctgggtcaaatggtatttctagatctagatctttgaggaatcactacactgtcttccacaatggttgaactaatttacactcccaccaacagtgtaaaagcgttcctatttctctacatcctctccagcatctgttgtttcctgactttttaatgatcaccattctaactggcgtgagatggtatctcattgtggttttgatttgcctttctctaatgaccagtgatgataagcatttttttcatatgtctgttggctgcataaatgtcttcttttgagaagtgtctgttaatatcctttgcccactttttgtttgtttttttcctgtaaacttaagttctttgtagattctggatataagccctttgtcagatggatagagtgcaaaaattttctcccattctgtaggttgcctgttcactctgatggtagtttcttttgctgtgcagaagctctttagtttaattagatcccatttgtcaattttggcttttgttacctttgctttggtgttttagacatgaagtctttgcccatgcttatgtcctgaatggtattgctcaggttttcttctaggattttcatggtcctaggtcttacatttaagtttctgatccaccttgagctgatttttgtataaggtgtaaggaagaggtccagtttcagttttctgcatatggctagccatttttcccaacaacatttattaaataagcaatggggaaaagattccctatttgtgtcaggtttgtcaaagatcagatggttgtagttgtgtggtattatttctgaaggctctgttctgttccattggtctatatatctgttttggtaccagtatcatgctgttttggttactgtagccttgtagtatagtttgaagtcaggtagcatgatgcctccagctttgtttttcttgcctaggattgtcttggctattgcgggctcttttttggctccatatgaagtttaaagtagttttttccaattctgtgagcaaagtcagtggtagcttgatggggatagcattgaatctataaattactttgggcagtatggccattttcatgatattgattcttcctatccatgagcatggaatgtttttccatttgtttgtgtcctctcttttgtccttgagcagtggtttgtagttctccttgaagaggtccttcacatcccttttaagttgtattcctaggtattttattctcttactagtaattgtgaatgggagttcactcatgatttggctctctgtttgtctgttattggcgtataggaatgcttgtgatttttgcacattgattttgtatcctgagactttgctgaagttgcttatcagcttaaggagattttgggctgagtggttttctaagtatacaatcatgtcatctacaaatagagacaatttgacttcctctcttcctatttgaataccctttatttctttctcttgtctgattgccctggctagaacttccaacactatgttgaataggagtggagagagaaagcatccttgtcctgtgccggttttcaaagggaatgcttccagtttttgcccattcagtatgatattggctgtgggtttgtcataaatagctcttattattttgagatatgttccattaatacctagtttattgagagtttttagcatgaaggggtgttgaattttattgaaggccttttctgtatctattgagataatcttgtgttttttgtcattggttctgtttatgtgatggattacgtttattgatttgcatatgttgaaccagccttgcatcccagggatgaagctgacttgatcgtggtggataagctttttgatgtgctgctggatttggtttaccagtattttattgaggattttcatatcgatgttcatcagagatattggcctgaaattttctttttttgttctgtctctgtgaggttttggtatcaggatgatgctggcctcataaaatgaattagggaggattccttctttttctattgttgggaataatttcagaaggaatggtaccagctcctctttgtacctctggtagaattcagctgtgaatccgtctggtcctgaacattttttggttgataggctattaattactgcttcaacttcagaacttgttattggtttattcagggattcagcttcttcatggtttcgacttgggagggtttatgtgtccaggaatttatccatttcttctagattttctagcttatttgcatagaggtgtttatagtgttctctgatggtagtttgtatttctgtgggatcagtagtgatatcccctatatcattttttattgcatctattgattctactctcttttctttattagtctggctagcagtctatctattttgttgatcttttcaaaaaaacagctcctggattcattgatttttttgaagggtttttcatgtctctatctccttcagttctgctttgatcttagttatttcttgtcttctgctagcttttgaatttgtttgctgttgcttctctagttcttttcattttgatgttagggtgtcaattttagatctttcctgctttctcttgtgggcatttagtgctataaatttccctctatacactgctttaaatgtgtcccagtgattctggtatgttgtgtcttcgttctcattggtttcaaagaacatctttatttctgccttcatttcgttatttacccagtagtcattcaggagcacgttgttcagtttccatgtagttgtgcagttttgagtgagtttcctaattgtgagttctagtttgattgcactgtggtctgagagacagtttgctatgatttctattattttgcatttgctgaggagtgttttacttccaattatatggtcaattttagagtaagtgtgatgaggtgctgagaagaatgtatattctgttgatttggggtggagacttctgtagatgtctgttaggtctgcttggttcagagctgagttcaagtcctgaatatccttgttaattttctatctcattgatctgtctaatattggcagtggggtgttaaagtctcccgctattactgtgtgggagtctaagtctctttgtggtctctaagaacttgctttatgaatctgagtgctcctgtattgggtgcacatatatttaggatagttagctcttcttgctgcattgatccctttaccattctgtaatgcccttctttgtctcttttgatctttgttggtttaaagtctgttttatcagagattaggattgcaactcctgcttttttttttttttttttttttttttttttttttgctttccatttgtttggtaaatattcctccatccctttattttgagcctatgtgtgtctttgcatgttagatgggtctcctgaatacagcacactgatgggtcttgaccatttatccaatttgtcagtctgtgtcttttaattggggcatttagcccatttacatttaagtttaatattattatgtgtcaatttgatcctgtcattatgatgctagctggttgtttttcccgttagttgatgcagtttcttcatagtgtcgatattctttaccatttggcatatttttgcggtggctgataccagttgttcctttccatgtttagtgcttctttcaggagctcttgtaaggcatgcctgttggtgacaaaatctctcagcatttgcttgtctgtaaaggattttatttctccttcacttatgaagcttagtttggctggatatgaaattctgggttgaaaattcttttctttaagaatgttaaatattggcccccactctcttctggcttatagggtttctgcagagagatctgctattagtctgatgggcttccctttgtgggtaacatgacctttctctctggctgcccttaacattttttccttcattttaaccttggtgaatctgacaattaatgtgtcttggggttgctcttctcgaggagtatctttgtggtgttctctgtatttcctgaatttgaatgttggcctgtcttgctaggttggagaagttctcctggataatatcctgaaaagtgttttccaacttggttccattctccccgtcactttcaggtacacccatcaaacatagatttggtcttttcacatagtcccatatttcttggaggctttgtttgttcctttttattctttttttctctaatcttgcctgctctctttatttcattaagttgatctttaatcacggatatcctttcttccacttgatcaatttggctattgaaacttgtgaatgcttcaggaagttctcgtactgtatttttcagctccatcaggtcatttatgttcttctctacactggttattctagtcagcaattcatctaaccttttttcaaggttcttagcttccttgcattgggttagaacatgctcctttagctcagaggagtttgttattacccgccttctgaagcctacttctgtcaattcatcaaacttattctctgtccagttttgttcccttgctggtgaggagttgcgatcctttgtaggataagcggcattctgatttttggaattttcaaactttttttgctggcttatccacatctttatggatttatctacctttggtctttgatgttggtgaccttctgatggggtctttgagtggacgtgctattcctttctgtttgttagttttccttctgacagccaggcccctgtgctgccagtctgctggagtttgctggaggtccactcctgaccctgtttgcctgggtatcaccagtggagactgcagaacacaaagattgttgcctgatctttcctctggaagcttcatcctagaggggcacctgccagatgccagccagagctctcctgtatgagatgtctgttggttcctactgggaggtgtctcccagtcagaatacacgggggtcagggacccacttgaggaggcagtctgacccttagcagaacttgaatgctgtgctgggaggtccactgctctcttcagagccatcaggcagggccttttaagtctgctgaagctgcaaccatagctacccctttccccaggtgctctgtcccaggaagatggggtttttatctataagtccctgactggggctgctgcctttttttcagagatgtcctgcccagagaagagaaatctggcagtctggccacagcagccttgctcagctgcagtgggccccacccagtttgaacttcccagtggctttgtttacactgtgaccataaaactgtctactcaagcctcaggaatggcggacgccccttcctccaccaagctcgagcgtcccaggtccatctcagactgctgctgtgctggcagcgagaatttcaagccagtggatcttagtttgctgggctccgtgggggtgggacctgccgagccagaccacttggctccctggcttcagcacccctttccggggggtgaacggttctgtctcgctgctgttccaggcaccaccggggtatggaagaaaagaactcctgcagctagttcagtatctgcccaaatggccacccggttttgtgcttgaaacccagggccctggttgggtaggcaccagaggaagtctcctggtttgtgggttgtgaaaaccgtgggacaagtgcagtatctgtgccggagttcctcaggctcagtccctcatggctccccttgtgtaggggagaaaattccctgaccccttgctcttcctgggtgaggtgacgctccatcctgctttggcttgctctctgtgggctgcacccactgtccaaccagtcccaatgagatgaaccaggtacctcagttggaaatgcagaaatcacctgctttctgtatcaatctcactgggagctgtagaccagagctgttcctattcagccatcttgccagcctcccctaaatattctttaaatttggttaaagattgcatttgtggctctaaaagtgactttgagagagggttactttgcttctttatgagtgaatccttatacagagaacacagactcacaaaatacaaacacaacaaaagcaaattttaatgctgtctttgcacctccctagacttagtggcgagggaatgggcttcctagtaccagggaaagtaagaattacagctctcacctctccaaagaaggccgaggagaagggggtggggctacctgctctggccccaacagcgggttccagcacaacagcattggcacacactagatgtcagaaaacacagagcctctctttgatgagatagctgattcggtgaaagtggcaaggaactcagggactcaattgcctgtacaaaagtaacccaccaatccttaaaaattatattaccaaaaactgctccctggaatgctgtggcccagccagctgcccagctcactctcttgtctccttcaggtctctgatcagcggtccctttccagggagccctgccctgatcgtcttatcaggcacttcattcctcctcccaccctgagcgaggctctttctctctctccccaacttagtgtttttccattgcagttattgccacctgccatgctattttacttattaacttgtgtgctatctgtcaccttccactgaactataagatctacagggcaggattttaatctatctcccttcagagtatccctggcagcaactatgaacaggacagagcaggcacatgaatatttagggacagaattttaagcacagcatttgcactaaaatttaagctgctaatttataatactattcattgccttgttttatttttaatttaagtccttcaggcatcaactagtttaggtaacactctgccaatcaaaggaaaaaagtctcaaaacaaaaggatatttgtctgagaagagcagatcaataccatgcaagcaagtatcttttaatagtcttttatattcataatcacctgtttttaaactatttttgtgatctctacattaacaataaatatttagtggcatttaatgggttctgagccacgttagaacctaaaagggcttttgacacacttttctaaaaataaaatgctattgcaagcttgttctcaggaattctctttgagttcataggaaaacctgctctcattacactaacctaagcttaatcagtccccttataagatgttaggatttttaaaactgccattcactattataaataatggagtagaaacagtttcttgcataaaactttttctcatttggtattgttcactaggacaggttcctagaagtataatcacaaatgcaaaggatatggacattttttatggttctaatatgtattgccaagatgatcccccatccccacacacacacacacaaaacctgcactcaacaaaatggaatatgggcattccatcatggaagtcatggccactgatgtgaagggaaacagacatatgagatcaggactgggaatcacaagatttgagcaggttaaatcgatagatcaaatttagcaagatgaaagctaatggaggaagagagaaacacagaaaaccacctacttggatccaaataaccaattgcacgagtacaagatgagagatttggatttatggcagcacatgaaacaaacaacaataacaagaaaaatactctagaactttcagttgccattaagtaagttaagaatgaatcatccatgagataggaccacagaaaactcatgaggtcttaggatgtatcataggagcatagtggccagaacacaggattttgattttcttatgagattcttatgccattctgagagagcccacaatattccctttctttctctatatagtataactttcagtgaatgaatattgaaatataaaatatacagtgttttctttctttcattcatttgttcattcaagtatttccatatcattcatagtacccagttctttttcttcagagtagttattgaaatttataattatttgtaggattatttgtttaatattactctgttctaccaaactgtagggcaaaatcatgtctatttaattcactgttgtatttctaaccactagcactgtgagtgttacatagtggacactcagtaaatatagtaagtatttgctgacatgaattaatgaatgcactaatgaccagctatgcaaaatgcaacatactaggctctgtgatatggagatgaataaataagacatggtatgttagtctgttttcacactgctataaagatactacctgagactgggtagtttataaacaaagaggtttaattgactcacagttctgcatagctggggaggcctcaggaaacttacaatcatggtagaaggcaaagggggagcagtcaccttcttcataaggtggctggagagagagagcaagacaacaaagtgccacactttaaaaccatcagctctcgtgagacctgactcacttatcacgagaacagcatggagaaaaccgcccccatgatccaatcacctcccaccaggtccctcccctacacatggggattaaaatttgagatgagatttgggtagggacacagagccaaaccatatcatggcccctggtattaggaggtcaaagtctacagaagaacttcccagttcagtattttatgtacactggtggatcacagataggttgaaggagaacccagatgtgtatttccctagatattagggtggcctcctctgtttaccctagggaaatattaccattttctatatgtgacatggagtcaagagacctgttagaaagaaccatattgcagcctgctagatgctaaaattgctgcatctgtgcaaataagaaaacaatcatttgcagaaagtgggtagtgagtgctgatttgggagcacagaaaggacatttacagagacaataacctttgagctatctcttagagtcgttgaaatttcaactggacaaggagtgaagagtgtgtgtgaagaccactctatttttgcctcacacctctattttaaaatttgccatattttaatgttttactatatcttctttaacaagcacctagagcctcacaagggcctagtaaaagttttttttttttaataagaaatgaaccaggggataaatgacattctgtcccttccccttcccttgaggagctcacttggtgtaaaatgcctctgcagagctataatgcacaaacaacacattttaaaagcgatgtcaacacctcttgcttaacacttagttttcttgcttaaaattgccgtgtgaaaagtcatttgtaagaagcacaagaagcaatgtgcactgtgagtgcctggaatggacattgggtcctcacacttctgcagccctggtctctagtgcctgctgccagaaaagatgaaaaatcattttccttcccagcaagaaagcctgagtctgggaaccagaggtattattaagacttaagcatcactcctctcaacagagcacacttgtgttttgtgttataaaatacagaaaaggataaatacagagaaagataaaaaagaaataaaaatatgtcattttataatctagagataatcattaacatttgggtatatttccttccaggttatatattatatagaaaacacacctatgtgtgtatatatatatatacacacacacctatatatataatttttgaacagaatattggaaccattctctatatagggttttatatcctgttttatttttatgggaacattatattgtgaacatatttcaatgaaattaaatgttccacatgatttttaatggctttgtaatactccatcatactgttgaattataatttattcgaagattcctctattattggcaagataggtggttctaattttcttttctttacttttatataaaacactgcagtgaacaccgtaacacataaatctttgcacctgtatttgcttatgataaaagcaaagttttatgcatctgtatttgcttatgataaatgaaattatagggtcaaagtaaagtttctctctctgtacatactcacatgtatgtatgcacacatgtatatgtatatatgagctctatttctggaggcagccgtttgggttttgacagtgtcagtggtgggcacacaggttagcatcacagtagaaagtattcctattttcaggctgctctaactactcagaaaggaccatgcatctagcttagctttgctatttaaaatatacagcgagtatgtggaaagactttgggttttggaatcattagatcattggactaggagtcaaattctgccctactagctaagtcaagaagtctctgaatttatctgaaacttacttagtcccttcatctacaaaataaaaatgatcaaaataaaataatgtatgtaaaatgcccaacacagtgcctggacataagggaccctcaatcaatgcctcctacttctgagccagcagcctagggtgcattttccacatttctgtttacagtgaatcataaactccattcctctgtagatttgggcatttgtggaccactaaggagcacatctgaatcttgtcaaaggtgtaactactagctatctttccaactccacaggtgaggagagagacagtcttctctagttcattctatctttattgtaataggattgggatcgctgtaaaataaaatgaaaaatttatgctatggatacatgatgcgcaaacaaaatctgttcaatgtgggtggttggctgggctctcaattgctggttttatgaactacttccatatagcagcttcaccaaaaatggaatttaaattataccttggcaaaaggctccgcaccagaggtatgaatggatagcggaaaccacactagatactattctagttgcttcgtatactttaactttcttcctcttggctggaagttccatgagagcagagacatctttctttcacaacaacacacacagtgctgggtgccatgctgaacacataatcaaagctgagtaaatattagtcacataaataaatgtattaacccctcttcaactcagattccactgcctgcccacatacacacccatgaagtaggcactcttattattattcccattcacaggaaagttaacactgagggaatcagagcattgatcgatggcacagagccagtaagtggcagtgaacaaagactaagccaccaaaggcctgtgtcattttctctattctgcatctcttacagctctggggagagatgtatgggagagacaagacagaaatttactgctaaacccctaaaatcctttctgggttattccaggggtcataccaggtttacagcttcacagatccaccaggtctcttccaggcctttgaaatgccatctcttctgtctttcctgacattcacattttcctttcatcccatttggaatctgtgcaccctgcctcctctctgagatctcaaacacttggcacatccctttgttctagttcttcgctcactgtgttaccctgatgagttaaattcccattcccctacaagattctgcaaagaggcagacaactgggccatgtctgtctctgtattcctgtggccacccctgtactcccctggcctcaccaaggcctggcacactggccaggtgataagtgctttccaaattgatggatatctgctgctggaattgctggccttacccacttgtttgcaaacgttaattggtctcctactttcttgcatggaactagcattgtttccacatctattttctaaaggtctagaaatcattttcaaatacatgatagacttctttaatagacaatacataacttttatgcaaaaaagaactttttcatgtatctattaagtagttttttaaaaagccaataagttcctgtggccttgcaatcctctcatctttaaaatgagagtgatgagcctccattccagatctaactactttatgggatagctcttaattctggttttgcaaacacttaaagccgttgtgtttgttttttaaaacaggtaaaatctaaagagtaaatgggtcatagtttactgaaacagtatcctattgtaggatatttagagaatttttaatactataaataatttagcagtatacattcgtataaagaaaaccctcttatttcatttatgagtatataaatgacactgtcgtgtgtaaggcatgttctaggctctgaggatatagctgacataacagacaaaaatccctacccctttggacattatacttctatattttagatcatttccatgagatacagtcccatgtttctggatcaaagagtttttaggctcttgatacacattgctgtatcattttctttcttttttttttttttgagatggcatcttgctggatgcagtggcatgatctcagctcactgcaacttccacctcccgtgttcaagcaattctcctgcctcagcctcctgagtagctgggactacaggcacccgccatcacacctggctaacttttgtatatttagtagagatgggggtttcgccatgttggccaagctggttttgaactcctgacctcaggtgatctgcccacctcagcctcccaaagtgctgggattacaggtgtgagccaccgcgcctggcctgctatatcactttctatcacacctgaccaagtaggagtttgagtaggaatctgactcagagcttgcttttagagagtatataacctttgccaagttactttgtcttggtttttcccttggacacaaactttctctccagttggcccccagctggtaccttatgtcctatagtcctttgtgttcaggaggactgggtgttggctggaggaagtaagtttggctggaggaagtaagttcccatccttctaccaggtggttactaaacagatcttgcaaatcctgttctcataaaattacctctttggaataaagttcaataccttagatttttgccctgacaaattaattattcaacatggttcatctctctagcattccaaggtttttctatgttagacatcttttatccgccatggttgatcactgtcttcacagcattatgtcatctgcagagtgaacaggtctgtctccctaggcatggatatatgcctcaaaaactctatttcctcatccctctacctgggatgctctcaggtagccacaaaactccctccctcacttctttccggtttctgctcaaatgtcacttttatcagagtccatttctgaccatattttataaagcaataccctcatcattctaaaccccatttgccttcctttattttattcatctgacttatcagccccagacatgttatatgcttgattgcttattagctattacccctactgcaatgtgaactccacaagggtattgctttgttcagcactgcatctgttcagcactataatagggcctggcacataataggtgtttaatatatagctgccaatttattgggtgtgcttttttgaaatcagcctaagaaacaagttgttttttcatcatgaaatgacactgacttatggtattgataaggattctggcccccaccctcagcccattttccccccaaagtcagctgacaccctcaggacttcttcacatggaccaatatgaagatacatgtgcatcacatgcacagccacacaccccctggcccctccaaaacagcttgtacttatgtggctgcctttctgggccctagcattgggttttacctgaatcccaattttaccattttagtgacaacatagccactccacccctcattaactatataagcttggccacttaatttaaacttgctgagtttgtttccttgcctgtcaaaattggagtaatactaagtcgaagagttgtataagaacttctaatgtctactgtgacatgtgaagagcttagaaatcatcactcctgtcctcatatgaaaaaaagctgaaaaactgaaaatcaacaactctaattacttccatcagagaactgaggtcatgaggcaaaccttcgccacctccttcctcctccaccccccaagaaatggagagacaagtgaatactgaaaatcacagattctcaggagctgctggaaacagtaaatggtaggaggacttaaaggctaactgatgactagctacaggctgagtgtagactgcttggagagttaaactcctgggagcccaatcctgaagggactcccacacttttgtgaattttaaccccaggagccctcatcaggttctcacggtgaaaatcagagaaatctcctccagcttgaggcatgggaagggaaaaagaacctttttgaaatctggccagatgcttctccctaacaaggtctgccctcaaggaaactactttaccagagtcttatctgatccgaagaaagaacaattagccaggtccagccctgtctagccttcctgtctcatataaaggaagtaaaaaaaggctaagaaacttttctgaagaccacacacaaagattctgccccaataaaatattgagatttaatcaaaagatagaccgttaccctttcccaatatgttaccattacatcaacaaggctcagtataacaacagtggattacaacagagagggctgcaaggcataacctctacttaagaaggagtttctagggaaaaccaaagacaaaaatgagaagaaagaatgacaaacaaacataataaccaagaactgcaggaaaattacaaaagatgtaacatacgtataatgggaatatcagacaaatagagaaaagaatagaagaaatatttgaagattagatgaaataataaaagggctattatggtaagtagttggttcatactaagtgatcaataaatggtagtcataattactattattaattgatcaacatatcagaggagggaagaagagttgaatcaaaggcaactgtttaaacaggacttagtcatgatcaggcacaggagggaggacatctttcttgacatggggaaaacaagcaaaactggtaaaaatatacaacaatttgatgaacaagaaggaaagtgagagtagataggattacacaggatgccctccatataattctgactttaatagtaatatcttccttatagaattactgagaaaattaaataatttataacaatggttttcaactggtaatgaacatcagaatctcctggatacttgtttgtaattcatctctctgggccccaagtcagagaatctgattctgtgcacctaagggggtgaggaactggggctgcggaccctgcatcttttataagcatcttatgtgaatctgacacaagtgccccaaagagcaccttaagaaacacataagcatgttgattagtgactgacctgaaacacagtcaacaaatgtttttcaagtagacagaggcaagctgatctgcagagggaaaggacagggctgaagactggggagatggagcaagtgcaggaggaatgtggtagggagtccatgagagatggatggaaggatcgtgtagcagcagagacccagtttagaaaacacatattcctagaggagactttgagattggatttgtaactttcttcatcaactcccaagagcctggtggcaggagccaagcagacagatggtacagttttcccagaactggaaaaccccaaacacagtagaagatagggggcacaggcatccaccaaggggagagagaatcagggaaccagggcactgttgagaaagctggtcaggggttcaagttggccaggaagatagtacctctactatctacctataatttttttaaaaaaccccaaagtcctaggaccccacatctcctccaaccactacctcatttctctgccccacctcgacagccaagcacttcaagagagttgtgcctacacatgttttacccacttctctgctgttgttcacttctcgacccccaccaaaatggctcttgagtcttgacagtttctgcaatggcctccgcgttgtccgtgcacactccatcatcttgcacacattcctcagtatcgcagagggagctgaccactccctgattcctagaatattctcttctcatgtctttctggttttatgtattttgccccaaaaagtggcagcaggggagttcccacacaagaaagtgcaacacactatcctgaagtggggctggttgggattccaaagaaaggagcactaagcaccagtgagatcagtccaaaacatttattaggggaacttacttacagaagtgctgcagtgatccctgcaccgaacagcgagagaaaagggatgttctgcccaggcacaaatgcagtgaggggtccagggtatggagtttttatgagggtttaaggagtttggctcagggatggggccagtttctttcagtgttttaggcaacaatctagatacctttgtcagtgtctgggaatgttcaaggccccagtttgggattaagcctgctgggaataacccacatttggctgggtcacagagtggtcaaggcactctgtgattttctatcaagacacagaaagaaagcgggagagctgaagggacctacataagcactattggcatttgggccatatttgaggtttacaacataatgttatgtatagatagtatacataatgatatatatatagatagtaaaatggttactgcagtgaagtaggttaacatccatcattgcacatagttactttttttgtgacaagggcaactaaaatctacttaaccaaaatccgtaatacaatttttcatcctcatgctatacattagatctctagacttgttcatcctatataactgttattttgtatcctttgacttacatcttcctattttttccttctctaccccctttgataatcactcccttatctatctctgcatatttgagctctttttttaaaaaaatgtttcacatataagagagatcatgcaatatttttctttctctttctggcttacttcacttagcataatgtcttccaggtccatctttgttgtggagaatggcaagatctctttctgttctaggctgaataatattccattacacacacagacacacacacacacatacacacacacacacgtgtacatgttctttccccatttgtacatttcctacattttcttttcccaaatgaacatggacatttaggtcgtttccatatcctggctattgttaataatgttgcaatgaacatgggtccacaggtgtctttatgaggtagtgagtttatctcctctaggtaaatacccagaagtcggattgctgtatcatatgatagtttatttttagttgaggaacctccataccattttccaccatggctataccaatctacgtttccatcaacagcatacagggttaccttttctccagacccttaccaacatttgctatctcttgtctttttgataatagctatccttatggatgtgagataatatcttatagtggttttaatttgcatttccctgatgattaatgatgttgaacaccttttcatatacctgttggccatttttatattgtctttggaaaaaatgtctgttcaggttatttgcccattttttagttgggtttttttgtttttctgctattgagttttaacagttatttacaaattttagatattaactccttatcagatatgtgaaatgcagttttttgtttgtttgttttttcagttcgtagttttccttttctttctttcttttttctgtgtgagacagggtctcactctgtcacccaggctggagtgcagtggcataataatagctcactgcagccccaaactcctgggctcaagtgatcctcctgcctgggtctcctgagtagttgggactacaggtgcatgccactatgtctggatgatttaaaaaaaatttttttagagatggagtctcactgtgttgcccaggctatgccttttcattttgttgtttgtttcctttgctgtgaagaaggtttttagtttcatgtagttccatttatttattttatttttgtagcatgaactgttggtgtgatatccaaaaaaattattacaaaggccaatgttgaggaggttttctgctattttctcttctaggagatttatgatttctgagccagataattctttgttgttggcagctgccctgtgtcctctgggatggttggcagcacccctggcccctggccccaccagttgtgataaccaaaaatgtttccagatattgtctgattctgatgtcccctagagaacaagatcatccccattgagatctgcttctctaaatgatgcactctccaaactctgtcctgtaaccttttctgtcctttctctgcacaattagactcatccgttccatggctttgagtaccatctgcgtgataatgactcccattcatgctccacgttgagatttgtggcccactttgatgttctagaccctgggctaaattaaggtaaattaagcctggggcttttcaaattagacagagggaatgtaagcccctgttctactcttgctgtgtaactttaactcttttaacctttgtttctctgtctgaaaaacaaataataaagatgtcaaagctgtaaagatgatcattagagtccttggcacatagtaagttgctaagtattattataacattcataattctgatctcaatgccttcaggctatgcacaaagggcttctggacttagggtcattcaatagaatgttatagactgttgaaagttcaactctagagcctgagagacctgggttcaaatcctgaatctacaattctgctctatgacctctctaaggctcggtttcttcctgcttggaaaaggggaataataatattacccactttggagggtgaatcaaatgagatcatcctaggaaaatcaattaacatgatgtctaacataccagtacttaataaacattagtaattattattagggtaacattagagaagctgatctttaactgaatctcaagggctatagaaagagcagtctcggcagagcatgaataatgggacagggtaaggaaaagtgagctataatctgggaatgacaaggagttctggattgctagtgcaaggttagggcttgagatgaaactaatgaattgtcatctaaatgcccttccacgccagtttgggactatgggctttatccttttagtacctgctagcagaaattgttttttggttttttttggcaaggggagagggacaccaaagagttttagattaggcaacaacatgatgattaaattttcaacttaggaagagagctctcatcaatatggaagagcttggagaagataagaacagaggcaggaaggctgggtaggagattgtggcatgaactccagtgagagatcaggaaggctgctcatcaggagatgaatgccacagacatcaaagagctaacaactgatgagttgaatgcagggggctgagtaggactctgaggctttttgcttggtcgcacgtggtggaccggtggtccattgaaccctctgctgtctcctcatcccaccactgccctctcctctctcctcttccctccttagctaagctcatcatctcagtaacacttctgccatagcccataacttctttgcctcttgtcctcacaccaatctagcaaaactccagccctgaatgaacacatcttttctcttctttgtgcttacacctgagccctgcacctggaaaaagtcacatttcagtgcagattggccagttcacatcatgctaatttcctagagctgctgtaacaaattgccacacatttggtggcttaaaacaacagaaatttaattatcttacaattctggggtccagaaattcaaaattcatctcactgggccaaaattaaggtgtcaacaggaccacactccctctgggggctctagggcagtggtcccaaacctttttggcaccagggactagtttcctggagaacagtttttccatgggctgcagtagggggaatggtttcaggataaaactgttctacctcagatcatcaggcattagattctcataaggagtacacaacctagatcccttgcatgtgcagttcaccatagggtttgcacttttatgagaattgaatgccgccacttacttgacaggaggtgtattagggttttctagagggacagaactgataggagatatatatgtgaatttattaagaattaactcacacaatcacagggtcccacaatcagctgtctgcaagctgaggagcaaggagagccagtccaagtcccaaaactgaagaacttggagtctgatgttcaaggataggaagaatccagcatgggagaaagatgtagtctgggaggctaggccagtctctccttttcacattttctgcctgctttatattcattgacagctaattagatggtgcccacacagctgattagatggtgcccacccagattaagggtgggtctgccttccccagtccactgactcaaatgttaatctcctttcgcaacaccctcacagacacacccagggtcaatactttgcatccttcaatccaatcaagttgacactcagtattaaccatcacaggaggtgaagctcaggcggtaatgctggctcaccccgatctcctgctgtgtggcccagctcctaacaggccacagactgggggctggggactcctgctctagggacgatttgttccttgcctcttgcggcttctggtgactgtcagcaggcttgtgtgtggctgcatcactctactctctgcctccatcctcacgtggccttctccttgtctctgtctcaaagctccctctgccactctcttttaaggatacatatgattgcatttaaggcttccagatagtctagaataaacatctcctctcaagatccttaaataaatcatatcttttgccatataaggtactattcacactttctggggattagaagtgaacatgcagtagtccctttgtatctgcaggttctgcatccactgattcagccaaaaatattggaaaaataaaaattaaaaattaatacagattttaaaaatacagtataacaactatttacaaagtattacatcacattagatattataagtaatctggagatgctttaaagtatacagaaggagtatatgggaggagtagctgtggattttgatattcacaggatgatgctggaaccaacccccgacaaataccaaggaatgattgtatttcgcggggacatttttcttcctaccatttacacttatgcaggaccactgaccttggagggcccttgacctgcctggcaatctgaccaaattactctggaaggcttgtcctcccactttccctaatgctgattcctttcattcctgacccacctatgggtcacatcacttttcccacatcattctcaacaagtgaccttgttgtgttctctatggggggaaaagaaaagaaagaaaaagaaatccctggacctggaccagaatttcttaacttgttgctaaagttaataaacctacctgcatctttcctcacttcttctcctactaaaataatggatctctccatccctgtcctgagaccatctctactcaggctctggataccactctctcctgcttcctcaggaaccttaaatggccaatcaccccacctttgttttgtagagtcagccttttcttcttgataaggtccttcccttcagctcaagttttaaaactcttccttcaggaattttccttcttaaaagaacaatttaaaaaccttacaacaaacaaaattccaccccctggccaatccatcactaagtcctgctgatggtaccttgtaagtctttctaattcaccaacttctccccttctcagcctgctatgagtccagtctgtcatcacatactcctggacgaccatagtaacctttctgcatccatttttggcacctcacaattgctctgttaagctgccttcagttgtgtgtgattggtatgtgagctccatgaggtcagggacttagttccattcatgtgttccctgtgtcctcatcatcttgaaaagggccagaaacacagtagctgttcaataaatgtttgttgaaggtattcacataatttatcactaatttcaggaggaagacaaagttccttaacagcccaaaaggcccagaaaggcctgacccctactcatctctccacctcatcttgtgtcatcttcccttgttccctgagctctagacacattggtcttctatgaacgctcccagttttctcctgccccagggtatgtgtagagaaatgtttcctcattgtttagaacattcccctctgccccaacccaacttttcctaataaataccactcagccttcagatctcagctcatatatagcaagttgcttccttggaaaatctttccttagcaccattatatgctctgttatgttctcgttgcacatatatctgtcatagaaatttcccagtaagaactgtgttcatatttggtgactatttgattcatgtctgtcttagtccattcagactgctataacaaaatatcttagactcagtgatttacaaacaacagaatttattgcttacaattctggaggctgagcagtccaagatcaaggcaccagcagatttgttgtctggtaagggcctgttccccatacatggcaccttcttgctgcatcttcatgtggaggaagggtaagagagctcactcaggtctcttttataaggacactaattccatttatgagggtggagccctcatcacttaatcacttcccaaaggttccaccacttaatactatcacattggctattagattcaacataagaacttgatggagggggctgtcaacattcagactgtatcaatgtctgtctttcccatcaaatgaggacaggggccactatattcccagtgcttagcatactgtctgacacacagagatgctcaataggtatgcactgcaggaacaaatgaagggataatggaataatggcaaggctgagatcagttgcaggaggagaaggtttagtggaagggtcacaactcagttttgcccatgttggagggccccacagctaattcagctggagaggtacactcttgtttgggaatctgggctgggagctaaggacagagggcaggctggatatctagacttaggtggttggcaaccctgtagtagatgcaaaagatgggccatataagaggattcatgtctagagatgagagggggatgggattaagggcagactgggagctcagaaaggaagacccacagattaaaaaaagatgagctaagtgtagagatgtaaaggagggacgaggttgaggggcacgtgaagcagcaggtgaggccaagtgaaggtgaaggacagactgggggtaaaatgagggattggggagaatcaggaaggtttagattttctgagaggaaaaaaatctcctgctggcctaggccaagcaggtgacctgcatgagtggagtgtgtttacctgtgtgcatgcttatacgtgtgtcatagggaacaccacaccactctcaatgtgacttcacttctcaatagattgcctggcatctttttacagcaacccaaactctctgaggcaagtaaggcaggtgtaatgatctttcttttctaggtgcaatattaagttggactcatatcctaggccaatgctctttccaccaaaccacactatttcactgggctctagccagcttgtccggagcttgaagacatattactgtcttatttcagcatttctgtctactgcagatgaaattggcctccagccagagaaaaataaaatgcccttgataaacggcaatatagtaggatcatagctttaggaaattgtgatgctccttgtaacattccccgctttttttctttaatggggagtccttaagaatcaattacattttcctaattagtgtgggtagtcaggacagaccagaaccaaaatattattaatggaatgtgcctcctatcctcggcagctgagtttgggtagcacatgcaaccccaaggaagagctcagccctctccactctgtgggtttgaattcagctacagaagctcagaagaaagagcactggactctactgaaaaccatgtttctacatgagttttcattcttcattcaaattttagcaaattttaggctttgtgacttctaggcatggcccactattgtgttggacaatttttcaggtaaccatataacaaggtactgcggttcttattcttagaatctaaggaaagctatgtactgtgtcatcagaaaaatgcactcacacacacaattttgcttgtatttcagggatttctccaaccttctgaggcctgtccatggctgactccccctatagtttagggggccttcagtccactcatgagtggattcctactgcagcctcccaataggtctctcctctttgctctctgactttccattcctctgctaaattaagaatttcctattgttctcaagtcagcccaaattcttctacatggcttatgaggcccttcatgatctggcaactagctcacatttccccactgtaggcacgtagagggaggggagtgagggaggtttgaggagaatgtaactcagtgaggatctgatggacaaataaaagttagagagtggatgaggatggaagaggaggagtgttgcttggagaggcctggaggtgagagggaaccctaaagaacaagaaaggaatatgacatgggctttggaatacaacatctcagatttgattcctggctctcctgcttattaaccaggtgaccttgcacaattcttcaaacctcagtttccctgtgtgtaaaatggcagtaatagtagcctcctcaaaggaagggtgtgagggctgcaatgcataatgtgtggaaagtgcttagcagagtcctggcaggtaaacagtggatgggtgggctgcagtgagataccaactcttgggatgggatgcctagccatgaaggccatgtaggtcataggagggagttcgttgacactttatctcctctttaccagttgggacttgctggccagccttccagaggtctaacactgaatgctgccagcctctcctgctggcttcagggcctccttgtgtcaaaagtgattgcagctccagacaactgagccccactgacagacacctcccatcctaacacccaccctaacctttcaccaaaggccacaggaccaagatgggaaggctgagactgtgccacagcagggcttcctatgaccccaaatgggggtcagcttttgactctggtgagatacattggagaaccagattaacaccagattcctcatagagcaacttagttatgccaagcatattctcagtggcgacgtgcaaaccgcatttatcctatgtggtagggaatgagacttttctccataaatgcatcatcacatactgcagccttctaagtgttaaccattttgtccaccgatttggcaaaaacagactcgtctttcaagattcagctcaaagtcacttcctctgtgaagccactcctgttcctcctcccccatcccaacacctagtagaagccaagcccttctgaggcttctgatgtctgccattggggagaatttcccttttatttctgcctctttgtctccctctgctagagtgcaagtcctttgaggacaaagcatgttttaatcatcttggactccccagggcccaggacaaaaattggctctcggtagttaataagtgtttgttgaacaaaaggatggctacattttttgcccttttccttcattattaaatattaaatgttcctatttacatattctgccttactgaagaggtgttgctggtccctacacaaaacggtccctgatgactgtactctgatatttcttacattctttccctgtgagtctgtttctaacggcaacctcatcttctaaatgtaatttcacacatgttactaaatcactttgcttcagcctgaacctaggatgttgcttctccttcagaataagatgccagctgggaatagagatccaggcagtcccagaagccccatgctaacaacttctgctaattcttaggctgattatgtggattattgaatagatcgtctttctgctttttatcctttaaactctctctgctcggccttgtctgtttcatcagtaaaggtgggcatggggaacatagagactgtgaaatctaaacctactctactccacttccatttggtcaggttttggaataaaaaaatctactctattagtaaagaattatagtcattttagagccattctctgagtaaaactgtcaattaataaacttggccattctgtttggggaataaaagaaaggaggagggagttaaggagcttatttcccccaattctctaactcaccaatgggtttgtggctgcaattgcctgaagtcccattgactgtgttgcctgcctattgagtaggatcttctggggtacatacaacttaaatgtagttttgaaagttgcttgtctttctctcaggtcatattgctaatattgtatacattgccaattgagcaatcagtttaccaactagaggaaatctggctcactagatttactgagcacctgctgtataccaggctctagactgggtgccctgtctccttgacctctaatcttcacaagcaatctaggaaaagtgttatgaacattttagagatgaaggaagagactcagagaggttatttacttcttgctcaagcccatacagcaatgatttcccaaacctgtagggtgtttcttccttgggtgttttgtagcggggaaaaagaaagtcaaagcctgtttccattatcgtggattttagggaaaggggagtattaaacatagtaatcagagaagcctggttcttctgaagcttctgactgtcatcaaattggaagttaatgctgggggagaagctctgtgtgaaggacccacatactcccgtctctggcccagcccaaactgccttggcttacctgaggctgccagtgacttctggctcctagatcttcatcttgcagctacgtggacaaggtgggtgcagcctggtgccttatgtctgtgctgtagcttcttaacagcaagtgagatggtagcaggcatggaaggccatcggtgggaagggaaaggaggggttgtcatagaccaaggagggtgaccacagcattccacagattcaaaaatgcccatttttaacattgtagcattttacaagtcagaatgcatcttacaattgatatgtacatgaaatgtaggattccttttccagataaactgttagtgcatcattgatacctcttatacgcaatggcatcctggattcaaggaactatggcaggtttcatcttatgtgtcaattctgatcaagtggtggagactatctggagtttgggaggagaaaggtctggtgctatgtccatggcagtggtgaacaacaataaactgagtggggcgtcactgtgcatgagagatggcatagaatcctactgtcgggcatttgcgccttcatccaatatctttggtattaaatggaggagcacctgccatatcttcaactgtaaactaaaggacacaaaacacaggaagcatttccaagggaccaggtcagaggcctgcctcttctcatgcagatttgtgactgtggcctttttaaatacttttttaaagtattaatttaattataaaaatagtacatgcatgctataatacaaagatacagaggtacatgaaattttaaatgtctcattgtatagatgttactattactggccttatagatttttacccttcttctattgtaaacaaatgtgtctttgtgtatgtctgtgcacgtacacacacacacttgtctgtctatggagaaaatcttaacagaattgtgggcaggcctcatttttaatgggcacaacatagtctacttaacctctccccattgaggtttggctcaaagcttatttcttgtttcttatgagtgtaaatgctcagaataacctgtatgaccagtgtcatagtccattcatgctgctataacaaaataccacagattgggttatttataaagaatagaaatgtatttctcacagtctggaagctgagaagtacaagatctaggtgccagcaagtttagtgtctggtgaggactgttttctgcttccaaatggtgccttgttgcatgctctggaggggacaagcactgtgtcctcaggtggtagaagggataatataagcagtttcatctcttaagacctttataaggtcactaatcccatttatgagggctctgccctcatgacttaatcacctcctaaagcctccacctcttaatagtatcacattgattattacttttcaacatatgaattttaggggacattcagaccatagccacaaggaatgctttacttacattttaaattagtttattaagatggtttcccagaaacataaacatgcttaaggtttctgataatttctgaattgatatgtcaaagatgtggttgattgacacttgttaactatgggtaaatttaaactcagtaacaaagcttttgtgtttccattaccaaagaacaagaaactattggaggtaagtcattgtatatttatgttggctgtttggcgatgtccttgttaggaatggagtgagtcatgctgcctgaatgcagtgtgtcagaggctcagggtctcagggacaatatccaggctctaggtcacctttgactttacctgccttatctgaccggctcatagcaggctggggtaagttcatgttgccacggattctaggagggatctctgaagtgtcaagtactgccttttcttctcatggttcagtgcagatggccgcagagggcaggatagttgatgacttattctctggagtcatccaatcttgggattaattcttttatattcatttgctgggaagggaaaggaagaaaaggggaagaagctctgatggcagttccctcttcctagattccctgctggtggtgcctcaggaacttcctttctttttgggtataccctcctttctttccttcctttctcagtgtttactatttgtgggagcatgtactaagtgctacgcactttacacatgtgatctcatttaactcaatccatttaactgaactgccaagaggctaagtggcttacaaaaccaattctatgatctttacatttttacttgtgcaaacgtgtgagaaagtttaactggtgaaacatctgtcaggtgaagactgatgtgctttctatgggtcagcaagaaggcagaagtatatccatctaagtatacatttatatcaaaataatttatttggacccatgtaactatagcattgattattgttttctaaatttgattagcagtcaactgaacatactattcgtttattgcaattgggtactttaaaacaagttctcagagtaagggttttttttctgttatatttttatactcacattaaaaaaagaaatatatacccaatcttgttcaaaaagaatttaggatagctcatatctggtttaatctaaaattaatactttaaaaatggaattttaaaatgataattttagtagtgttttggagactaaaattgggaaagtcaagaagctggctgttgactcacactattggtttcacattgcagaagataatgtgccatttttttcatttcaattcaggcaacgcttcctgatcacctactaagtgctgggcactgcatgtggccagtaagacctccatgtgttgcacagtagctgacagcagatcagcagacttttgctaccaggatgggcacagggcactctaactttgcaaagcagcctttagggcctcttttcaggtgcccagagattgctacggtgtaagggaaacttttgtatgttccagggctggtgtcaggcccattttcattggcaatgaccttcctggcatatgctgcattttcctatgttggtgagaaatttaattttactctccagaggtattagggaaaatattacaaaccacttttcaagttgaggttgaacaaatgaccaggtataactggttcaggaccccaaaataatgtcattgtttctttaagcattgtcattgagttgaaagccatggaggtcacaaataaaaagagttaggctcatattctaaagatccccagctctttaatttaaaaaaaaatcagtgtcaaaatgttttgttttaattacatcattgttttcagactatgctttaaagaattttaaaattagcttagttttttagtaatctatgaataaagcttctcttctcgtgtgcctgccttagagatggactgacttttttgcaaaatgcagcttttattcttagagaacttagtagtgcttaaactgtgttcatattcatcctgtcatttgagctctgtgacagccttgtgatggagacagaactggattcttacccaaattttacagatgaaaagttagaggttgaacaacttgcctaaggccaccttgcctaaagtagcagggccatttgagccctagttcaggcatatttcattgggcacactgtctttccaaatatttgcaaaattggacgcttgaatagaagaccttcaccaaaactctgcttactatttggctatttcaaaagttaattgttggatttgctgggactacctaagtgtcttgaaaaatatgtgcattctgataatggatgcaatacatcaactaagtatttttaggccccttgtgtttttacacttgttacatctttgtaatgtattgatcaaactaatgagtcggactatttggaatgagcagctcagtattatttaatgctgcatttcttgtattttattgatcacttgcctgattaattaacttatactatacttggttttaagaagactttgctggagctactgaacaattctttagctcacttttcttatgaaataaccatggaacaaggtactatttagagtctttgggtcttgttgcgaatttgtgggtagaaaatgtaagatatatttcaatacatggatataatccatttacaagtagctagacggcctttgttcaaatttgaccacctttcagacaatgagcttcacctctcaactctgcaggaagcccttagtaggtcccaaatggaaataggatctactctgtcataactatcaagcctgagatcttaaggcatccaggtagtcacttaggaatgaagaggcaaggatagattcaaacaacatttcagaggtagaaattggcttgttcagtttagaaatgacatggaaatttctagtttaatgatgccagtaactgagagaccaacggaggggcaggggctgaaggaaggggctggattgagtttgaaatattgtatccttctcctgaggaggttataacttggtttgggaatgtggagttgacatggatgagaaaagataagtaaacaaatgactaaactgcagtatgataaggccagagacagagatctgcagagcatgctgggagaacaatttgtggaggttgagaagtcagaaaaagcctcctagtgggcctgacacatgggctacattgtagaagaattaattagggagagtgtagcacagggcattcaatgcagtaaaggcagtctatacaaaggctccaacggtacaacaagagccagtagaccaggcaagttcagtgggctggaggttttaggatggttgaaagatttgaaaagaagcagcagcttagtcatgaagagcctggtaatagcagccagcacttgtaagcatttactgcaagccaggcatcgcagaatagttcagaatatgtttagaaggtagaattgtcagtatgtggtgaccagttggacatggggtagaaaagagaagtacaagtccaaagagagtcccaagtttctgccttgaccaagacagagtttgaatgaggagcctatttatgagggagaaggctgatgagctccatttgggacctgtacaattcaaggttcctttagtcatccatagtatttggatgtatggagtctgagaccagactgccccggtttgaatcctagctcagccacttaggagacttatgaccatgggtaagttacttaatccctctgtgcctcagttcagttttctcactaataagatgggaataatggcacttaaccttatagagtagttgtgatatttaaattttacataaaattatgtatattaattatatattatacgtaattttataatgtgtataattatataaatatacaatgtatataaaattgtatatgattatatatataatttaggttctagatcataacaggcacttgataacttattgttattaattattatcattatatagttctgagactcaaggacctgggttgacaccatcaaggtagagtattatatatgatcattatgtatgatcattatgtatctcttaggaggtatttggctataagaaacagaaaatccaatcatggcttttatcatgggttcttttattgtttagcaaggagtttggagataaatggcttccacattcttttagcagctcagtgacatcaggtccctggactagtagctctgtgattcactcagcctttctcttctattccataaaatggctgtgctagctcctccggttcataaattggccacactagctcaaagcatgtcaccctcaccaacagtgttctaaataggagagaaggaggatagtgggggaaaacactctcctcataggccactaccccttttgtcagagaggaaaatcccagaagcctcctggctgatgtttctgtacctctcattagccaaaagcaggtcacatggtcacctgaaactcaaggaaaggaacaggatagccataattggtttagaccagtcatgattcaatctctggggttggacactgtaaatcctaaacaaatagggtcttttagcaaaagagaaggagggaatggctgttgggccagtaattaagaatgtgcaccactctagggagggaggacatttagagaagaggacaagaggagaacccaggactccatgacattcataggtcttatagggaacaggggccagggaagagatttcaaatgccaaggaaataggagaagaaatccagagaagcaccccaaagggaagagctgggggagaggcaagtctacaggggtacatctggcagagctttgagcagaatgaggctgtaaaaagctgtcagagttggcagtgaggaggtcagagtgaccattgccagtgcagattcagtgatgccaagggttaagaagagaatggtgatctctatcatatgcagttggtaggcgtgcaaattaatccaaaatttgtattagtttggcactgtgtgccaaaatttaaaatgctcataccctttaactctgaaatttcacttctaggaattaattcaactggccaatttagacaagtggaggctgatgtaagtacgaggatgttgattgcagccttgtttgttatagcaaaacaaaaaaagaggggtgattgatctgatctgaaagcccatcatataggattaattataataaatggtagtacatcttggcagtggaataccaggaacagtagaaaagaactgaagttctggagtcccacagccagggtttaaattctggttctgccatttaccagctgtgtgacctcagctctctgtgaacatttctgggactcagtttctttagctgtaaaatgggataattataatactaactcatagagctatagtgaggaataaggatgcagatataagtgaaatacactgaatatttctggcacagattattatgcagtaatttaaaaagatttggcagatttacatgtatgtttaaaagattgtttataagatgttaagagaaagaaatgaggttacagaatatcacgatataatgatccaacaggtggttttatctgggaggtaaaatcctgggcacaattcactttctactttatacctatttgtattttttacctttaaaacaaggcatttaatgtcttattcacctggccaattataagccacaggagggaagctaccatttctgttttgttcaccacagtatatcataatatctggcatattacaagcagatgataaatatgtgttgaatgagtgtatgaaaaaatagtaagttgtgtttagaaggaaattccataggccaagagttcaaagatgcagtagttctgcaccaacaagtccccgggtagacctcagggacaaggctgcagaaatgaagcagaagtcagggctgagggttgtatattggtcttcagtatgaatgcctcagcttctgaaacagctcaggttgcaaaacctgaggaagaagagggaaaacaagccccaaagcaccaggatccagtccctggttttgttcagcacttcccaaacaggctgaatctgagagccaaatcacattttagaattgcagggcattttggtgccattgagtcatttcaacttcagaaaacccaaggccctggaaggaggagttctccaagttcctacaagacctgagacgaccctgccctgtgtttcccaattcctgctctagtgctggctccttcttccaaggactgaacattgtagatttctgatacacacgaagttgttttcagaggatgtccattcatttgactcctaagaaacccagttctcttaagcacaattcaatggcttgcgtctctaaagttcactgatcacccatcgctcttgctctttatttgtaaagaacaaagggaccagggatgtaattaactcacccacatttcccattgtccttaagtcttttgtgcaagcattgattgttgtttttattgttgaaagcagaattgttctcctggcaacacacatccagaaagagagcccagtgagggactcagcaggtgatgctgttgaagtttgaccttaccgtttggaagaataaaagaaaaagccaaaaaaagcaataattgagcagagggtcgttatgaattggttactattctatactattaaatgctttgggagaaaagacatttggttatttttaagtgcatttaggaattcagaatatcagccagctgagctcccaagtacaggtcctcaggggattcagtttaatgaatctttaagagcagcctgttgttaacatattacaattagcacaggtaaatggaggattcgaatgtgcttctggcaaataatctgttctcacttttatatcttagtcattacttactcatacattgatgtttactctgaggttgttttgctgggaagaaaggatacacttagcaaagcaagatgatatggcagaagagagcttgagatttgggatctaaatatgaccgggtggaatattggctctgttcattagtacagtcgtgtggtcctcaggaaattgctgaaatcctctgaatctgtttcctcctctataaaatggggattataaaacctgtttcagtggattgttcagctgattcaaccaaatcatgttaaaagggctgctgcatagctcaataaactttagcttctttccctcaaagttaagcttttcttccctgttcatctaaaaaatcaagcaatgaattactgaaaccttttcatagggaagagaaggcaatgttttgggttctttacccacattttgcccatacattcgactttatccaaagaacgctttgagttgctgcaaccacctgcacgctgagaagacaaaggtgaggagtagggttaaaagcaggttcatgtaggttcaactggaaaaccagctgccacggaagcctcaggcatatctaaatttgttcctccctcttttccttcctaactccttaaggtttgtgggcgggatcatgtaggatgacgacagccaaagggaaccatccaaggctctgaggtggagggagctctgcttgtttaaggaactggagctcggtgggtgagacaaatggtggcaggagatgatgcctgagaagttggcagggaccagattaggtggggaattgcaagctggcattataaagtttggattttaagtgtaatggaaagccactggaagtctttaaacagggaagtgacatgatttattattttaaatgtgcgctctggcttctgtgggaagattggattgtaggggctaagtatggaagcagagagataagttagaaggttgttgcagtggtttattgagtttgggtgctttagggtgctggagagaaatactgtgaaggtaaaactgacaggcagtcaaaggtgaggcttaaatgaaataacataaatgaagtgccaagtgtgtagtagataattaacaacacaagttccctctcttcgtgctacaactatatcaacaaagtgatgtttttctctggaattggatatagggagatgataaattaataaccacattttctcagctatggatttgttctttggaggtgggctgactgggagatggaggtcagcttttgcagatcacagcctgccaactgggaacacttgcgaaaggaagaaataatagaagcaggaagcaggaaaggagggaagagcagtatggaaaaaagactgggccaggtgcggtggctcacgcctgtaatcccagcactttgggaggctgaggtgggcagatcatgaggtcaagagtgcaagaccggcctgaccaacatggtgaaaccccatctctactaagaaaacaaaaattagctgggcgtagtggtgggcgcctgtaatcccagctacttgggaggctgaggcaggagaatcacttgaacccgggaggccgaggttggagtgagccaagattgggccactgcactccagcctcggtgacagtgcgagactccatctcaaagaaaaaaaaaaaagactggaaggagcaatttggggaccttatctccctcacaaggcatgtgacagtggtatggcttggctgcttcagtgccctagtactcaaacccctaaagggagaatgcagatggacaggtgcagaggtcatggggagcacttttgggcttcaaccccacggcagtatcttggggtgagtgcttacgactcttgaagccccagtgggtgtgtgttacagtgtgctctttctgctttgccatctgcaggtggcttgtgttaatcagctcaagtagaccctctgccttatcgcaagagcagagggctttctgtatcctgagttcttgcccagtgtaccagaaaaatttgatcacaggtgggcttggtgcaaggttctgttgagtggtggaggtggcgctcagcaagatggatggggggccagaagagggatggagtgggaaggtggtcttcccctggagtcaggctacccagtggcagactgtcctctgatggcccctggctgaactcccctcagagtccgcattgttccaccatcgctggtctgccagtgtctgctggtgtggtcctctgctcctccgatgtctagccgcttgtgtgtgtgcctgctaaggtctcgggtttatatgggcacaggatggggggcatggctggccagagtggtcttggaaaatgcaacatttgggcacaaaaacaagagtgcctgttctctcttaggtccatgggcacaggcccaagggtggagcccctgccagggaccccactcttctctacccagggcttccctgccctacttccgcatcactgagaaatgtgaggacattggtgtgtgtggaaggtgctggcataacagctggagttgcatccttcaagtgacaatataggtatatcagggcagtctgctatgattagaactgaaaagaatctggaggccatatcatctgaattcctcattttaggaaactgatctctagagagaaaaagtgacttgggcaaagccacagagataatggcagaggcagggctggtagcaaactagagtgggaagagattgagttttaaagtaagagactgggggtgcagtcatttattcagcaaacatgtaccaagctcctgttccatgtcagacccaagtctaggcaccgggaacacagtcaaataaaacagacaaggctcctgcccccatggagcttacattctcattcctcctcttacagactcttctgagactaccatggcagtccacctagtttgccttcatgaatcgatttcctcttctctaaaaagggagtagcaatacctctttaattttaattaattcatttattcattctacaaatattgatcaagtatatatgatgtgccaggcacaatgctaggtgctggtgacccaaaagtaagcaaggtagaaccagcccctgctttcagatatgacgaactagaggcaagatggttgtcatcttaaatgtccatcaaaatcacctgaagcccttaggaggtcactgctgccctggccccatgcctggagctgtcgattccactgctctggggtggggctaggcatcactattttcacaaaccttccaggtggttcttataggggtggggtgaagaagtgctggagaggcaaagataaagggtcatgcgggtggtggtttggcaggtggagggtgcagcctatcagacctgggttcttggggctgggaaatgcttcccagaggaagtgactcatcaggtgagaccatgagtaggactagtccaggaacaagaagtgggagcagtgtctgggaaggccagagcccccagaggttgctctgagggtaaaaggggtaacagaggtggaccatagtccgtggtcagagacaagaactatgccattgttcctttgcctgtttctctctctttgttctttccagccccactcccttcctgttatgttctttatcctacaatacaccatactgacagcacaacagctgattctccagctcctaataattatctgaaagagcttcctcctgtcatccatctcatgtccactgcttctctgcaaggcaggagccagcctccggctcccttcccacagcttccagctcaattgcctccctacagcagagggaaatgctctctttgctgcatgatttgatcagtgtattccccccaaccctccaccttcaggtgcacaaagacaaaatgcattctcttcagatatttgatttgttttgcaagtaagtgctcagtacccaccagctgataaccacattggatgtgtttgacaaatagtccttgagtgttaccataaatctataacttgatgagagattcttattgtcaaaatataattagatcaaagtttggtatttcccaagggtgtaaggaagttcatggatgtgtaccatattcagtaagatatacatctgtgcatgatgtctgccattgtcactctaaaacaagagggaaatctgacatgcttttacgtcctaaagaaggaagatattcagtgacttgtttaagtctcttctgaaataaccctcagcagagcctgagtttattctcaaggcgagggggtgggggaaacggggtgcacaaacagttttgatcccatgccgatgtctgctgacttacgcagagaatacaacaagcttcagggttaaggaaaggataacagggaggttgagaaagaaaaatcagtctgctggaaatgtcattgtcttaagcgagggtggaggagagttggagagtccttctcttctatgtataatcttctcaatgcattgtaaaatgttttaaagggattatattatttctcctgcctgtgaggttaccccaacttgtctcctcctctctccccatttttcccatttttggctcttttgacatgtaagtgagaccagaaacaaaggctgtcatctcatccaggcagccatttgtccacacttaccagtaaactgaatttgccaagaactcccactctgcagtctctgggagaggcaagatgataagcttgtgcctctgataaagcctgcagcctgggatgatctgggctgagtggggagactgaatccatgggaaactgcatcccttgaggagactcgtctggacttctctctgccgggaggcactggcgttgtaagaaatgaaggaatggggtcaggggtggggagcatccacaactcagatgtttaaagagccagagctgcaaacaaaatctggctaggaacagttttcttcgactgacctcactagatgcctctttccaaaattccaagccctcttggggcacacggggtctttctggaagttggtgatgtcgtggaaaggtcactaggtttggatccaaactgcctagtatgagtttaccatgagcttcaataatctgatcaagttccaacattcctctgagcttcagttgcttctgtgagatggaaaacaccatcccttctcaggactgtcagggactttaaatgagctgacatagttaatacaaataaaccaccagcacagtgactgggacacagaaggacctcagcaaactgagtttttgctcctttttcctttgctaaatgaaatcaaaccattgcaaaccccattagtgtataagagacattcatttgtccatccctgaaggtgtaagcacaatataaaaaggcttcccaaactactcaggcggagcaggatagagagatgtatgttttgctgagctgatcataaatctgaatgaagtaattatgtaaagtattcaagagcaattcagtaagaagatgcctcatctgccttgatgggcttttcaattactcatttttagtactgcattatactgttctctggcaataattattaaacatttcaactgtactgctatataaaacttaaaaggctgatttatttcctaggcattagactacattgaataaaatcccccaattacatggttctattttttaaaacctgtttatcagtgattttctagtattgagtcaaaactgacagcaggtcctcatgtgaaaaataagggtacagtgtgttaaatccagcggttattagctttggggtcatggaggatattaatacagaccccctacttgctagtcccagtttctgaatctgtaaaatggggataattcccacttcactggattattgtttgaaataatggatacaaagtgttagcaagaatgtagagtctgtgccaggtttggtggctcacacctgtaatctcagctctttgggaggctgaggcaggaggattgcttgaacccaggagtttgagaccaacctgggcaacatagacctcatctctacaaaatataaaaaataaaaaatattacctcggcatggtggcgtgtgcctgtggtcctagctactagataggattgcttgagtccaggagttcaaggttatagtgagctatgatcttgtcacttcactctagccggggcacagagtgagaccctgtctcaaaaataaataaaaataaaattttaaaaaagaatatagggtatttacttattaaacactagatattctgagattcactggcatttacatatagccagtgagaatcttcccacttattcagtgtatatgcatcaatcacctactaggctctaggcactcaagatgccaccagggcccattctctgattgtcacttcaatgactcaaagtcatggtcatcaagcatctagcagctccaggtccccttctgggctctgtacacaggacatctttcatcatgtgtagccattttccacataaggatgtgtactcacagagagttgggtgactttactcaaggtcattcagtagctaaggcagaaatcagacctatgtctgctggctccaaagtccacatcttctctccccactaccccatgctacctctcaggattccaggagcacatttcacctggtttgaaggataattcctcctcctcttcctggtttttctagaggagatagctcttttcttattgaggattacccacccctgaaaaattaccactttcccgaagtctgtctctacttttctcagcatcttccaattctcacctggaagatgaggctttctattctaactgaggactacaccatgattcaggcagtgacccctacacacacacacacacacacaagcatgtgtgtgcccagttctactggagcctgtccattgtacttgaggctcccaagccaaactggatttaggtgcaggccagctgggctggtaccctggataccagtctgtaaagagaactaaaatgctgctggaaatgtaatacagtggagaaaatggtctttaccagaattgttgagagcaagcgggacacgagaatgataataataatatttatcaatgcacagtgattataatatacactgatagttttgttgataaactttctccttagttcagccaaaaccgggctcttgtcacatgatcaggaaaagattaggcttgtggacacagaatggtgaggaaaacagaatttattgggtgaaaaggaaaaaggaaaagcaactctcagcaaagtgagagagtcctcctatcaggtttcccgcctcacacgttgaatcccaggtcaccacatagcaacgggagaggccaggctcctccccactgaacttcctgaggctccaccccattctcccagtgctcaggtgggcgttattcagaaagaatcagtcaggaaagggtggcttcatccaggaagtgtagtcaggtttttcagccttcaggctgttttaggtttaaatatggagttttgctggggacccttggctgcctcctgtctccactggttttgtgccagaagcttctctaacaactttgtatatgaattcatataaacacttctggcccattgaggtagatgctattatcagtccccattttacagataaggagaatcagtccagaaaagttaaggaacttgccagagtcacaccagtaataaataggctgctggactctcctaggactttgtattgtctcctggtagggggaaaacccccaagagcacttaagtgacaagagctggtatctcagtgaccttccaggcctcttagttgctgggtgaggtatgcaagtttagggcagcagttgaactactcaggttaatagagtgagcagtgctgagctggcagtctgcctgccctcctcccacgcagcactcagcctatcctccaaatgaatgttgggcaaatatttagagaatatcgttttgaaagggggccaggttattagcctgcccagggcgcctacgcatcttggcccagccttgctcccaagcctggcctgctgtctgtgctcctaatatgtgaaacaactcacatagcatggaggattaatctgcttttgggggagaaatgcaatctggtgtttctcaggactaaacttctgtggattggatgccacatgcccggtgccagagggtccgccaatggtgctcgtggccacgtcacctcccccacaatcccacgtgcttctcaagtctggaaagcacagggtacactcccgggaagagaaaataaagcaagtgagattttaaaagatgaataagatggaggtaagaatccgtttgaagagatgctaatgcaaaaagggatgctagttcagagacatgcaaatcaaaactacaacgaggcaccacctaacagcagtcagaatggctgttgttaaaaagacaaaaaataacagatgctagcaaggctgcggagaaaagggaacacttgtacactgtaggtgggaatgtaagttagtttgtccactgtggaaagcagtttggagatttctccaagaactaaaaacagaactaggatttgttccagcaatcccattactgggtatatatgcaaaggaaaataaattgttctacaaaaaagacataagcactcatatgttcattacagtactattcacaatagcaacgacatggcatcaacttaggtgtttgtcagtggtgaactggataaagaaaatgtggtacatatataccatggaatactacatagctataaataataaaatctatcctttgcagcaatatggatgcagctggaggccatcatccgaagcaaattaactcaggaacagaaaaccaataccacatgttctcacttgtaagtgggagcaaaacactggattcatatggacataaagatggaaatgatagacaccaggggctaccggagcaggaagagattaatggggaaaggtctgaaagactaccttttgtgtactgtgctcactacctgggtgatgggatcattcgtaacaaacctgtacatgtacaccctgaagttgaaattatatatttttaaaaaggatgctataacttttgtgaaagttaggctggaagatgggggtatttgtagggaaaagggacaggatttaagcctaaatctttacagtttagaagagaggccactgacaaaaagtacactgaataacgcagtcaatgcagccattcaaattatgtttctgttaagttcagaaaaacctggaaaaatattgaggctcctaggacaaatggaaaaagaaacaagacacattatataaacaaaatcagtaccgctattaacaaattttaaagaatacatggagaaaaggctagaaggaaacaaaccaaaattattcaaacagtggaggatttttttttttcctttacttttctgtcctggttaacgtttctatgataaacttactttttaaatcaataagggcaaaatctgaattttaaaaaatctatattgaaagccctttcataaaagacaaaagcaactgtctttccttccatggctttcagattgaaaaaatacacgtaggaaactagtaagaggtgattcaatgactgggattattttctttggattctctctcaggttttactgaagtagttagaaagcccttcctgggcagattcagcaataataaactacattaatttcatttccagaaaaaacttaagatgtcaaatttagctaagggggatcataatagccccaaattataaacaacaaaatgttcaacgtgctgaggtttgttaggtaaaatgtggaccaaataagatgaggtattatgctgccattaaaaattttattgggattgtacattaaatggaaaagaaatatgttcgtgatatggtgtgaaatgacgagttataacatgggaagcatactttaatcctgtcttttagaattacatttttatatgtatatgtatgcacaatctaaaatgatatacaccaaaatattaataactatcttggggtggtggaatgatcaggaacgtttgtttcatattttttgctcccctatgttttctgattttctacgatgaacaaatatctgtatggagtaattataagaagcttatttgtttcccctcttaaaagtgtcttcctcccatgttagccagcctgtggtgttaatgcttccctctggggatgtgggccacgaccagttaggagaggggtgcacggcacacaaggggaaccacaacataccgagggcctgttaacagctgctggctgcttcgtcaatactatctcatctattccttctgtccatcaagcaagatggatattatcatcctcattttgcagatgagaaaacagacccagagaggtcaagtagcttggtgtggtcaaagtcatctaattagaaagtggcagagccatgatttagtccaaatctacctgcctcaaacattcatctactttttactctatcacactacttctcatgacacctctagagaagaaatatttataaagtggtgtcatagcacatgtcttccctcattccccaccctggtccctaacttcagtgccccctatactccctgactcaacagtgcatatttagatgtcccaatgccctgttcttcaggcccagcccacccagtacccacatacccagaccagaagctgctgtcctcaattgggggttatcacaccactatccctgataggaaactttggtcgtggtgcctcagcattgaccactgagtcccctgagttgtttccttaatcacatctcacatcctccacagaagatgtcccttcttatcccaaggcccagtttctaagactagcctctcctgctcactctgctccaagcccatgttcatgggactagtttcctgctgtggatgctattccaagttcctgttctaattatctgacttctccttgattctcatgtgggaactggagccctgacctggccactagtcctgacctctgtgtctggggctctgcttcctgaagacaaatgtcccagatgccacttacgtggactttggaatcgtattctcctagatgtctcactgccatggcccacccacgtgttagaacgcttgcaacttcctctgggaccttgatgctgttcaggttcatctcttgaggcttgtgtctcttgaaccagaaagtgtgaggaggtgacgtatcaggggagataatccagatcagagttgaggaggggagtcaagattagatttagggaagaagggttgtatgttcagatctgaaaaagaaaagcccataaataggctgagggaagagtaggcaccctcagagtaaagatgggtcatgatgtaggtttcaaaatgggtatggcatgtgatttaggactaagactgcattcaatgaaaagttttagaagcctagaaaaatcattctattagcttaaaatgcccctgatatttgaaaaggcatattcatgaccagatacccaaccagttgctttaacaatagactgacaagtattggggaaatcaaaccttgtctacctgtctaaacttggtggatatctgggttgtctcacctggctggatgggaaccagtcacagattaagatttctccgtctcttgcaaggagtcaagcagctgccttatcagcaaatctctcccaaagtgactttaaacttaaacttaacccaagaaggtttatttaaacctatatataaaatagaaatgttatcattggaatgttgtaattaggtcctttaaaaatattaagctgggtgtggtggcatatacctatcatccaagctactcaggaggctgaagcgagaggattacttgaacccaggagttcacagccagcctgggcaacatagtaagatcctatttaaaaaaagaaaaatgtataacctcttcatctaaagtaatacatcatcattgttgaaaatttagaaaacacaaaaattatacaaaggaaataaaaatcacccataatactattactagacacaaccactccattgtaatatgttttaattttctgtcttaggtaaaaagaaatcacagattgaaatgaatgactgccatttagttggtagctaacacggtaggattctgagacccactctagatgacgagtgtggagacgtttgggattgccaggaggtttgagagcaggttctgatagtgcaaggcttttcagaagaagctgatattttctgagaagcaaacaatgtttggaggattctctggatcgagagaaataactccttctgttcaatgtttaattaccatctggcaactgaggttgtggataaacaaccgtatttacctgaggtagcttctatggattggagaacattcttctttgtttcacttctgggccaagggtcttagtcttatgtccccctgggatcttggtcagagttcacctggagagagcatggactttggcttcagacaaccctgggtctgaatccagacagatcactctgagctccagttcctcatctgtaaaatcttctgttcctatcaaaggtccagtgatatgaccatgctaggtacctggcagataataaatgttaactcgatatgagtgccttttggctttcccagtgtagtcacccagaaccttcccaaggattttaaagatttaggattaaaaattcctgccaaagttctctgcgaccatcagcaaacagggtcctcactggactcactattctgcaagtccaagaaaatcacattgtttggaaacctaccctcacgtcaacaaagctgcagaagagagtctaagaacctgttaagaaaatatgaagcaaaagtactattcacttttaccaagtacttatgtgtatgttggagtggagtggggtcttttgttgtgggttggtccagtgtatgtggtttcatgggactaggattggctagagagaaatttcctgcctatcataaaggatatggcactattaggagggactgtagcataggggaaagagcatggacattatggccaagtagggctgacctcaagccctagctctgccattctgggactttggacaggttgttgaacccatctgcattacagtagtttcctaaggggtgggtttaataatgcttatttttcagtgtttgagggaatggaaataatatatgtaaaggtcttcatcaagagaaagtgctgaaaaatgctattattattatcaaggctattaataaccatctagggaaacaaagtccaaattcagaaggaagtccagggaattatctaattaaaggagctgagacacatattgtggccaagtcatatagccaggaacctcacaacaaaagggaggaggcaagtacacttagttctttttttttttttttttttttaagacagggtctcactctgtcacccagactggagtgcagtggcacaatcacagttcactgtagcctcaacttcctgagtttaagcaatccttctacctcagcctcccaagtagctgagaccacaagtgtgcaccatcacagctggctaattttttatttttttatagagatggggcctcactacgttacccaggctgatctcgaactcctaagctcaagcaatcctcttgccttggcctcccaaagtgctggggttacaggcatgagccaccatgcccagcctactacacttcattcttacagtgcacacttattagtaccagctaccttgcaaagtggtgatgaaatgatgactatttttaaaaaggctttggaaataggaattgaccagggccttggcaggagaagacacctgaccagtgtacaaagtgcaggaagcaaggagggagatggcacaatgtgaggctagaggcagggaggcaggaactagcctctgtgtaggatttcagtcttgattctgaaagcaatgaaaagctgttgaaatactctgaggaaggagataattatattgtaatgatatttgtgtttttaaaaggcctgtggcttgcagtatagataacaaattggagaaagacgagagagtatataaagacagttagaatgatgttacattagttcagagaagaaatgatgtagcttagtccagggtaatagtaagaatggtggtagacattcaggagatatttggaaggtaagatggacaacatttaaatatggaggatgaaggcaaggaagagccaagggtgacctccagggtttccgacttgcacaattggagtaggaccaggttagaggaaagacggttaatggttaggttagttattaacagggtatatttgaggtgtttctgatatatcaaaaggtaaatgcaagtaaaagatagaaagttggagatacatgcctggaactcagagaagcagccaacactagaaatataaacgaatgaatcatctatacagaggtagtaattaaagccatgagttgaatgagatcacctacagataaagaatcaagtcagaacaggagagggtttacgactgaaccttgagcaagttcaaatttaaaggccagtagtggaagatgagtagccaaagaaagtggagagagtggatgggggaagttgggggagggcaccaagaaggagctatggcacagaaggcaagggaggagagtcagttgagaagaaggatgacataggatccattggattaagcattgcagaagcttagctagagttattttggtagtgcaatgtggcctgaaaatacacagaactgggttgatgaataagtgggaggtgaagggaagacagtaagtatagctaccttattcaagtaatttcattgtgatgaagagagagagaagaccgtaactggagggggatgaagagttaagtaaggtctcagctttttttttaattttattattattatactttaagttttagggtacatgtgcacaatgtgcaggtttgttacatatgtatacatatgccatgttggtgtgctgcacccattaactcgtctcagctttttaatgggagagatttgaatgtgcttaaaagacaatgacaacaattcagttggagcacaagttgaatccagagaagagtaaggagataattgttagagttgggaagaagggatgggaccaagacagtgtggtattagtaaaaaaatagtctaacagagcaatggagtataataaaaagcccagaaatagacccacacaaatatagtcaactgatctttgacaaaggagcaaaggtaatataatagagcaaagatagtcttttcaacaaatggtgctgaaacaactgcatatccacatgtagaaaaaaaaaaagaatctagacatagaccttacacccctcacaaaaattaactcaaaatggattacagacctaagtgtaaaatgcagaactataaaactcctagaagacaacacagaagaaaacctagatgacattggatatggcagtgattttttaagtacaacaccaaaagcattatccatgaaagaaataattgataagttggacttcattaaaatttaaaacttttgctgtgtgaaagacactgtcaagagaatgagaagacaagccacagatttgaagaaagtatttgcaaaagacatatctgataaagaactgctatccaaaatatgcaaaaaactcttaaaactcaacattaagggccaggcgcggtgggtcttaattccagcactttgggaggccaaggcaggcggatcacttgaggtcaggagttcgagaccagcctggccaacatgatgaaaccctgtctctactaaaaatacaaaaattagctgggtgtagtggcacacacctgtaatcccagctgcttgggaggctgaggcaggagaatcacttgaacccgggaggtaggggttgcagtgagccgagatcgtgccactgcactccagcctgggtgacagagtgggactctgtctcaaaaaataaataaataacgactgggcgtggcagctcatgcctttaatcctagcactttgggaggccaaggtgggcggaccacttgaggtcaggagttcaaaaccagcctggccaacatggtgaaaccccatctctactaaaaatacaaaaaagtttagtcagacgtggtggtgggcacctgtaatcctagctacttggaaggctgaggcaggaaaattgcctgaacgtgggaggcagaggttatagtgagctgagatggcaccactgcactccagcctgggcaatagaatgagactccatctcaaaaaaacaaaacaaaacaaaacaaacaactcaacattaagaaagtgaacaacccaaataaaaaatggtaaaagacccaaacagaaacctcaccaaagaaaatatacagatggcaagtaagcaaataaaaatatgttcaacatcatacgtcattagggtgttacaaattaaaacaataatgagataccactatacatctattagaatgaccaaaatccaacacaatgacaacatcaaatcctgtggaggatgtggaacaacaggaactctaattgttgctggtggaaatgcaaaatggtaaagctgctttggaagacagtttggcagttaaatctaaatatactattgccatatgatccagcaattgtgctctttggtatttacccaaatgaactaaaaattttatgtccacccaaaaacctgcacatggacgtttatagcagctttattcataattgccaaaactcagaagtaaccaagatatccttccgtaagtgagtggataaactgtggtactttcagacaatcagatgtcattcagtgctaaaaaagaaatgagctattaagtcatgaaaatacagagaggaaacttaaatgcatattactaagtgaaagaagccaatctggaaaagctacatactgtatgattccaattctatgacattcaggaaaaggcaaaactgtggagatagaaaagattagtggttgggaagaacaagggatgaataagaagagcacagaggatttctgggccagtgaaactatttcatatgatactacaatggtggatacatctcattatacatttgtcaaaacccataagatgtataataccaggagagcagcataatgtaaactgtggactttgcaggataatgatatgttaatataggctcattgattgtaacaaatgtatcattctgatataggatgttgatagtgagggagactgtgtgtgtgtatgtgtgtgtaggggtgaagggacagggaatatgtgggataaccctgtactttccactcagttttgctgtgaacctaaaagtgctctaagaaaataaaatttattaatgtttttttaaaaaatgaagttggatccctactctatcatattaaaaaataaactccaaatggattgaagacctaaatgtgaaagggaaaattataaagctaatgaaagaaaatattggagaatatctatatgatctcagtttctttaggcaagatcataaaagtgcaagccataggagataagttgatgaatttgactagaagaaagttatttctgctaaatgaagaattccaaaggtaagactaacctctgggtgccagaaaggaaaagatatttgtagatgttgaggtattcatgtctagaaaatcccccaaaacagcaagaaaaagacaatagaatccactggcaaagattttgaatagacaatttgcagaaaggcaaacctgataaatttgtgaagatgatcaaatgtagtaacattaaaataagatactacattataagcatcagattggaaacagttagaaaatccagtaataacaagtactggtgaggatatggaggaaattaggaacactagtacatggctgatagaataaaaggtatagctattctgcagtacttagtgaaattaatatgactatacccacaacttagcaatcctactacattatcaatcttgctgagaaactctgatcacaagtacagcagcatgaggttcttcattacatcaatatttgtggagacaaggaactggaagtcaactaagtgcccctcactggaagaatggttacataaaatgtgatctatgcatgcaatggaatactaggcaacagtcataaacaaattacatttacatgtagtaacaatgatatagctcaaaagtgtaaagttgaatgaaagaaccattaaaacacaaaacaattctaaataacacacacacactcagaacaacacaaatacttaggagtgaatgctaagtagaggaggaaaaatggaagtaggataaaaagtataaagataaaaagtaatagaaaatggtctttgctttgtccagtgataaaattatatgataaactatggagtttgaggtacttcattccttttgtctgttgtcctaaaaagaaaaggaatttttaaaagtaaaataaatacaatataggtataataatttaataagattgtgttttgaagattaagtcagataaagcacttaacttagtgcctagaacatattaaacactcaatgaatgttatctagtaatgctatcaacactattcatgatacagctactaccaatctattggagttggcacttaaaaccaattggatttagattactttctcccaaaagatcctttcaggtctaatatactatagttctgcaagagggatagggaaataccacaggaggcccagaagcaacaggcaggagaagagatggaacatccttggggaatgggaaaggctaccatcttgtttgtagcatcataggaaactttgatggttaatttgggagaatactgattagtaaatacaatgcacagattaaggaagtaggaactgcgctagtaaaaagtgctatgaagctgggatactttatatactttgctatacttcctccaaaagggtgttttaacattttaagttataaaattgtagctgagttatgaagttttgctatgcagtgtttgatttggattacccctcccccatcctccttcttccccaaagtgggacacaggtcgttctattgaaataagcaagatcatcacctagtggttaattcctcaaagtgctgacacaagatttggtcccagagagcaaagatgtgcccagtctgcgtcctcatacaatgttaattcattcaacaagcgttgactgggactttatgccaagcactattctggtgcctggggatacagagttgctaacataaaatgataagtttaaaaataaagttaaggaagtaccaacttagaagcttaagcgccctctcaaaatgatgttgcatgtatttatttcccactggttttccgtagatcatagacgaagaagaaactcagtttatgagcaattgccctgttgcagtcactgaaagcactccacggaggaggacccggatccaggtgttttggatagcaccaccagcgggaacaggctgcgtgattctgaagtaagtaaacatggaatccttccctgcagtttatcaaagactttgtggtgtgattgcagggaaaaaaaaaaaagttctttactgagcatcagaaagttgcatcatctctctgccctcccttatctgaattctcaatagcaccatagactatcattggtgaagtgttccataaagattcatttgctagaatctctattttcatcaaataggatgattctcctggccaccctgtcctaccagagataattatattagggctggttaagaaaaattacaaaccaggtgaagataatctttgactttttccacctggaatttaacactttttcttttctcggaacatacagcacctagaatccttaaacactgcttaggctgccccgagacccacatgtgacctccattagccctgagctccactttatgatgctatcttcttctttgcccatcaaaatggccctctggtgccacttcctatctggcctcctgacctcctttcagtgagttataataggtgataaaaggtattaaccagccaaaggagttttcctctggaaggtagcattatctcaaacctgtttctccaaacttatgtgccacagaatgatggtttgggaaatggaaatagatgggcaggaaaatgatttctgtggtcaaatgtttgcaaaatgctgtgtactagatacccttcttacagattcataatactagcataatgaaggttttgcaaagtcctggcgaaaaaaaaaaatctgtttaatttggtttcacccagtatttatggtgacatctattaacattcacagtttggtgaaacataggcataatctattttaaataggtttgaagtcctatatggaatgatgctgagaatgttaggatttcataccagcaaattagtcatgggtagatggagagggttccagtcctagcatccaagaagtcacttttttttaatggaagtaggcactgagaccttcccaacagcctttctcttttttaaatcctcgaaggtcttatttatgtatttggttcatttgtcaaatatagtcattttgacagacttaacaactgtggttaactccagcccacccctgaggagatcccgataagaaagcccacctaggcatcgcaatacctgcagttcttagacttccactgtgcttggcttatggaaaaaaccccacagaatctctgaagcatctgtccattgtccagactcacccgtcattgtctggcctccctttgccgccatctgtctggacattatttgtttctttcttagtttaatgcaagctgagcatccttcctcagattccttgagcagtttggctcttggcattaatctacactggtcattaagaaaaaatcagaattttaaaagatgaaatcatatctataaatgtcaatatataacatgtctatagtatctagttaaaatgtgggagatggccttgtggaaatgaacaaagacccctgaaatgagaacagagactgtgtgttcagagcctgttgtataacaagggagtcagctgccattactagcatttggcagagtctcaaagacaggcagaggactgggaaagccttctagtgaaaacaagagaagactgattggaggttccttggcatgaggaagctggaggcaggctaactacaagtggagcatcttatgtgattggtttggagggcatatttggcttcctctggttagttctgagttgaaagttggggaggtggtgagggcaaaaaatagagcagttgacagttccttggacaaatgctgattttctgtgtcaattgctggggcccagagactaggggtcagagtactatggtcactgtgataaataaccttgctattgtctgttagtattttcactcttagcccagagactgggttcccagcttggccctcagtgcccatcccactacccatgacagcccaatggctccacagagcctggagctctaaagaagatgggctgaaaatgtcagatctatgtgaggagccttcctgctctaaaagctctcatccctctggcccagatctctggttttctttgatttattgttcttacaacccagaagcattagatctttttggtggaagccagaaaggcatctcttgtttacccattaacaatcaacgttatgtgtacatatgtttatccattaacatgtatggcttattcatttgctcattcttccaacaaatgcaactgagcttctattagcccaggcatccaggatatacacaatggaggtatattcttgaccctggaggttcttacaagtcaaataagggagagagaaaaagtcaaccaatgctttctgtgtaccaagaactcagcacacatctagcaggctttgtctaatttgatcttcacagaaaacgactcccattttacagaggaggagacaggccctggggatattaggcaagttttttaaagtcatgaatccatgtaatattaaagtccatgttctgcctttcttttatttattttttctctgaaggaatcatatataagctacaactatttattaaataaatagtaattgtatgggcaggacataaatgcattcacctcgtaaaatttcaaacaatacaaaaagtagtaaaatacagaaaaatacagaataaagaaaaagttaaagatccatgacatcttggctggacacagtggctcatgcctataatcccagcactttgggaggctgaggcaagcagatcacttgaggtaaggagttcaagaccagcctggtcaacatggcaaaaccctgtctttactaaaaatacaaacattagctgggcgtggtggtgcgcacctgtagtcccagatactcgggaggctgaggcaggagaataacttgaatctgaggggtggcagttgcagtgagccgagactgtgccaccgcactccagcctgggtgacagagtgaaaccccatctcaaataaataaacaaacaaataaaatccatagcatctctctcaattccagttttctacacaaaggcaataatagaatcaatttggtttgtatgctttagacttatctctgcttttacattcacgaaggtaatcataaaagcacatagtttcattcctgtgggaatttaaggttacacaaatggtatcatgttatgtcctgaacttgaatggtttttcactaaataagatgtattagagatatgtctgggtcagtacatacaaagctacctctttttgttttttaactgctgcatgtctatggtatggatgttaattattccaaagttagtggacatttagattgtttctggtgtcttactatgacaaataatgttatgatgaatatcctgaaacttgcctattgagcaaatttccaagtttttatccacagtagatgccaagaaatgggatcataagggatgcacatttataattttattagatgctgccagatttttctccagaaagcttgccaacttaaacactctccctgactgtgaacaagagagcctaaatctttacttgctcaatggcacttggtattatcaatctttaagattcataaagattgtgtgaatggcccattcatattcttgtccattttttaataatctgtcttttaaaaattgatttacacggccgggcgtggtggctcttgcttgtaatcccagcactttgggaggccgagccgagaggggggcagatcgcctgaggtcgggagttcgagaccagcctggccaacatggtgaaacccccgtctcttctaaaaatacaaaaattagccaggtatggtggcatgcgcctgtaatcccagctactcaggaggccgaggcaggagaatcacttgaacccaggagatggaggttgcagttagctgagatcctgccactgccattcagtctgggggacagagtgagactccatctaaaaaataataataaaaatttaattatatatttaattttgttttaatatatatattatatttaaaatatagcttataaaatgtttttataaatatatgtaaatacatcttatatatttacatacatataaaataatttgatttatttagaacatatttatgtttaaaattgctctttaggtagtccagataatgacactttgttgtaaatttcaaatatttctctccacctttcttttaactttgcttgtgggtgtctaatcagtcaaaagtttgaaatttttatgtaatcaaatgtatccatcctttcctttatgaattttgattttatgtcttgttcaaaaataattttcctatgcctaaggctataaatatattcccatattttatagattttaaaataaatgtaggtctttaatcttcctggaatttaatgttgtgaatgatatgatattaataagctaccacagaaaatagatggcatgctcaaaatgaggtgccagaggaaagtttaataagggtctattcacaatggtgggggcaaaataacagtgaaggagggctatacaaggagggcctgaagaagcaaaaggaaaaggcagagaggatggggtagagaggaccacccctttacaggagctaagaccttcggttaagggaagcaactagcctcaggtaccccaaccctactcctttctctaattccttgtggactctccctttggtgtggctccaactacaggaacacagagcccattgatataatctttacggagtattctcagtctttaactagggagcagaagagtagagcaggtatccagaggaacaaatcaaagatatccaccatagatgggaaattgaaatctacctatttttccccaaatgggtagttgtcccccatccatttatcaaatagtttattctttccttgatgggctgagatgctacttcattaaatgcaaaatttttatacaggtctggtctgttctgttgatctttttatgtattcttgcatgaaacccacaccattttatagtgtaaaatggtttgaaatggttatgttttgatagcaagtcattgctcattagtcttctagttcaaactgttcatggtcattcaagcagatttctaattcctgacaaatcatagaataagtttgttgtgtttgataaaaaatcattttgggatttcgaatggctttgcactgaattaatagtttcccagaatacataagatgcattctcagtcaaaaacatggaatgttccatatttattttggtctttcgtatccttcttaaaattttgtaatttttcttcatttagattgcacattcttgagaggctttttccccacataggtaatttatagttttatttcttttgtgaatgggatctttgtcttgttgtgctttctaatcattgatcccttgtgtttagaaaagctatcaatttttgtaccttaagtttgaatttgggcactgctgaactctcttggtagttctactggcttattctttcattcttttgggattgtcgatgtaaatgatcatatcttaaaataatgaatatatatatataccttttgtttcttttttatgttttactttattatctagcacctctagtacagtattgcatagtagtattcatgcttattccagattttaatgggaacactattttacttttaagtgtaatattcagtattacagatttcaaatcagtgcctttaatcaagttgaggaagaccctttagctaagaaacttcccttctttatcatgttgaaggtgttatttgggaaaccaaccaaccagtattccatgtgtaagagtaaggcaagaagtgtaggcacccagagtataccagacattgagaaagattcagggtataaacaatgatcctgactttcaaaacactttcagcctagttgtgatgtatattaaaatatttatgcaaaagctagcaaaccgaagacagatattaatgggggacaaattaaacatggtaagagttcagagaggagatgaatgaggaatggaaaaatcagagcctcttggaaaggttagcagttacatcttgaagacagtgttagggtttggataaaaggacagaagggaagaggttattccaggtaaaaggggtggataaagtgaaaactgaagtgagagcaaacatggcagccctagaagacagtagacagacctttcaagattaaaaagcctttggggacaaaatctattgctaaatcatagagtccctccaatgtcaacaggaagagattgaacttgattctaaagtagttgagggagccattagtagttattaaacagtggactgacacactgggaggaatgttcattaaaaagttaataagggtgggccaggtgtggtggctcacgcctgtaatcccagcattttgggaggctgaggcgggcagatcacctgaggtcaggagtttgagaccagcctggccaacatggtgaaaccctgtctctactacaaatacaaaattagccaggtgtggaggtgcatgcctgtaatcccagctacttgggaggctgaggtaggagaatcgcttgaacccaggaggtggaggttgcattgagcggagatcatgccattgcactccagcctgggcaacaagagtgaaacctcatctcaaaacaaacaaacaggttagtaaggatacttaaatctggcagcaaagttcaggacagataaagagggggataccaactgtgctgcagagccctcacttgtaaaaaggagcatttgtgttgtggtgtttgagtaatattcctgggagaaggcagcctagtagataagctgcacagactgatgaatgtctatagatgacagctctgaagcccacgtagctggttgtgttcctttgcccaggagtgccgggaaggaaaatacatagcaattatgactttccttttggcacaaacctgacaccatttccattttccatttggatgcaaagctttgaacatttctaaattacagactttccaggcagccctccttatagacttctccctacaaatgagcgacccagcacttaaagtttccctggcatatgctacaatgctgcaagaatgctgcaaaccatcatagacaagtagcgattgattaaaagaaaaagccgccatgagtagaataaatgtttacagaccccaccagaaggaagttccgtacccttcagtctgacaaaagttttatctcatgaagtgatcctctgtttccatggatttgttacctttggatagatttccaacacttacttgtcccttcctggaagggtctgagatgtagatcatccgtctcctgagaacacactcatttggtaaaccattaggaaattcattcttaggaaacagtggttggtaaaaggcagacgtaagagacaagagccaggcactgttctgggtgcactacaaatacttatttcatcctcatagcaaccctatgaagtagatatgaaggaggaagctgaggcacagagaggttcagtaatgttcccaaggtcacagagtaagtgacagagttgggattcaaacagaagcatctgggctcccaagtctgtgatcttcatactgtactctgccatctcagtctgatgccacagggtcaggttgaactctgactcttctctccctccaacatcattagagccagatcttggctctttttttatcactgctctacattcattgcctaattcacagacacttcttgcattactcttacagaaacctcctgactgatcactctagttccttaccctctggtcctcctcacgctggtataagacttgctgtcctcaggcccatctgagtcacaccacttacctaacacttgaacagggctccccagcaccttcagataaagtccaaatcctgatcagagcatataagggtgcctatgaccttcaccaggttcctcaccagccttccactgcatctctctctctgaactctgaatcctccctagcctttcttgtctgtccattcctttggtagcacttactgaacacctcctgcttgcaggcagtaaggacacagaggctgcctttgaggttggcacagtctagggaaaatcatgaacatacaaattgggtccacagcccttcatccacaaactgaaatccagaaagctctaaaatccaaaagatttttcataactcatttagggccaaaacctgccctaaactgcctcaaagttacgtatggtctttttgtgtacatattaatgtgtttgatggtgagatgctgtcccagaccctgatgggggcattacaagatacatggaatgtgtactatattattcaaaatattcttaatttcaaaacatatctggcctcaggtctatcagagaaaggaccttggccctgtcgatgcaatccagggtgggaaattcagtaatggaagcatcactcagggtgcttaggcagccctctggcaggactgggtttcatgtaaatgttaaaaagaagcaactcatttcttgctagtgaaataacctattcccagctgcagctgctacaagatatgagaactcattcaatgtttctcaccaccaaagaataaagtcaaaattccttaacatgatgtctaactctgtatatttctagccacctttacaaccttatttgtaggaactcctccccacacaggactctgagcttcataaaggcatagatcaatttcattcttctttgtggtcataatgtaggtcagcaaatcacagcccatgggccaaaactggtccattgcctgtttttgtaaataaagttttattggaacacagttacgttaattcatttgtgtactgttagagctctatcaagctatagtagcagaacttaaaagttgcagtggagaccatatgtcctgcaaagcctgaaatatttatctggccctttatagaaaaagtttactgactcctgttctaatgtacactccagcatcaggaactcgaaaattattgattcttgtcctaggttcttctaaaagcccagctgagacctaagtttataagcaggtagtttatttgggaaatgatcccagggatcaagagtgaagggtgggggtggtgatttggtcaagtgttattgacttggccaccactgcaggccactggtgtttgaccccagttggggcctttggagaaggcttatgacatgtgtctcagaacagtgtgcccagggtaaaccggggaagccactatccattggcctccatccttcactaatcaaaggtggccccatagcattaactctcctccacttctgagatgcatacatgtgagtattcttaagattctgaacacttgctgcagcatcagagaagctctgggacaggaatcaagtggtacaccatgcaggcaagacgtgcatcatcccattgcagtgggggcagagatggtcaagtctgtacagagttggtcactgcaacagtggttggagtcagagttgtgctgagaggatgtgaagaggggtgtagagttgcctattatggtctgaatattttgtgtccaccccaaaatccatttgttgaagtttaatccccatcgtgatggtatttggaggtgggacctttgtgctataattagatcaagagggtgaagccctcaaaaatgggattagtgcccttataaaaagacacacagggagagatgtggtggctcacacctgtagtcccaacactttgagaagccaaggtgggaggatcgtttgagtccaggactttgagaccagcctgggaaacatagtgagaccttgtctctacaaaaaataaacaaaattagcctggtgtgctggtgagagcctatagtcccagctactcaggagactaaggtgggaggattgctggagcccaggagattgaggcttcaatgagctgagatggcaccactgcactccagtctgggagacatagtgagagcctgtctcaaaaaaaaaaaaaagagagacagggcttccttcctctctctgtcattcactatgtgaggacaggaggagatggccatctttaaaccatgaagagggcctttacagggcactgaatatggtggcaccttgatcttagactttccagcccccaggactgtgagaaataaattctgttgtttataagctactcagtttatgatattgtattttgttataacagcctgaacagactaagacagtgcccaatacattgattaatcaaataataagtagcttatatttattgctaaccactatgctaaatgcattgcatgtcttatatatgtcttatgtaattctcataaaagccctatagaattttcactatattattcccattttgttcataagagagctgatgtttagacagttgatgtaaagtaatgaggcctgggacttcaactcacttctgcctgactccaaagccctaatcaccactaagctacactgactaagcttgactcccctccccacagctcctgcccaccttctgcctcagtaggtctgtcaggagtaggacagagctcttcctataaccaggggttggaggtctacctgtgaggtgagatattgttccccaagtgaggaaactaaatgtcacttagaaaatggaaaacaagcccagggaaactggcaagagaaagacttgttagtgggaagagaggatgagtattaagaagcaattagctagcactcataatactttgtaatttcgtagggctcactaactctttttatcttcaaagaaagtaacagaaaaccacatgcaatgactccgtgtgtgatttagaggaaaatggcagggttaggaggatctgatgtggctggggcgaagcttaccccacagtttttctggcattaggtagcaagaggaactacaggctcctttgttgtaagtcagggtggttttacttcaggcagcctagaacctcaggaaccctgaccagggaggaagcaaggagtcaacagaaaagggactaggaaacccctgaaccagctaaagtgtcagattcttgggagagcagttggaaagaccaatgccatggctaaatgaaaacatgtgcctgattaggaagactcagataccccagaatctgccatccaacaggtggaatccagatgccagaggttctcgggatgccagtgggagcatggctccaggggatcagtccaatggcagcagagtttcattcaacagctgggatcccaggtgcaggatccagcccccaggggagaaaactggaaagaattaaataggaagtacaggctgccgaggaacaggccctagacagagctctaggcacagcagtaaactgaagcttggtgggaagactaaagcactgccagattgcaccaacatcgtggggatcctgggattgactgcaactttgttggcatgcaagaacacatggcccgccctatttgtgagctagcaccaggtctatggcagcaagactagttccaatcctcttccactgatggagtgggagttgccaatatattccctgccctggtcaagttgggatcaaaacggaatgtttcaaccctatgaacatttttataattgaggttaaattcacataacataaaatcaaccattttaaagtgatcaattcagtggcatctggtacatttataatgtgcaaccaccatctctacctagttctaaaacatttccatcatttcaaagtaaaaccccttattcattgagcagtttctccccattctcctctccccaccccagcccctggcaatcaccaatctacattccggctctatggacttacctattcttgatatttcatataaatggaagcatacaatgtgtgaccttttgtgtctagctttttttcacttaacataatgtttttgaggttcatccatgttgtagctttatcactactttattcctttatatagctgaataattccccattgtatggatataccacaatctgtttatccctgtgaacatttttaacatgagatgatcaaaggataaaaatgagaactttgggcaacagtgaaaaagtatcatggtattattcctacattaacttttcagtccctatttttttaaccaggagataattggcatgttgcctcacacctaagtcccacaccatccataggaaggacagtaatgactccaaacaagagtagaaaaggacaaagaaatggttttacacctactttgtctttcagggtcacaaagtatgaaacagcctgtcccaaaaatgggttgattagatctttggacacccagtgtgtgaccacagtgcaacaaagtcatatacttgggcatttgttccttcatctggaagaagcgagggcagaagccacctgaaggtcctcagtgctgtggaagatggcattcctctatagatgctctcctgctctaccactgttcattctcaattactaatcaaataagtgcacctgagttatttacctccctgcaagcctgctcacaacaaagaatacccaacctaaagtcagtgaacaataagattgcataagaagaaagaatgtaccacactccctccataattaattattgtgggctgatttcagctacatttttccttgggcattttcctaacagttcatatttaacagtccctggaagccaggaaaacagaggagaaaaagctcctttatgtcttagttctatgctattcataaatgaaaatcattgttaatttagagtttgacagctgtggtgcacttgtaagtccagggcagctgtcatcagcactccagtttatttttcaagcacatgtttaatttgactttagcgctattgccagttcttaaggagaaagagggggaagcagaaacagaaataatcattatcttcatcatttggtttcctttcaaaatgtaaatcggcatgattaacaatgatatcagaattgctctaattgcagttttgggtgcagaactagttagctatcatctcctacatggtccaaagtctagttttcttttctttttttttttcctcctaaagtcagagggtgttttgtggtaattacacgcagactctgaacaacagtcccagctccacagaaaagccttccaaagtgcagaagaaaatcaaaaatcaaggaatggggaatgatgggggtgactaggccacaatcccagatgaaagccacaggctgagtcttgtcttgtggctctggaatcaggaaaccagcgagagcaatcagagcccttggaacagcagccaggatctcccgctcttacatatctaccatgcttctgcggccaggcagctggctttgtacaggctcacagtgtgcaaatcggtctcaaagtataaaattaaacacatctgtagctccacgtagaaatctgatgagtcagtatgtacttgatcgggcccactgttccagtccacgttgcttggaggaatcttccttcgcaccagctgtgatgctagctaaacccacttcctggatctttcttcaccctcatttttatatgtgtggcttccggaggtctcacttggcctttattttttgccatctgtcatgtgtccaatcacaatgtcccaaagaacctctttgacattgcctctgtagtggggacagtagatgcaataacacactcctatctttctatttgtttctttgtacattgagatgaaagactgccttgccttcttcatcagtcaacatctcgatatgtgctatgctaaaaaagatcccacccaaaggaaaactttggcaaatgtcctggaccccagctctgaaattaaagtttgatagaggaacaatctacaacttcacccttctagtgccggaggatcctctagacagaactaaagatgtagaccctgaggggcaagtctgactcctaaaagggtagtcttccgtctttttaaatggaaagtattatttgtagattatgagatcagaactaattcttccttaacgatagaaagaccaggcttctgccaggttaacgtcccaagaatctgtgagaatccttagggaattataaacatgtaccaaaaactactggctgttgcttgttgcttgccaccttggccatccacctggggctaggctctggatctgttccgtgggcagctcctctccctgcctttgcctcaagcttggactccaggctgtccattagtacccacattatggttagggccaaacagcaatggttaataagatgttgaggacttggggagtgccccaaagtcctcacagagatcctacataactggactaagggttggctgctcttaggcccacgagcccaagctcatccttagaggttccctgctctcagctcctggcctgtctcacacaaggtgggcaccaggctgcctgcctaaccccagtggcctctttacttctccttcaaagattacccctgtacaagtcccaggttgccccaatttccagacctaactcccctccacactagtttgcttagcattgtagttaagaaggtggacttccaggtcaagtgatctgagattgaagtctggcattaccacttactaatgacgttaggcaagtcattttagacacccagtgcctcaggtgcctcccccataacatgggggtggtaatattaatagtatgtacctacctcatagagttgctgagaagactaaatgagttagtgcatgtaaaattcttagaacacttcctggcacagaataagctctaaacaaggctatattattaatgttgctgttattactattgctttacatttgcaataaaacaaagatcatcatgtagatgtttcctaagacaaagaagtggtctacccaagaagtgaatttcagtttctggtacttaggacaaaaactgtacattttaaaggtcgtttttcaagcttcaaaaactgtttagtcacactggatctccatttcttttacttgcttgctccttgccacttcccataaagaatatgaagtggcattaagaaaaatataaaacaaagtggtcgtgttaaattaaaaaaaatcaagaccagggaaaatcaacattaaaatataacatcggctgggcacggtggctcatgtaatcccagcactttgggaggctgaggcaggtggatcacgaggtcaggagattgagaccatcctggcaaacacggtgaaaccccgtctctacttaaaaatacaaaaaaattagccaggcgtggtggcgggcatctgtagtcccagctacttgggaggctgaggcaggagaatggtgtgaacctgggaagcggagcttgcagtaagcggagatcgcgccactgcactccagcctgggtgacagagcgagactccatctcaaaaaataaattaattaatcaattaaataaaatataacatcaagacaggaggaagatctaaagcatgctaagggctctaaattctcatacacttataagagcactggattacaacccattaaataaaatggaaataaactaaataatataaataatataaataaacacatataccagttaaacaagtggatggataattggaaagtttgataaggaacaggaggtttctataatctcaaagtacttgcccttgaaatacttaatcactaaaaagggagaaaagcaagaactttagaatggagaaatctggcagccacctgtaatgtgtgccacctgataggatgcaatgagaagaaaacgacacagtgccacttctgtgatattcctgctagagatgcataacctgaatctaattatgaggaaacatcagacaagctcaaatattttacagaataaataacatgtaatcttcaagtttcaaagtcaaagactgaggaagattctagattgaaggaaactaaagtgacatgaaatctaaatgcaacactgtgattctaaactagatatattatctgcaacagaacaattgttgaaatgtgaatagggttcgaggattagatatatcaatgttatctaatctcatggttatattgtggttaaatgggagaatatctttgcaagaattacacaaaaaaagtacttgagctgatcagcatcatgtcaaccacttactctcaaatgcttcagggtaaataagttttttataccgctcttgtaagttttctttaaggttgaaatggtttcaaattaaaaagattcagggttgccagacacagtggctcatctgtaatcccaacaatttgggaagctgaggctggaagattgcttgaacccaggagttcaagaccagcctggaaaacgtagtgagaccttgtctctacaaaaaaaaaaaacaaaacaaaaacttaaaaataaaattagctgggcatggtgatgcatgcctgtggtcccagctactaaggaggctgaggtaagaggatcactggagccaggaagatagaggctgcagagagccatgattgtgccactgcactccagtctgggggacagagtgagaccctgtctcaaaaacaaaaaaaggactcggcaaaatcagggggtgttggggtggagaggaaaaaagagctatattgacatctttccttccttcctttttttcttttctccctggcttttttctctcagaaggttgggccaagattttgatgagaagacactgggttcaatcaggaaggcaggcaaggacttgccagacctgaggggctgagctgagttggttcgttcagtgatccttcctgtagtgtgtgtatactaagcaccttcatcacatcccaagtgccataccagacagcaaggatacagagctgagcaggatgcagcctgtgtgaccggagactcgcagagtggtgggaaatgagccagtcaacaggcagcaacctcatggtgtgaaagggcctccccgagagaagcacagggcggagttgggcaggtacccatcctggttgagggtggtgaggaaggtccagacagcagtggcaaaaggcaacagatgaagggaagcagcggaaacagtgtgggattgtccctagaccagagaaggcaaggaacattaggggacctgcaagcaggtggagcaaggaggactgtgattggggcgaaggtgaggccatggtaaggagtgggtgctcaatgaatgttcctctttttctgtactttccttctcttctttatcgcttcctttgccaaaacatcccttctttgagcattcagctgggtattgctctaattttttaatgacagtaacaattgctaaaatatgtgcccacaatcctataatgcagatactattatttcctccattttacagagaagaaaattgaagcacagcttgctcaacatgatatagctcataagtagcagagctgagatttgaaccctggacagtctaactgtgtagcccaagcttttgatctaccacaatgccagagtacatctttaacaaggctgaatcctcaggggattatgtcttttataaagtgtcttgagggcctcaatagttctataactagaggggtaaagggagtggggatcttacaagctgtgtctgttggtgcatcttacccattccagccacctcccctcatcccactcactgccttttcatgcctgccctgttatcagttgtgtgggacctgcaatgggtccagggacacaggcagcctgggctggaccagtgagggttttacccagggtggctgcagagtcagcacagctcatagtggaggagggaaacaaagggtcaaatcaaagaaggatcaggtccaaagggccctcagggggaaaggctgtgcccagcaagaaactgggcacaaagttgggtcaaggtgagctgttcgggatggaaactgaataaagcaaagtcaaaatgtaaaaggtgaaaaaggctcttttgcatgtggtctcaggcaggagggaatgggaaacatactttccaccaccgtagaccccccactaccccctcagggctcaattatttattggacaaatatttagtgagcacctactatgtgccaggctaatgctaggaactggggaggaaaggagaaaaaacaaggcagagagaccagaggggctggcacatgaatattcatctgagaacctgaaatgccaagctttctttggaaccaggctgcatttccattttccctttagcccctggaacaaagccaggaagtgacagagttactggctggggaagagtgtgggagggagggaagagcaagttccccccagcagccgctgccacagtcatttctaaaacaggtttttacagaaaagcctggttattccattattcctctgcagccaggaaaaatccccctttccacacctgcctggtgatcaatacagatgcttctgctaattgtgttgtcaagaaggtccttgactggttctaagcattctgttaggcaaagcttcccccttgcaggtgggttttagggtcagacaggtcaaggttggaatcctggctctacccagtctgagcctgttttcctccttataaaatgggaatcaggagcaaaggcataggaagtacccctttacatttttaaaagtaatttagggtttgcagagcaccttccgctctacccccccaactacttttgctaggtcaacatcataataattgtgagaaattgaagctcagagaggtaatgtgatttgaattggatcacacagaccctgagtataaatgtcaagatatagaaactcggccttcacttttaaaatagaaatgatttgctaggcttttgtacattttcttttgtgatggtcaaaatctactgcctaataccaaggatacctacatactatctaatacccagtagttttagctgggaatttccttgacaaatggaaggcaggagagcccagtggagaagggtatgggttgtggagtcaaagttgttgggctcctaatcctggactacctcttaacagctgaacttgagcaaggtacttgatccctctatacctcagcttcatttatttgcaaaaggagtactacctacctcataggcaggagaattaaacgagataaccagggattcttggccctggctgcatattggaatcacctgagcagcttttaaaacttacctgtcctttggccccacctctggaaattctgatctcatctgtctggggtggaattagggcacccaaatgattctaatgagcaaccagggctgcaaaccctggaactaaataaaatgtctactacagagtgcctagcacatcacaagcactcagtagatgctagttatcactgtcatactggttggtgataaaaccaaggcatgtgggccaacactgatccattggtaccaacatccagtaggtcccagttactgtgccatgcactgtgggtagatacaacggtgaacaagagtgagtctctaccttataagggtttcattaattctctagtttggtaaaaaaaaaggcataaatatgagaagttataataaatagtgacacaaggtttaaaggagaaggaagaaggaaagataaaatttttcaagctcctatctcatgctaggcactttctacaccaacgtagttcattaatgcacacaggagccctataaagtagatattaagctcaatttgtgggacagaaaactgatgctcagggaagaaattcacctacacacaaaacagctagatccagaataaaattttatctgcctgactacagaggtctttctattgtaccatgtctttagcacactgatttcatggtgattataagaacaagtaataagctggtaagaattagaatgtagaaggttcaagtccttatgtgtgtgtgaatgtacacaactatcatctatctgtcattctatgtatctatcattctatccaattatccatccatccacctatccagtcatctaattctgttatccatcattggttgtaaaattagattttcagcttaatcaaatatttcagttaataggtcaagcttttaaattactcttaattaattctccattttcctgcataaaattaaaatattagcattaagccaaacaatatatcacttccagtaaatcatggaggaataggattgctgatgttattctttaaagtgtgctaatggtatcagactatttaatgtagattaactaccaggcctaaacagtaatacaaatagaggaaaacaaaattaacgtgattaaatacacttggaggctatttagtcaacagtcagattgcagacatttgcagctgcagctccaaaagctggttctcttctcagctgtcactaattaatgcgattttcctaataacagttttctgatagacagacagcatcaaatcaaaacaacttcatttttatgctgatgaggcctaactactgcaacaagagcccaacagatgcaaatggcaatgttgctaactgcaggcttgcatgtggtcttaatcacacacaagttgaccatcagtgctggaagtttattgcacaaatacatgggatgtgggagagcttggctagttacatcgtcacatcagccttggtagtactgggtcacagtgggatataccacagctctaggagaaaagtgctctagacaattgtccattgctccggacctacacctgtgtaagtgactcatcttcccttaatttgactgacacttatttttcccaaaagacagaattcaagcaggccggttcacatcattcaatattcagaacccttgctgggcagggtcagcaggaaggcaaccccaaaatggccagcatccctcaagtctaatatggatgactttggctcaggcattgatccctggtgtaatcaattgcagttaatcggtttctccaaagcatgttacataaatcataaatatttatggatcaagaaactggtttacatttcctaagaagggtactagacacatggaaggccaggatttactaccttttctactgacaaccagtacaatagcatcgcaaactgggccaatcagtggcatttgacctctggccatgaggaacttctggtcatctctaggggagcttgaacagagaagaatccaaattggcaggagagtgaattgtagattttcaagaccatgtcagcccagagaaacactgtacatattgatgcctttggatggagaggcattaaatacagtgcaaaatgttattaccaaaagattgttgccaaatatcctccgaggataagaattctgctagttgactttcttgaaatgcatctcactttataatagaaacatccttcacatggagatatccagaaagctagggaaatgtacatcttaatctcatggcccagactcatccatttacaaacaaagcagtgaccaggacaaagaccctggaaaaagtttgggcccaccacactgtgagggtccagctccagggaggtctgttgtgctgcaccatggaggtggcaactacctggttttgctcttgttcccttacacagatgaggagatagagacttccccctccttccctctttttttcctctcttctcggtgatttctacctatcctactttgtaaaggttttaagtgttttcaagggacacattctctgaagttcaactccctcatgtctcccagatgtgcaacatggaaatgtacatgttacattgtcaaccttaggatatagatttttacttatgtattgggttttaatttattccttgccaacttgaaaacaatttgcagtaccttgtttcacacagacgctccagaatgattcccaagtctcccaacataaacatgagtggtttaccattaaaataaaaaaaattcatcatttacattctgctctgcattaaaatgggatcacattaatttcttttccacattattcactaagaaaactagagttcttggtttccttccttccctcccttcctcccttccttttttcttcccttctcccactcttcctttcttccttcctttcttgtagctgaaaatatttctgtgagaaagattaggaaacaggacagatcatgtccggattttgtagcttacatatggtctcatgctgttgccccagaactctgtgagggtccaagatgactgtggcttacgtctgatgagcttatgccacataaggatgaggtcagatgctacaagaggggcacagacattgaaaagaagaaacatggggcaactcaatggatgagcaaagttgaatgcgttgtgcagtcagcaagtgtcttttttataagaaagctctgtgcttggtttcacctcctggtgctggacataccatcatcctgctgattcccaacattgtgaagggattttgagttcagcctccgtggttccttttgagaacaatggttgccatcagccaaactgcctagcttggtcaaaacacagaaggcataaacagcctttatgcagtgggaaatgtttcatgattcagaccagtcactgtttgctgatcacacagcactctgggtggcactgctaatacagaggagtttgtgcttcttgccagattgtggacatatggcagacactcaaaattatgtgttgaatataaaagagttgaattatggggaaagtcagtgtattgaaaatgtatcacatcagcacacctgcaatgtttcctgtaggaaagctcagtgccaaatgttagagggtccaccagggaataacaaggttcctaccctcaaaaagcttggaattcaggcagaaatgcaaaatataaacatgcaataaatcaaaggataatacaagatattaaataaagttcaagcaaacatcaagagtacccaatgcctgaatgccaaatgaacagtaacaacaaactgtgttctagaagtctggtggagggacaggtcacttctgatggtcctggttaatgcggctctgaggaggaagtgagatggtgacagatgattgggatctgacgaggcagagaggagggtagaagtgaggaggagacatgtgacacacatccacacagtaaagctgaattcaggtacttggggaggggggtatcagacctgaaaggtggcttgcaccccagtgttcagaattgtggatgtttagccaagacttcggactataacctgtaagcgagagaggagcctttgtttagagaggacctactgtgtgccacaccctgtgctggggtgtggtagaggttgggggtgggataattaggatgtggtgccatcgttgctaacaatgtgtgaaagaaagtgataatgaagaggtgatgatcagtcccctggcagagcataggtaaatgggatgggttggcaaggacaggagaccattaggaggttactgcagtaattaaccagaaaatccttcacttaatcttctgtgtgtgtccttccttagggtgaggtagaggggagtcaggtgggtactagcaggcatgaaaatcaaggcttctactttagacagctgctcttatagaatctctccccaaagcaatgcacatgcttacaattttgcatatactttccatacagttttttcaggggttcaaagatcctctggaaccaatcatggtctatgaggtcctagctgagaacagtgacccccctcccacacctccaaccccacctaaagagcaagcatctcccaacagccagttctactactctacaggatgctcccatttccacagcagaaaacctgagtgagaggaaacagaaagaaggcaggtggcccgccctcaaggaccttgctctgtcacctggattgtttccttacacctgagaggacagtgctcttgcagtcagccctagtttgcaggaacccacagaagcgggaggaggctgaagccaaggcaaagtgggacgaactgcggagagtaatgacttgcatgaacccagccaagagggagcttgcaatgtggcagcatttcctcttccttagaggctggggcgattatatgattacacccacgcccagccacggagcagcaaggactcagcacagaacaccggagaaacccaagagcaacacttcactttctatttcttgttttccagctgagacaggttctattttggatcagagcatagtctggagagaaagcagttgaagtcttgggtgcttggaataaaaatttgaccttaatctttaggaaaaaagtgtatatcttagttggaatattttattaaatggaatgacattcatgcccttctgcgtatctactgtcatatatttcagacctaatggtgattcttaagctttgtggggtcaggaacccctttgagaagcagatgaaagctatgaattctgactcagaaaaatgcacttgtgcacatcaaacaaaatttcatcatcctaaaacctgtctgcaaaccctatgttaagaactccaggtttgataagccttggccagatcctctgttaggtcctaggaatgcaatgatgaataagacactagtccctggactcaaggggctctgagtttaaggaagtgttgtttatagatgtgaagaggttggcagggagagccagggaggtcaccgaatagcaagtgaactgtaagaggcattaatagtcaccagctaaacaatgtcatagagacagcctgccagttgtcccttgactagtaataccccaggtaccactaatcaattgcaaaatgctaagtaatgtgctaaggctgattgaaaaataaaagtaattttttagtaacatcaaactgaaaaataaaagtaatttttcagtaacatcaaaccccttgttcatgtgttattaagagaaaagattttttggcttaatgatgtatgtgagatactgccttcaccccaggctcagggattagacaaatatctctttgcaaggttaagaaataccatggataatttcaaccagaggaagaaaaccattaagggtcaaaagacgctggaaaaaaaaattgatagtttggtttaaaacaattatagaaaatgagaaatagtcctgttaactatctagaattgcctgcctgtcagagcttccacaaccgggactacctcctgcagcctatttatttcattcatatgagttgaagagttttccaacagctgacaaatttccagccagtgatccagcaggtacccctaaggatttccgctctttcctgagcttcaccttacaggcatgtgaaagcttcctccagagagaaaaaaagtatttcccttgcttgtgttttcctgtcaaactcctactcacaacccccaccccacctttcctttacagccacatctctgggatgtaaacttgaaggcctgacccagcacagggaccctctggttcccaaatccaaggccttcttataaggccttgtccacagctgtccctcttctccctcttctcagtctcttctgatgaagggcatccctgcccctcactcccaccaaaaaccgtcagtgtgggagcaatagctcacacctgtaatcccagcactttgaggggcctaggcaagcggatcacttgccaggaattcgagaccagcctggacagcatagcaagaccccatctataccaaaaaaaaatgtaaaaagcagccaagcatagtggcaggcaccagttgtcccagctactcaggaagctgagccaggaggatcacttgagtccaagagattgaggctgcagtaagctgtgttcatgccactgcattccagcctgggcgagacagtgagactctgcctcaaaaaaaacaaaacaacaataaaagacctccaacagctccccagtggtgcaaccttgtggcctacatatgggaccagacagagcctgactcctcctttcctctgaactgccctccctatatcccaccatgcctctttccatcagttaggcacacatttaagagcagcattcattacaaaggttggctgatgatggcttcaacaaatagaggtttatttttcccataccacaagaagccccagggtaagtgactgctggtattctttcagcagctaaatgatgtcaaggccagtgtctttgtgattcttcttggcctttcttcatggtagcaaaatggcttgccttgttccacacattgtgtttgtaagggaaagtccatggtgggtcatttgtttttcttacctgggaagcaaaacttcctcagaaggatctcttttaggtgtgcagctctactgcgaagttcctgtccctggttttacagacttagtctcttccatcttgcaaacttcccgttatgttactgaggccacatgtgggtcacatgtcctaccaccagcagcaaggaaggctgggaaagcaggaacaggactatcatgactggcatgtctgatattaccccaaacaaaatgacagctctgcaagtggggaagatggagggaatggatgctgggtagacgccaggacttgctgtgcagtgttctgattcaacagattacgtcactctcctgtcaggtgggcaactatttggtatcacacaaacaatagcttattcatctttgtatctctaagtcctaacacagctttgtggcacttactctgttagacaaacttatgagtaaatgaatgtctgtctggttttaatacctctcacatctaaagtagttctttttaaaacacaatccagttttattcttgtctttttatatctcttatatgaaaatcaattcatcattagttttccattggatttgggcagacgggtaagttgtaaagtgctagagtaatggtattgacaagttatatgatgaagttgaacaatatgagagaaaatgggatcatggtaaccttgttatccctaggtcagtttaactattgaagaggaaataaactgagcactaaaactagctttcctttagtttttattaaaatcagaaccagggctttgtagtgtaactttgtgcaatgcgaattgagagcttgagaaatccaatgaccacacaagtttgggaatgggttgtagtcttgttaagagcctaaccgacctcttacccaaattctggtaataatcaaagctgcacatgggtgtgcagcaccatgtggagctgatatctctgattcaggtcgagatgtctgctcagagcagagaacgttgtttccaagggccacagatggtgggcctgccaagggtctcttttaggtgtgcagctctactgcaaagttcccgtccctggttttaaaaacttagtctctaggactccaagtccaactcctgtgccatttttccaagaagttacacctggtcaacctcatttctaccaacactttccccaactccacctcactccagccagaaatggccaccctccgctgagttgtagcacttgtagatgattgtttgattgggattctaacagatttgtgttgtgagagtcattcgggtatgttccatcatagagagtgccagagtttctttagaatggcatgatctagctttcatctaaccttattgcaccatttggtacccagactcaagcccagtgaattgtatcaatgtcaatatcatggttgtacaattatacttaagttttgcaaagtgtcaccattgggagaaaccaggcagagtacaatcactttgtattcttttttacaaccatatatgaatctacaatatctcaataaaaattttaaaaataaaaatatttctttctaatccccctgtcttttgtgtcaatcctagcattactatgtctccctctagtcattggtgttcgtacctaggagtcagttcccttacctccctctatctcagttttctcatctgtaaaatagggatgatagtaatgcctacctcttggttggggggattaaatgagttaatatttgtgaagcacataggaaggtgcttaactgttaaataaacaataaataaataaaatatcttatgcttaactttctctttctgccttagatccaatatgctataagtcctgatgaattttcctaccatgtgtctcatagagtctctatttcccatgcccctttctcagttctgaccttcagagccgccgccatcatctcctcctcttgaagccttgccattgtgaagttagtcacttcacctctgcctcccatggctcctccattatcatgttccacattgatttccagtttcctttttctgtttatctcttttcacccactagcataggagctccttgctggaagtcatcgtttcttattcctctttgaagtttcagctcctaacatagtgcctggcacaaaatgagtgttcagcatatgtttttgagtgagtgataattaatcaggaataatctcatttcagctactggaattgcttttttgcagtcatggtagatgacctctgaatctatagctttgtgaccccaagcagagactgcagccttaccctttaactctatctacaagtcatggagtcttgtagatagagtcttgtagatagagtcctgcagataagttttcacttttcttctcccatgggcccactgtcttgggcttcctggatacttgttaactcttgaacatacctccatttcttgagacccacctaaagccatatacaagattggtgagtgtgcatcctggcatgtacacagcctttggataaatatgcggccatcgttcagttagcccttggcatccttgtgaagtaaaataagggagacggcctcagcatctgatattatcattgcagtgacttcaatatttgattcctgggtcatcccacagttaattttttcattggtagatgggaataaatattgctggttataaactggaccaactctatggaaaacattactgagatcatagagaaattttataaagtatttcaagaaatattcagtaataaggattttactggaattgggaagaaggctggcaaaaatagtctagagaccacaaacccaaccttcattttggcaatttattgtctctgtctgaagcagctgactaaggtaatactctcactcctccttccacaagcaaagaaacagacctgacatcaatcataaaaacaactactgtttattaagtacttattacgtgccaggtactttttgttaggggctggtgacttaacagcagcaatgataatgaccaccacatactggatatttaccgtgtgcaacacaccacagtaggaacttacatgaattgtctctatatggctgtgacacattccctgaggatccaggtatattttttaagtcatttcatgacctgatttctcccaagtacttcagtttctgagatctctctctcccgggagcagggaccccagccccttttagcactagacagcaaacccacaacttcacaaactctaacttcaccccaacaggcagattccctcaggaaaaagagtggtaaatgaataaaccctccaaacagaaaagggctgagcacctaagagattcaggatggcatttttggaaatgttcacttcaggttgaaaagaaaacttttgaaatgattagtgagttatttagaacctcaatattctaaagtttgagaagataacatactgaggaatttaatttagatttccttaacatgctctcttatgataagagagcattcagtatataaatgctatgcaacagtactgccaaattgcaacacagtatgggagaaatttgtcattttgaaatgctaagggagttcttactaacagctttctcatcttgtaaagctattatttttctgaatgataatatgatttataaacctcagctgagttttatagttttgatgggaatagactcaaaatgcattttctcagaatataaaattctctcaggagttgaccaaatgaggaataaatagaaacttccgcaaccaagtgtaccaaagtcttggtctccactagcatctctgtaggtgaatgttggtcttcctcagggttctgggctcagtttgactctcactctcaactctgcacgctttccctgggtgacatcagccactccaaatcctttgactcttacctaggccagcaactcccacgtccacactcccattccctcccagctttccagagttacaatgccctatgtctaacgacccactagactgcccaccatcacaacctaagccacattagcctcagattctctcctgtccccaaaccctgttccttctcctagaacattggtagtagaatgatactaacatttggaggaataaggtacgaatcttggaatctagcacaggagactgaaaagtgaataggtaacaacagaactcagggaggataaatgaaattcatacataatctaacctttttttttgagacggagtctccctctgtcatccaggctggagttcagtggtgcaatctcagctcactgcaacctccacctcctgggttcaagcgattctcctgcctcagtctcccaagcagcatgggccacctcgcccggctaatttttgtatttttggtagagatgaggttttagcatgttggccaggctggtcgcaaactcctgacctcaagtgatccatctatctcagcctcccaaagtgctgggattactggtgtgagccacagcacctggccccataatcgaacattttactgcagaatattgatgtgtttgattatagaggtattagtggtatatgtacaatcttaactttctgatatctaaaagtttctgaattccaaaacatattccagaccacgggttttgggtgaagaatttgaggacctgtcatatataaagcataagttatataaggtaataatgtatattaagtgcctccttagtgcagactagcacatagtaagggctcagaaatgacaacaattattaaaaagaggaaatgggttgccttagactttatagaatattgaggaagctgagacatcttataggaaatacatgtttttcatctctagtcccccaaaatttttataatcatatatttcaaaaatttgagggcaattacttttctatgcactatcatgcttttaaatgataggctttgccattgtccccctatttacagtaggaggaagaagattcagagtatttattacagaggcaagcaaaggcaggcatgggtgattccggagaggaggcagcacaggcagaggcctggtcgagttgaagaggtgttcacacaagaataaacatcgaaagtctgcaacccgggaagcttggcccaaagtgatgacagctgaagccaggacatgtctggggaaaattataaagacccttgaatattataagtttgtattttatcctgtagatgactgatttttaaatgtttttagcaagagagctttatggaaacaaaacttgatttgcatgggagctctgtccactgcagccacacaccaactggtttttactacatcctgagtgctcttttaaaagagcagatctgatcatcttagtcctctgggcacactcttcaaagatatctcattaaacttggagtgaaatgccatctccctgcaggctctgggtaatgtggccctacccatcttcccagctcatctcatacaggtcgagtattccttatccaaaatgactgggaccagaaatgttttagatttgtgattttttttttcagattttggaatatttgcatatacacaatgaggtatcttgggatgggacccaagtctaaacacaaaattcatgcacgtttcaaacatatacatgaatagacccttatatatatagcctgagattaatgttatacattattcttaataattttgtgcctaaaacaagtttgtgttttacacaaacattgagccatcagaaagcaaaggtatcaccaccacagcctgccatgtggacagtttgtggttgtttggcatcaccatcattcctaaccctaaatttatgtgctgccaataaatgttttaactgtgacctgatacatgaggtcagacgtggaattttccactgtagtgtcatgtcagcacccaaaaagttttggattttggagcatttcagattttagattttcagattaggcttgtataatctgtactacctccctgacttaccactcgtaggtcctcccatgagcccatgtccctcccctcctgaagaactttataagggatgccctctccctgtctcctcccttccacttgcctaattagctcctagtttgctctttcaaacctcagctctgccaccttttttcaggggagcctttcccagcatggttaggatgccctattctatgctctcctgcactccgtggacttccttgtaaactttaatcaaggttgtgttaaatgatcagctgcaggtttggttatttgatactttctcctactatgctgtaaactttgagaatgggtagtgtggccccatctggcttgtttatgacagtgtcctggaacctccctcaggcccctaagcagacccccaactatttgttgaaaatacaccagtaaatataatgggaagacaaatgggggaagaggctgttgtggttgaaattaggatggagcctttggctgaagcaggaatgtggggcctgggatacttcccactaagcctgccccttcccctccacagaggtcctggaggcacagagtggaaaacactctgaaaagcactgttggagatgatgggatgatctgactaacaaaaggctttgttatttggctttggggtgaagactgttattctcttggcctgaggaaactttcttttgcttcatagtcaaaagaatgatcaaagtagctttgcgtagacaggaagcatatttcattcatttatttcaacatcttgtctctcttgggtaaggaatgactgtaaaagacatctgtaggatggtcagaattgtattattttgtgcaagactagatgtagagtagatatttctttggaaagtcatcctggcctaggcccagaccatcaggaagattgcctctgtactctgtggatccatgcacacatggccccattcctgggtctgggatcatgtgacacatgcagatcatgtgactctaatactccttcagtgtggtcagctataatacagtcaaggaatccctatatctgttaaacagggtgaatggaagtgaaaattaccgtttgactgagtagcattgctgaagaaaatcagtagaagtggtccaagatcctttcgcattgtctcagttctaaatgttgtaaactttcaaattactgaaactctgggtttcagtatccaaccccttcaaggccagctgaaaatcaacaacagagtgggttaaaataaaagaagcatgtctgtgcaatcccaaattaaagcgaaaatatgtgctggccaaaagtaagtcatttttcagcctcaaaatattttttccaaattctaagatcctgcatttgacatgtttaagagggagatataacagctgaagttgtctttgttcagaatgtaggagacagttttgtctagactttcaggaaagatatagaatgacattttcagaacaaatcaaaatatatttttaaattcctttttccccttcacaaagaggatctgacatgcttctgtgatttgaatttggctgatctataaatggcctcaatagtttaacatgaaaagtagagtaaaataaaccattgagaaaagttattaaaatactgttagttcactttcttaccttcacaataaccttaccaccaaaaacaatttagtaactaatattgagtggagtggtttctaggtatgtgttaatctcttgacatacattttctgacttagttctcaccacaaccccataaagcaggtattgctgttatgttaattttctcatgaagacagagagagttggggtgactcactcaaagccacaaagccaagcagggactatgtctgactgatctcccaaacctgccttcctgccctcctcaccactgtgcttgggtcttctttcttcacagggccagcatcgtacaaaaacgcattatttattttcaagatgagggctctctgaccaagaaactttgtgaacaaggtaagaccctgtgggtggggagggggaggggcagagacatggaaggcagctcctcctgcacgatcctcctgctgcaagaattaaggcccctgggcttcgtgagttcctctgggttctgcttcctcacgtagctccgatttttaatctggctgtgtgctgtgggtaattggatccgccttaagctctaattactcagcttgattccctgggtagaagataatgtaccttatattggtgtcgtcttcttatttttgtgaaacagtgattattctgaagaggttccttggaataattcacaggacttaattaaggaatgcacaattgtgtacctttaaaaagtctgtaatggttctttggaaaaaaatcaccagcaagatcttgtgtggcacccagacaatatgggaggattttctccagagaagcccagcaggggatggggatgccaagggggtgttgaccttgtgatatcaccacattcaaggatctagtccttagatttgcaaacttatcaaccttctctccttaggttgaaggtattgtaacaaagctcatggaggctaactagactcgggggataaagcagagacctgagtttagatcaggcccaggttcggatctgcctctgccccttctagccatgtgacttaaatagataaaatagtacagtacctccttgacacatagtaaatgctgtctatagaatagatagctcttgttatctatatctgaaagcttattcattaatctactgcaaaaaaaattgaccttaaacatcggaatgtttttaaaagttattggataactaaataaaaataaaaaatgctctatatttatacagcataacaatctcatttctatttaattttgcagaatttttatttgcatttagagcaattagtgtttggagaagaaataatcctctccaactatagcaaagtataagctactaagaaaaagaaaggttgataaaggtcttcggggaaaacaataataataggtaatatgtttggggtgctttgctacgtgccaataactattttaagcacttcatatgcattaattttataatctgcacagcagccctatatggtaaagattattattatatttttattttatggatgaggggcctgacacaaaaaatttaaatagctttcttagcatcatatactcatggtggaaggctgggtttgaagtcaggagccaatgcccttaaccattgctttctagcaaagcaactgcttcccagttcagtagttcttatcattgcctttgacagatcaatgcattgtcctcctgtagatgagctgagcagaaactaggtcccctgtttggaattgtttagagaacatggcaatagcaaaggagagagagagttggataccttgcattaggatcatacctcccagaggggctggagagctggaatctgcagtccagagaaccctggccagcttccacatggacaccaccacacgtgtcttctgaggcttttcttttttgtgttcaactgcctgcaagttcactcagcctttctctacacagggagcatctccacttattaagctcttggttcctcaatgacaatcccatccctgctgtatcttcatgtgatgagatccaggtgctgtggtggacttgtgggtgttttggatcacacatttccaagacacctcttgtaaatgccttagacaagtcttcacataacatcaggattgagactttgggaagtgcacattagttaatgattgatggcagtacatgagggtgtcagtgaagtatctcctaagaaccctcagctcctgaaaataaggctgtcctccgacagtcaaactgacaaaaccacaccacagtgcctggggagaagacctagagctgcacagatgaaaagcaaaggcaaacaatagttttaaaaagcaagataaacaataggttacttccaattaagaacagagaaacaaaatattcaaaaaagtgacctataacaaacatatgcatacacatactttatttttttttttttagtttttttgagacagagtttcactctgtcacccaggctggaatgcagtggcacgatctcggctcactgcaacctccaacccccgggttcaggcgattctcctgcctcagcctcccgagtagttgggattacaggaacacaccaccatgcccatttttgtatttttagtagagatggggtttcatctctactaaatatgaaaagatctctgtctcacaagtaagatctaaatagagatttgccatgttggccaggctggtctcgaactcctgacctcaagtgatccgctcatctctgcctcctaaagtgctggaattacaggcatgagctaccgtgcccggccctgcatacacatactttaataccatgtcacaagcaattaaatgaaagagacaaaaaaaaaaggaaaaaggaagggaaacgcagaaaaaagagaaaaatgtcaacagaaacaggataatgagaaaaggaagaaaaagggaagaggaacaaagaatacaggaagagagttgcaaaggaagtcagtggatttcaagtagaaatggggagagagggcggctctggagatgctccatagcctgaaattacccatggttggcagaccctgcctgctgtggttagaagaggagtaagtggacgattcttatcactgccctttgaaagcctgattcattttcaataggcttttccttagtaggaaaacagtatgtctgtttttattttcaaactgaaaaatttatttttcaaatgggagcttaaaaatgtatttttcaaatggaagcttattttcctttgaaaatccaaaaggtttattatgcattcctttgaaccctcagaaatatcgttaagtttaccacctatatccgaaagcccttttgataaggcaaagctaccagttggccttcttttggtttttgtagagactattgctgcctcatttaatagcccctagtagctacaattgaaacctcagcatgtatctctgatttagaaatcgtagagctatgtagggaggcaattttttttttagcgcatctttcttcattgaaaaaagcaatacagaaacaataaaaaagttttctctctttcctatctatgcagacctatccagatgaggtctttcctggagtaatgtagtgcagagattaagggtatgagtcctggacccaaaaagacctggcctccagttctgcctgccctgttcactaaccctgtgaccttgaacaggttacctaatctgcttcaatttactgacctgtaaaatggggatagcaaaagtacttacctcctagcattgttaggattaaacgagacaatatatggaaagaaatcagcaaataaaaggactcagtattttgtagttattattatgatgtctcatcctttcatctccaccctagaacctagaattcacttctatccatcatggattttatatatttaaaccaaatcaacccagtaaattccaaaaggaagtcttgtaaaatgctcttcctaacactcacaatgattttaacattctttgccactactctttgtataatatttaagaataaatgtccaactgcaaagaaaaaaaaattatgttaatactactagaggaagtgaaaaaaagcaactgaagcaagttacatctgtagtcattgttttcatcttgcaggaagcagaacagactaaaagcaacaacgtgcagctagagatgtgggtttgacaatcggaaatactgaatttattcatgtaatctctctttccccacttatcagctattcacagctaaaaatgagggccgagagggaatcttaagtttttcctggctacttctatacccagaagtacagtaaacctgagcttatgaacacatttccaccccctactcctcccagtgaagtctctgaaagcatgataagaagtgacgtgattatatatgcatgcctcttttttttctcccttcagtaattctttatctctctccatttattttcactgctctgcttcaaagtcattccttctggtcctgtcattttggtcccagagaatatttcctagagaaagcacacatgtgtattcctcctaaaatttgttagagaaatcctgttgtgggaggggtggggaaggagaccaggatccggaaaggatgattgagtgaattttacccctgatttttcaacatagcccccatcttaaatattctcgaatagcctatgggttattgctcccacagatcttctcaatttattagggaaaaagctctctttttttttttcaaaatattaccatacttagaggcatacaaaatcctttattgcccaagtactgatctggctctaagtcttattaactaatgaaagctgcatcttcttttcctaagggttaaggataaaatgagaccatgatagcaccaccttatatacaacccacgtttactttctaacttggtgacttttctgactgtttcagattccacatttgatggggtgactgacaaacccatcttagactgctgtgctgcggaactgccaagtacagactcacattttatgggaattggtccgagaagacacacccaaaggattaccctcgtgagtagagtggctactctgtggtttggggaaaagcacattgtcaaagttctgtctggttatagggcacactagctgcagcatgtcagatctgctccctagtattggctggttcatgaaatgcacaatccaagtatgtatattaatcaagacaggcagacattatatgggtatgctttcagcttctttgcatagcattgtgctattttttttctttttttttttgagatggagtctcgctctgttgccgaggctggagtgcagtggcacaatctcggctcactgcaacctccgcctcccgggttcaagcagttctcctgcctcagcctcctgagtagctgggattacaggtatgggccaccatgcccagctaatttttgtatttttagtagagatggggttttgccatgttgcctgggctggtcttgaacacctgacctcaggtgctccacccaccttggcctcccgaagtgctgggattacaggtgtgagccactgtgcccagccccagcattgtgctttcttatctgtgatttttaaaaatattcccaaagtcatgctgcttatattcaggtgaggcatttggtaacctcaatccccctgcaatgaccctgtccatgaattccatgacagacctgctggaaatagcggcaaaagggacctgctcttgactctataggtcaaggtcaacaaatactctgctatcataggtgttagtaattagtcagcatgccttttttttactgacttcagatgccaccttgaaatcccttcatgaggggccaagcatggtggctcaagcctgtactcccagtgctttgggaggctgatgtgggaggatcctttgaggccaggagttagagacctgcctaggcaacatagcaaaattctaaaattagctgggcatggtggcacatgcctgtagtcctgtagtcttgcctgtagtcctagctactcaagaggctaaggcaggaggatcttaagcccaggagttcaaggctgcagtgagccatgaccacaccactacactccagcctgggcagcagagcaagactctgactcaaaaaaaaaaaaaatcttttcataacattgttatcaagatagccaatacaaagccatgagagttgtcaggagaccccaaacttactattttttaagtagatcctactaattccactttatcatataattgtctcaacaaacgcctaacatgtgccaggcactgtgctcagctctagagttataatactgaacaaaaaaaagatgcatcccatattctcaagccactcagcggctagtggagagacagacactaaccaaatagtcatgcagaaagaggtgaagactataagaaaagtggacttactgtgaaccaagcatttctacatatgttatagtgtttaatcctcaaagtaatgtgtttttgtggataagtttactggggaggagagagatgtcatgatttgcccacattgagatgtaagtaatggatccaagatccaaaggggtttttcagtctcctatgcctgccttttgtttgggttgcgtgttgcccattctctctgtgggtggcaggatgtccatgtgtggcactgagcctgtttttttctgttcattgtctgttttgttcttgtgcattttactttggagttaccgcagttcaggaagaacagtaggaatgggagagagagattaaaaagagggatttggctcaggtcccaaaggaaagggggagaaaagggcacatgattggacttaagaagactcagaccagatcagaacctccatgatccccacgcagcccacccagaggggacttcgacatttgttgacaaatcaagagctctattgtttaatgttacccacatgcaatcaaggcttgggatcttagaagcctctttctagttcattcttctgactctgagattcagcctgatctgcatcagctgtgtgggagacctgtgcgaagaaacttggactctctgcctgggggaaagaaaacatttggaacaagcacgatggaaaaatttcctccagcctctcctatccactaaccagaggaaataaaatgttaggggcccgttactcatcttttgtgatcctaagaagcttcttgacctttcctattctgccactgtcatttcccagaatttagggaggaggtgaaaaaaaaaaattgtttctgggtctttgggccaaatcaagtacaaatctatacagagtttctgtggagttgttgagagtttcttagtaaatatagcagacgtgtgttccagatcttctaggattgttccatttttgacatgatgtcttatagacaattgtcagattgtgtcctaatttttggttggaaaaatttggtcacttgtacagaatagcacttaacatagcatactgtagttatttttttaaaagtctttctttcccactagaccaagaagtcctccaggacaaacgtgatgacgtgcttatctttgattcttagtgcctgttgtcttcccaagcactgtgtactgattgttgaactccgagtcacactcattatgacctgggaggcagatgtctagccttcagctaattatgatgggcagtatggaggagagtgtgagtcaaaccttccatggaggaaaaggagtgaacactcagggagactggagccgtttaaaaggacatggggaggatctaatcgggatcttgaaaatttaatgttctcaaaagttatttctatcagtcttaagtaatagatgaatttctttttgccactgcaaagatgatactgtcttgataaccattctctatcatcatgcccagagaagcttcccacaatagtgcaaactgacaattgccaagcccccctgtcctttattagtcatccaaaacactgctttctctacagtgatcttaggacagtggttcttaagcttttaaatcttaggaccgcttttgtatgcttaaaaaatctttgaggatcccaacataagtggtttatatgggttatagccatcaatcttccatgtatcaaaaactaaaacagagaaattgaaaaatattatttatttttaaaataaacctagtaaattaaaaataataaacttgttccaggttaatataaagaacatattttatgaaaatacctatattcaaaacaaaagaaatgtgaaaagaggatcaatgttttacgtttttgcaactgtcttttctatctggcttaatagaatacacctggattcccatttgcctttgcttttgcattcaacttagattcaaaatagattcaaataggttcaaaaaatctattttttggttgaagtatgcggagaaaattctgtctcatatggctatgtaattggaaaagggaagagtattttaataaccttttctgataattatggataatctttgatcctacaccagaactctgcaaattgtttttttaaaggttaattacaatgtggaatttgaaactatatcaatgaacttgtactcttacattaaaagtcattgctttaccttctactttgaatggatcttttacaaatgcatggttttgtaacatcttacgttgatcatttggaaaatattggtttactgagttatgcagattgtgcaagtgttgacacagttcattaaacaatatgaaaagccatatccattaatatcactaccaatctcatcagaaaagtatttaatattggaaagctatcaagttcataataatgaacacaagttttctaaaattctgggttttgcttgaaagcttgaattttatcattggcaacaaatactgtcagttgttttccttgaagtgacaggatcactttattttttagaaaatgtaggccaaattcccaagtctgaataaccataatttgtctgtcatttgtcctttcaagtgaaaatgatgttttatgaacataaaaagcggctagtccagcttgcacctcaaagagtcgcataagtgcttttattcaagacaatcacagtacttcagtatatagcagaagtgcttctgcgtagttcccaattagtcacacagaaaaaataaaaatatgtttactcaaaggcagagatctaatgaaattaatcatttttattgttttttcaaggacattctttttttttttaactttaagttctgggatatgtgtgcagaatgtgcaggtttgttacgtaggtatacatgtgccatggtggttttgccgcacctatcaacccattatctaggttttacgtcccacatgcattaggttatttgtcctaatgctctccctccccttgccctgcactccccgacaggaccaggtgtgtgatgttcccctccctgtgtccatgtgttctcattgttcaactcccacttacgagtgagaacatgctgtgtttggttttctgttcctgtgttagtttgttgaggatgatggtttccagcttcatccatgtccctgcaaaggacatgaactcattcttttttatggctgcatagtattccatggtgtatatgtgatgcattttctttatccagtctatcactgatgggcatttgggttggttccaagtctttgctgttgtaaacagtgctgcaataagcataaatatgcatgtgtctttatagtagcatgatttataatcctttgggtatatacccagtaataggatcactaggtcgaatggcatttctggttctagatccttgaggaattgccacactgtgttccacaatggttgaactaatttacactcccaccaacagtgtgaaagcattcctatttctccacatcctctccagcacctgttgtttcttgactttttaatgatcactattctaactggcatgagatggtatctcattgtggttttgatttgcatttccctaatgaccagtgatgatgagctttttttcatatgtttgttggccacataaatgtcttcttttgagaaatgtctgttcatatccttcacccactttttgatggggttgtttttttcttgtaaatttgtttgagttctttgtaattctggaaattagccctttgtcagatggatagattgcaaaaattttctcccactctgtaggttgcctgttcgctgtgatgctagtttcttttgctgtgatgaagctctttagtttagtaagatcccatttgtcaattttggcttttgttgcaattgcttttggtgttgtagtcatgaagtctttgcccatgcttatgtcctgaatgatattgcctagattttcttctagggtttttatgcttttaggttttacatttaagtctttaataatccatcttgagttaacttttgtataagatataaggaagggtccagtttctgttttatgcatatggctaggcagttttcccagcaccattgattaaatagagaatcctttccccactgctttttttttgtcagatttgtcaaagattagagggttgtagatgtgtggtgttatttctgaggcctctgttctgttccattgatctatatatctgttttggtaccagtaccatgctgctttggttactgtaggcttgtagtataatttgaagtcaggtagcatgatgcctccagctttgttctttttgcttaggattgtcttggctatacaggctcttttttagttccatacgaaatttaaagtagttttttctagttctgtgaagaaactcaatggtagcttgatgggaataacattgaatctataaattactttgggcagtatggccattttcacaatattaattcttcctatccatgagcatggaatttttttccatttgtttgtgttctctcttatttccttgagcagtggtttgtagttctccttgaagaggtcattcatgtcccttgtaagttgtattcctaggtattttattctctttgtagcaattgtgaacgggagttcactcatgatttggctctctgcttgcctattattggtgtataggaatgtttgtgatttttgcacattgattttgtatcctgagactttgctgaagttgcttatcagcttgagattttaagctgagatgatggggttttctaaatatacaatcatgtcatctgcaaacagagacaatttgacctcctttcttcctatttgagtatgctttatttctttctcttgcctgattgccctggtcagaacttccaatagtatgttaaatgggagtggtgagagggggcatccttgtcttgtgctggttttcaagggaaatgcttccagcttttgcccattcaatatgatattggttatgggtctgtcataaatagctcttattattttgagatatgttctatcaatacataatttactgagagtttttagcatgaagcagtgttgaattttactgaaggctttttctgcatctattgagataatcatgtggtttttgtcattggttctgtttatgggatggattacatttattgatttgcatatgttgaaccagccttgcatcccaggtatgaagccgacttgatcatggtggataagctttttgatgtgctgctggatttggtttgccggtattttattgaggattttcacatcaatgttcatcagggatattgacctaaaattttctttttttgttgtgtctctgtcaggttttggaattgggatgatgctggcctcagaaaatgagttggggaggagttcgtctttttctgttgtttggaatagtttcagaaggaatggtaccaactcctctttgtacctctggcagaattcagctgtgaatccgtctggtcctgggctttttttggttggtaggctattaattaatgcctcaatttcagaacttgttattggtctattcagggattcaacttcttcctgatttagtcttgggagggtgtatgtgtccaggaatttatccatttcttctagattttctagtttatttgtgtagaggtgtttatagtattctctgatgggagtctgtagttttgtgggatcagtagtgatatcctttatcattttttattgtgtctatttgattcttctctcttttcttctttattagtctggctagcagtctatctattttgttaattttttcaaagaaccagctcctggattcactgattttttttaagggtttccatgtctctatctccttcagttctgctctgatgttagttatttcttgtcttctgctagcttttgaatttgtttactcttgcttctctagttcttttaattgtgatgttagggtatcgattttagatctttcctgctttctgatgtgggattttgtgcttataaatttccctcttaacactgctttagctgtgtcccagagattctggtacattgtctctttattcccattggtttcaaagaactcatttatttctgccttaattttgttatttaccccatagtcatccaggagcaggttgttcaatttccatgtagttgtgtggttttgagtgagtttcttaatcctgagttctagtttgattgcactgtggtctgcgagactgtttgttatgatttctgttcttttgcattttctgaggagtgttttacttccaattatgtggtcaattttagaataagtgctaagtggtgcagagaaggatgtatattctgttgatttggggtagatagttctgtagttctattaggtccacttggtccagagctgaattaaagtcccgaatatccttgttaattttctgtcccattgatctaaaattgacagtggggtgttaaaatttcccactattattctgtaggagtctaagtctctttgtaggtctctaagaactttctttataaatctgggtgctcctgtattgggggcacatatatttaggatagttagctcttcttgttgcattgatccctttaccattctgtagtgcccttctttgtcttttttgatctttgttggtttaaagtctgttttatcagagactaggactgctttttttggctttccatttgcttggtaaatattcctccatcccttttttttgagcctatgtgtgcctttgcatgtgagatgggtctcctgaatacagcacactgatgagtcttgactctttacccaattttccagtgtatgtcttttaattggagcatttagcccatttacatttaaggttaatattgttatgtgtgagtttgatcctgtcattatgatgctagctggttattttgcacatttgttgatgcagtttcttcatagtgtcattgatctttatattttgtgtgtttttgtggtggctggtgccagtttttcctttccatgtttagtgcttccttcaggagctcttgtaaggcatgcctgttggtgacaaaatccctcagcatttgcttgtctataaaggattttatttctccttcacttatgaagcttaatttggctagatatgaaattctgggttgaaaattcgtttctttaagaatgttgaatattggccccccactctcttctggcttgtagggtttctgcagagagatctgctgttagtcttatgggcttccctttgtgggtaacctgacctttctctctggctgcccttaacattttttccttcatttcaaccttggtgaatctgacaattatgtgttttggggttgttcttctcggggagtatcattgtggtgttctctgtatttcctgaatttgaatgttggcctgtcttgctagattggggaagttctcttggataatatcctgaagtgtgttttctaacttggttccattcttgtcctcactttcaggtaccccaatcaattgtaggtttggtcttttcatatactcccatatttcttagaggctgtgttcgttccttttcattcttttttctctaatctagtcctcgtgccttattttggtaagttgatcttcaatatctgatatcccttcttctgcttggtttagctattgatacttgtgaatgcctcaggaagttctcatgctgtgtttttcagctccatcaggtcatttatgttcttctctaaactggttattctagttagcagttcctgtcaccttttatcaaggttctgatcttccttgcactgggttagaacacgttcctttacctcagaggagtttgttattactcaccttctgaagcctacttctgtcaatttgtcaaactcattctccatccagttttgtgcacttgctggagaggagttgtgatcctttgtaggagaagaggcattctggtttttggaattttcagcatttttgcattggatttatcctcatcttcatggatttatctacctttgatcttgaggctgatgacctttggatggggttttttgtgtgggggtcctttttgttgatgttgatgttattgcttcctgtttgttagttttccttctaacagtcaggctcctcttctgcaggtatgctgcagtttgctggaggtctactccagaccctgttctcgtgggtatcaccagcagaggctccagaatcgcaaaaattgctgtttgctccttcttctggaagcttcatcccagaggggcaccagccttatgccagctggagctctcctgtatgaggtgtctgtcaacccctgctgggaggtctctccccgtcaggaagcacggaggtcagggactcacttgaggaggcagcctgtcccttagcagagctcgagctctgtgctggtagaatcctccttgtcaggatctgctgcactcttcagagctggcaggcaggaatgtttaaatccgctgaagctgggcccacagccaccccttccctgaggtgatctgtctcagggagaggggagttttatctctaagcccctgactgggcctgccgcctttctttcagagacgccctgccctgtgaggaggaatctagaaaggcagtctggccacagctgttttgccacgctgtgttgagttccgcccagtctgaacttcccagcctccttagcactgtcggggaaaactgcttactcaagcctcagaaatggtggatgccccttcccacaccaagctcgatcatcccaggtcaacttcagactgctgtgctggcagtaagaatttcaagccagtggttcttagactgctgggctccacgggaatgggaccggctgagcaagaccacttggttccctggtttcagccccctttccaggggagtgaatgaacagttctgtcttgctggagttccaggcaccactagggtatgaaaaaaaaaaaaaaaaaaaaaactgcagccagcttggcgtctgcccaaacagccgcccagttttgtgattgaaagccagggccctggacgtgtaggcacacaagggaatctcttggtctgcggattgcaaaaactatgggaaaagcgtagtatctgggctggatagcacagtcctgtgtctggaattggtgggttcttggtctcactgacttcaagaatgaagccgcggaccctcgtagtgagtgttacagctcttaaggtggtgtgtctggagtctgtctcttctgatgttcagatgtgtttggagtttcttccttctggtgggttcgtggtctcattggctcaggagtgaagctgcagacctttgtggtgagtgttacagctcttaaggcggcgggtctggagttgttcgttcctcctggtgggctcgtggtctggctgggctcaggagtgaagctgcagatcttcacggtgagtgttacagctcataaaagcagcgtggacccaaagagtgagcagcagcaagatttattgcaaagagcaaaagaacaaagcttccacagtgtggaaggggacccggttgccactgctggctcccgcagcctgcttttattctcttatctggccccccccccccccccccccgcccacatcctgctgattggtagagcccagtagcctgttttgtcagggcgctgattggtgcatttacaacccctgagctagatacaaaggttctccacgtccccatcagattagttagatacagagttttgacacacaggttctccaaggccccaccagagcagctagacacagcgtgtcgattggtgcactcacaaaccttgagctaaacacagggtgctgattggtgtatttacaatccctgagctagacataaaggttctccaaagccccaccagagcagctagatacagagtgtcgattggtgcactcacaaaccttgagcgagacacagggtgctgattggtgtgtttacaatccctgagttagatataaagactctccacgtccccaccagactcaggagcccagctgacttcacctagtggatcccgcaccggggctgcaggtggagctgcctgccagtcccgtgccgagcgctggcattcctcagcccttgggtggtcgatgggactgggcgccgtggagcagggggtggtgctcgttggggaggctcgggccgcacaggagcccatggagtgggtgggaggctcaggcatggcgggctgcaggtcccgagccctgccccgcgggaaggcagctcaggctcggtgagaaattgagcgcagcaccggtgggccggcactgctgggggacccagtacaccctccgcagccactggcccgggtgctaagtccctcattgcccggggccagcagggctggccgcctgctccgagtgcggagcccgccaagcccacgcccacccagaactccagctggctcgcaagtgccgcccgcagccccggttctcgctcgcacctttccctccacacctccctgcaagctgagggagtgggctctagccttggccagcccagaaaggggctcccacagtgcagtggggggctgaagggctcctcaaatgccgccaaagtaggagcccaggcaggggaggtgccgagagcaagcgagggctctgaggactgccagcacgctgtcacctctcaatccctcacggcttccttttgctgggggtggcggggcgggggaggcccccagctgcttgcacttcctgggcaaggcgacaccccaccttgtttctgctcatcctctgtgggctgtacccactgcctaaccagtcccagtgagatgaacagggttcctcagttggaaatgcagaaatcacccgccttctgcattggtcttgctgtgagctgcagaccagagctgttcctattcggccatcttgccaataccctccaaggacattcttaagtgaaacggaccccttttgctttttactgttggtatgtggcagtgaaaaatatatcagcgactaacatggtttggggtcattaacttgatccatgctcagtgccagagttaatgtcaatacattacaaagggaagtaatgtcttagcattattataaaaatagttttcaccttctagaccccctgaaagggtcttggggttccaaggggtctgtggtccagactttgagaacctctgcaataggtaagatagcaacctaaggtgtctgactttcagtactctttgactaacttgcccttgggaatttacgttggacactataggaaggatggggcaatacccagtctctgcaggtgggccacatctgccgaggctcttctcaaccattttacaaaatggtttgttccaagtgctgtttctggggttccttccattggagcacagtgttctctctaggaggggctagatgtggttagataagaagggaggcaggggaatcgcctaaatgacctctggcattccctatctattgtaatgctatagatctctgcttgtcatctggaaatagtgaaatccttttaaaacacttctaatctagtagttctagaaacgcattttaacttatcatgtaagttttacttcctaattttacaagtgaaaaactgaagcacaaagaagttacagactcagatgacatagccacagagtgtccgaaacaaaatcaaagcttaggtctcctgactcctttttgccttcctctgtaggctattaggaggccatcaatcttctgtccttctgcagaaaaattagtatcttatacacaaagcatcttttaataaggccctgctgtactaacatgaactcaactggtaccaaatttggtgccatactgaacagctttgccccactctacaaaaacctgcattgcagagatcctaacttagaagtcagaaagagaaggtctggattcactggtcctgagtggagttcatggaccttaaagtgtcagaagaactgccagctcctgcaatgtctgttcgaggcactgtgagtctgtagcttccagctatggctcagaagcagttgcttcacagaaacaaggtgactaggcagtgtaaccacatgagggtgtcctggaggctggagacatgcccattctttgccaaggaattgggagttacctaaaagatgctgagtctctttattctctagctctgaatacagctcttgggtttttgacaaatgctcctatcccatagagaccctttaatcacctttgacaatgtaagctgcatagcttcccccatttttgatatgacatcggttttaatgctgtttaacagatatgcattgatgaaaagaacatttttttccaggagccaatcacgttttccgtttgacaatacattgcctaaaatataaatacagcaattgggaaatatactctatataatcaaagttcattttacaatgaaattcagccatcttttctattggatcaccagatttaggaaattattattaagtccaatcacatgaaaaaccaccgctctaacacttaacaactacttttgtttcttcatatattcatctatgtacagagtatgtatatcacatttgaacatactgttctactttttgcatttgattttgtcttcatactcatatcagcttattctaagcaacttatctattgttttattgatcatttaagtaatgtcaggtcttttgctaacatagaaagcactgcaataaaatactttgtacttaggccaggcatggtggtcacgcctatgatcccagcactttgggaggccaaggcagatggatcacttgaggtcaggagtttgagaccagcctagccaacatggtgaaaccctgtctctactaaaaatacaaaaactcaccaggcatgctggtgtgtgcctgtaattccaactactcaggaggctgaggcacgagaatcgcttgaacctgggaggcagaggttgcagtgagccgagattgtaccactgcactccagcctgagtgacagagtgagactctgtctcaaaaaaaaaaaaaaagccacacaacgcttggtacttaaagtcttcctcaacccgtctcctttctttggaattatttccttgaaataatttcccaagatgaaaactgctggatcaaaggatatggatttttcttttggcccttgatacatcttgccagattcttctccaacacatttgtatcaattcagtttattaccaataatgaataaatgtgtctgtttctcccagccttctcagcattcaattaaaattttaattaaaattttatttagtaataatttattaaaattaatcttattttaaattggcattggtttaattaccaacacacttgaatcttttttcatgtttattgtcctttgcctttaaaaccactagggtgttggcatgaatcaagtctgattttgctccttgtctccccagggcatcagtcattgtctggcacactgaaagttctgaataaatagtgtggaatgaatggatgaatgaatgagaagcagttacaaaatgaggaaggaagagagtggagggagatgagcaatgaaaagctgctgatgaagaggttagggcaggagagagataaggccatatgtggctgctgagtggacagcagcttggatggggccagtggtgtgtgggaggatgcgcaaggaggacattgcagtcagttagtgggcaatggtgtggcttggactgcagcggtgaaagtggtaatggagaaaattggtatatttcacatctcttttaacagtagattctgtcatgaactggatgcggaggagtaagagagagaaacatcatagctgacaagctaggtttctggcttggaaatggaggtgctctttcttttgaaaatattcctcaatattattatctctctctttttacaaatgactttgaaatcatttcatcaggctctgaaaaggatcctgtcagaattttaagtgggattgcactaagtctcaaaattaccttgagaggaattgttagctttataatgtttagcttgtctagttttttcccatttatgaataaaaccaagcatttctgggtttccttagcaccatgcctagaagagtgataccatatggaccatagcccttctttctcaatctaactgcagaaacaaaattaaacattatattacagttctccagagaaacagaccaacaggagatagataaatgagagactagatagatagatagatagatagatagatagatagatagatagataatacatttttttttgaggaattggctcacatgattatggaggctgagaagttccacaatctgccatctgcaaaccggagacccaggagacccagtggtgtagttctagttgaattccaaaagcctgagaacaaagggagccaatggtgtaaatcccagccccagggcaggagaaggccaatgtccctggtcaagcaggcaggcagggtgtaaagaaatggatttcttcttcctctgcatattgttctattcggccctcaattgattggatgaggcccacccacacgggggatggaagtctcctttgttaagttacctgattcaaatgtgtatcacatctggaaatcctcacagatgcacccagaaataatttgggcacccaatggcgcagctgacacataaaatgaaccatcacaaacatacaatgaacaataatcccactgcttccttcttccatcactgtggaatccctcccaatcctgagaagtctgcccatcagagcatctcagctgtgccactgccagtgctatgatgggacaggagacattgctgctgccaccaggctgagtcacaaatataggatttcaccaggaaatggaatttggcacccaacacttgtgtcgtcatacacagtttcagtgaaagaaagggcaaaagagaaaggattaaatatcttctttaccctttttctcttgccttccttctgcctctctggaaaggaagtcctatgacaaccagtcactcatgtatgggttgggagtggagaaggaaagtccatgatcacattttccagttaaacagggaaggctgaacacataaatctctgttgtttccccaaatcccacaaagataacactagatgaataaagcagactcagtcccagaggatttctctcacttttttccagcacttttaggtactttgcacaggtgtgttttttagggatttcattctcacccccagatccactcttctctccatcctgctttgggagggtgacgtcgagggatctcatcaagtggctctctcgccctctgcattccagctggatttggtcagtgggaagccaaggacagaggaaagtgaggtcagggtctctacctacccacccactgctccctgccagtggaggctgcaggtgggtggtcctcttccagcagccacagcttctgcccagccaccctgtcttccagcttcaactctccctcctggttcctgaaactgctcctcctcaggtttaggggtagtcacaactccctgggagcttcacctttccttattgcactcctttgactctgccaggcccttataaaatgtcccttcatcaaactcacttctcttgccccacttgagtatgccatctgtttcctgtgggactgagactggtattgccactttttcagaaattgattcttagactctgtacatgtattattttgataaaataagaagcaaagctaacaaaacagtaaagtcagttattactatagaattttatgttgctataggattttataaaagattatacatccccactgtactgaggctgccctttctgaattgccttcctctcccccatcccactcaaatgctgcttccttccattgctcacctaggacctaaaaacacccaaatgagaatgtcttttctctgggtctgtggctaaactcagacgccaatccagttcccattcccaaatcttctctctttgccaacactaggctgtcatctaacccaaaacatactcaaaggaacaacgttataaagtagattattagataggggtttctggaattttagctaagaggacaccctttaataatagggagtgcattttcacagatcatgtttcctggtttaaaaatatatgcaatttccgtaaaaactgagacttgaagagattttaattttttctaaatgatttttgttttctcaagaaggctttgctgtttcattcttatatatgcttcatcaagttaattcctagaattattttatgttttggttattatgaatgagatttccagttttcattacgttttctatcaggttataattagtgtacaaaaatgctctcgttattcccatttattgtacctctatgttttttcctaatagttttacctaatattccttgggttacataagtaatcaatagctatttgcctagctgggcatggtggtgcgtgcctgtagtcccagctacttgggaggctgaggcaggaggatgacttgaacccatccttgaacccatggttaaggccattgagccatgattgtaccactgccactgcactccagcccaggcaacagagtgagacctcatttctaaaaagataaataaacaaaataaaaaattaataatttgcctgtaaaacacaacatgtttttgtcttttttttttctgattactcttccatgatttctgtggtctcccacttgttcactgacaaggtatgatgttgactcttggcttccaggatgttaaaggatgtttaaggatgttaaatatagatgtacacttctaatttttttaatgggtgttgcatttttctttctttttgagacggagtctcgctctgtcgcccaggctggagtgcagtggcacgatctcagctcactgcaagctccgcctcccgggttcacaccattctcctgcctcagcctccccactagctgggactacaggcgcctgccaccacgcccagctaattttttgtattttttagtagagacggggtttcaccgtgttagccaggatggtctcgatctcctaaccttgtgatccgcctgcctcggcctcccaaagtgctgggattacaggcgtgagccggatgttggattttctaatgccatttcagcgcttattgatatgaacaaataattgttactattcaatctcttttgtggagtattataattactagttttcaatttgctagactattcatccattctgtgatgagcctaatttaattgtggtttgttttttccttcctttagtacacatgtgtaattataaactattcacaaagcattatatttttggtatacattttctcaataattcttgccttagcctcataggatgaatattatgctcctgatttatggaagagaaaattgagtctcagagaggctagagagtaggcccagttcatagagcaaatctgtggtcgagctggtgcgtgatatgaaaggcagagagagagagaggggtgggaagagagagagagagagaataggaggggaagagagacagagggagaagaggagagagagggaaagagaggcagccagagaatgatgcactggctgtgccacaggtttgcactatgaaatgcatctggctttgaatctgggtccatctgaccctagagtcctttctaccatgcctctcctttaaagtggtaatccattagtattgtcattaaattcttcagatctacatgcaagagtgaaagtggtacacaattcctgatttttaaatcaactctttatctgactgtagtctcaaggccatactagctttgaggagtaaattggttagttcctacctacctgtttttattcataattgagactttaaaagaattatccacacacattgaatactttcccttatcctcacccccaagttatccaatttcttcatcagttattggtgtattcaagctctttcttttatgtcagttttagaattttactttttcctttaaaaattatccattttatttagattttcatagttcctagcatacaactatagagtgcagtaagatcattcactatttcctggctaaatttacccgtgttagctttatctaataagctgtgtagcttattaaataatgctactgttatgctgttggtaatttacacacatccacttttatatatactgttcccttctatttcttttgggttgtccttttgttcctttggtgaatttttatattgttgacttagtatgctgattttcccattttgttttttgtttttattaataataaatgcacttaaggctgtgaattttcttagtgtagctctgagcccttcccagggaatttaatatgtagttctcattttcattgttttcttaatagagtgcttttgtgcactttatcttcttgacatatttgttaattagcagattatttcaaaatttctaagtagtcagagagttttgatttacatctttgttcctaattttgttttattttgttttggtaagtgtgttagtccatttttgcatcactataaagaaatacctgagactgggataatttataaagaaaagaggtttaattggctgcaggctgtacaagcacaactccagcatctgtttctggtgagggcctcaggaggctacaatcagggctgaaggccaagcggaagcaactgatgtcatacggtgagagaaggagtgagggacagagggaagaggtgccacactcttccaaacaaccagatctcctgtgaactaccagagcgagaactcactcatcaccaagcggagggagctaagccactcatgagggatctccccacctgatccgatcacctcccaccaggccccatctccaatactgggggttacatttcaatatgagatttggaggggacaaacatccaaaccatatcagtaaaagagtgtgttatatataatttctgcttttttgtacttactgagtttttttttttttttaataacctagcttatgttgactttcaaaagcctgttttcttattctgcctcaggtgccaagctatgtgttacctagtgacacacaagtataattagtccatgaaaggcccctctgggccttgttgtttgttcgtttgattccatctaccccatatttattgtgattactgtcctactataatttttctgccatgttattatacatttctgattgtactttctcatttctttttttttagacaccttcttttctttccattgcctaaattattttcttctgctggattaaaagtgatttgatccatttttttgttgttgttcttatggtggttgcctttaatgtaagacacgtacttatgtttatctctgttgaattcataaacaaaacaagtactttagcatactttataattcctttggtctctactatccctgtacccaaatacacactttatgttggttattttctagaattttatttctggattgtatggataatttcttttttgtttttctctagtctttgcttttttacacaaccataaacattactaaagtgttgttcacccatagctctttagcatttttcttatttcactattttctacaagagtatttttataatacatttttgcaaggcaaaccccctaaggccttatatgcctgagaattttttattatgctctcacatttaaatgactgatggctgacataagacctgcattcagaaacactttgttttccattgtccagtgtgtccttctatccagctgcttagaagcctaatctcagtctgaatttggttgcttcctaggtgatcaaatctctctctctgttttgcttttccatttttttgttgttgttttgtttggtttgttttttgctgtctctttgatgttctttattttcacagttaatgtgacttgatgtcgtttttttctttttaaaacctggttttcggctgggcgcagtggctaatgcctgtaatcccagtgctttgggaggctgaggtgggcggatcacccaaggtcaggagtttgagaccagccagaccaacatggtgaaaccccatctctactaaaaatacaaaacttagccgggagtggtggtgcatgcctgtaatcccagctactcaggaggctgaggcaggagaattgcttgaacccacgaggcagaggttgcagtgagcagagatcatgccattgcactccagcctgggtgacagagtaagactccatctcaaaaaataataataatttaaaaataataataaaataataaaacctagttttctattctatgggtcctttaaatatgagggctttcctcctttaattctggagatttattttttgtcaaatatttcccctcctccttttttctctttctgagcctctggtgactcagatattgtcacttctactcatttccttcatatcatctgggttttattttatgtgttttttcccttcctacctcactgctgcctttaaaaaggcttagatcatctaaaaatactaaaaaacaaactcaaaaacactaaaaaggtctattaattaaagagaagaaaaagcaagtgagaagttcctcagttttatccctaggccactcattctttagtgccaaccatcctgcttttaccccaactactatgttgcttatttcaactgttgtgggggttttattataaacctttatgttgaaatagcttcaaatttatataaaagttgcaagaatagcacacagaacttctgatcacctgtcaccagattccacagttgttaacattttaccacatttcctttatcattctctcaccatatagatacatattattttttgtgaacttctgagaagtagcagacatcatgcctgtccttttacctctaaatacttcagtgtgtatttcctgaatgtttttgtaatattttgtaagagaacaaggatgctcttacaaaattacaatacacttatcattaacattgataaaatactataatctaatctatatgtcttgttcaaattatactcattatacctctcatgttctccaaagcaatactgtatcatatcactataatgtaaaccacaaatatgagccacgtatgtaatttcaagtgttctaatagccatattaaaaaaattaaacagaagcaagtgcaattaattttaatgttctattctattttatttaagccagtatatccaaagtagtagcattttaacatgcaattcatataaaaatttattattgagacattttgcattctctttttcataatatgatccattgtatttttttacacttaacagcacgtctcaattcagactagccacatttcaatcacacagtagctacatgtagctggtggcaaccatatcacacagcacagttttgtagcaaatcaaaaataaaaattctggttcaagatccagtctaagattatatactgcatttacttgtcaggtctctttagtcttgttcaatctggaatggttcttagtccttcttgactttcatgacactgatgcctttgaagagtacaaggcagttactatgtagactctccttctgtctggggctgtctgatgctttctcataattagattcaggttgtgcatctttggcagggataccacagccattatggatatttgtttaacacctaatttacattttgttctttttctctatttcttgttcttgcttcatattgctaacatgctcccgatctttgagaatatgtattgtgcttctgttaaatttttggtccatctgttgcaataagctgcttcatgttcagcttgcattctctttcgctagttgtactgcttgggatttagttactgtggcaggtggtcttctgtttctgtggtgatataaatgttctgcctggtagtgtatgatggggaaaggccaaatcctaggtggtgccccttctggtgtgtataaggaaaaggaaggagacgaggcccaggcatcatgtcgctgctatcaactcttctgtttgctttcttctactgggtaacttattcagttaaggattcatcctgacactcttagaacaaagcaggaataggaggaagtgatctcctcaggttctaatccccagccctgcaagtctggaaacagaagggatgaagaagtgtatacccagtgaaggctgggattcgtttatccctgtctctcctgagagggctttatgctgctgccctgagattattctggctgggaataggaatagagctggcctagtcctgcagacatctgggttgcaggacaggcaaggacccagaccctcccttggtgatgtcaaggaggggaaatgagagaactgcaatagtcctcacaaatccatcctcccaccactgggccagaggaaagaggaggattcatcactccatctatcctctttttcctgggtcaggatagcctttgatctcctctttatttcagtgtctctgttagttccttggatctgtgcttccctctgcttctgaagtttccctgggttgaatttagaggatgaggagcacatgctaattcaccgtcttatcaggaaacagcaataacatttcagggttttttatttgtttgcttgtttgttgttcaatctattaaattgttggcaatacctaccctttctgctgtatgtttaattatgcttttcagtctattaatttatcattttcttattaatttatcatattctgataatggggtattaataccttgttctaaaattgtatacttattaatttccctttgatttttataagggatttgttgctatgttctttgaaccttatagacataatatcattatgctctcattattaaggcttttatcacataattaacagttagcttgctttaataacttttaccataattctaccttgtctgaaatctcacttgctttttttccctttaattagtagacctttttagtgatttttaaatttactttttagtgtttttatcctttttctaagcctttttaaagatttcccagtaaattattgcattattccagttggaagcatttttttcgtttttgtgttttattttttcttcctcaaaattgtttgagcttatacttattttaaccctagtccgcttaggtttatgttcttccattttactttttatctctcaatttttatagttaatttgtttttttttcccctagatgttctttggtattatatacacaattaatttgtttggtttgggttttgcttattttaatttcctttagcaactgtcttctttttaatttgattagctgtcaatttaagataaaccacaaagatttcattatcaaaatggtatctttgattctcttttatgggaaacttttgttctttttttgttcttccctactctgttactgcttccatttttcattgaattaacttgttgctcagtttatttattttaatctgcttttattctaacaattttcctaatgcccaactcctatcacaaacaattctttctattgtttttgtttacttatctcttcaataggtacatactaattcaagatttcatactatttttaatagcatcatcttttttcaggtctatcttttaagatcagatttctttttgtagtaacttttgaagtcagtgctggtccattagtgggtgaccaaatttcttaagactgaaaattcatgaacatctttacatttggataaaaacttgactgtataaagacagaaattatacagcttctttactctatggtatgtacatggttttttcattacaatgaagtccttgtctacttatgactatatcttttacatgaaatatgtaacctagctccttgcagaatgttttcttttccttttgtaattaaaataaaatatttgatgatacatgttgatttcagttatttttagtggatcttaaatagggctctgtttgtactttaacctttaactattttattaatggttacatttttcttctagtggatcttttctttttctaatcttcaatgttttattctttgtttgctcattcattccataaatctattcaaagcatctatttcatgcaagcaatgtgttcagttcattccttctctttctttaggaactcctatctcttccagagcactccattctccagatcttcttttgcatatttttatatctcttttcatgctctgcagattttttcctagttcattttctctttctctgttagttacctgtagcatccaattctacattttacctatactaccattgtttactccttcctgccccttcctgctgtaatgagctcttctgaaatagatataatgtctttcttccacatttaagaaatagtttataagtattttctaaatcctgttttgattcttgtttcatttcatggtttattgattcatacttcccatccccaccccaccctgcacccaggttcttaattcatctttcttctctcgtgcctgacaaacattttcaatggttccagtcatttattcccctttactcattcttccttgagtttctcatgatgatatggctgctatttctgaaacctttgcttcagactgttttattcacatttaaataggccttgaaattggaaggttcacaggctctcactcagacttcctcctggaggtccaaaaactttatttcttgagcacatcatgtcctaaataacacacacctgtattggattggccattcagaattagatattacattaaatattactttccttatatctatcaaggtaaagtcccattaccactgagaggggtaagttaatttattgataacttgcttgccatttactcctgctggttggcagtttaaagagcacatgcttcctgcatctcatttatgtagcttaagtagtcacctgttttgaactgatttgagagggaagactggattcattggcaagtcatggatcaattattatgtaagctctaatgctagcagtctcctagcaaaatggatgtgattaacatttaagcacgatgacaacccatgcatttttcatttactatttccttcaaacctatttgccagttcctctgctgtgattccaagaaatgcatactttaataataaagacttaacttttcctttgtatgaaaatattataaacaccaaaaagccttatgaaattataggagggggaatatcaaagaccattaacaacattatgtatggtcacccaggaatttgcacacaaaattctgccaaagctagtgtcatttatgtacttaagttttccaaacaacgagttgaaaaatataccctcaagaattgtttatgccaagaagggccaactatttataatcacaagtggagtttctgcaaaggtctctgccagccactacagtcctggcatacatccctcccaatctgcaaaaactctactgtttggggttgaaagtgaagcatgagtccaaagaaatacttgcagctttttcctagactcagttgaattcagagtgaaagaacatagaagacgacaaagggtataggaaatcgcagcataggcagccctgccttatttttagtgaaaaggattagtactggtagccctgcagtaaagctgatcgcctgtgatcagggagtaggatagttgtaatccctttactataccactgagttgattgattaaattgaaagttatgagtcaaatgcccccagagcatcttggaaccttcctgagtctgtgcatattcatatggtcctaatgaccttccactggaaggaaaaagtgtgtgctgcctgcagggaacacatgaagaaaggcttaggacgaagcaaaactttttcacaaccaccagcaagagtttaattaaactctgtctaacattataagcttgcctcaatttaagagcaaaatgtaccaggtttttcctgcacatggagcctcccagggtcttgcagctcaagtggaaagaacaatgaaaagcagaaggctttcattttacatctggctccttgaaatggggctaagaggctttctggagggttttgctggctgggacagttagtgtttacagatgtgagtggctttcagtcattgaatgtaaattgcatttgctttgttgcacacaccctgggaaaaccaagaggaagaagagaaataatgttcctttatccgcccacacacattgatattcaaggcacagtcttttcaggtttattgggtccctaagcaacctttgaagagatctgtacatctgtccggctgtccgtactccagcggacatggattcctttgctttgcttttcaagtctctggttccatctttggtccgttgactgaattttttggtaaacatttcttgcattcagacctgagtggccacccagctcctgggctaattctgcttctctcttaaaatttgatctgtattctgaaggcaagatcctcaggaaaaaaaaaaaaaaaaaaaaatgaaagagggctagcttttaatgtggaagctaaaagcctaagaagtaaactaaaataggaaggtgggagagagagcaagttcttgctgaaataccaaatccccaaaccagatcagagtaatgcgagagtggaaaggaagcctttctaaagtgagagaaactgtaatctaggtttcttttgcaccttgcagctccccagaaaagagtagccaatggtcagcactccgctgagaggcaatacatattgtatatagtttgaacaataatggactattgtgagtcagatccatctaggagtgttgaatctgagacttactagaggggcttatggaagctacttaacgtgtctgtgcctcagttttctcatctgtaaagcagggataatcaaatcacctatctcatgaagcagttttaaagacgacctaggttcaaagctaatctccaccatttactagctgtagcaccttgcagaagacactgacttacactgacctccagtctcctcagtaaaatcacagtctacatcactgtattgttgtagagttggatgagttaatattcttagaataggcttggaatatgatgaaagctcacaaagtgttcgtcattattattttaaaatgagacgatgtataaatggttcttagctcagaacaagaccaacagcaaggactgtgttagctatggctataatgtgcttatttctagccttgtcctgctacccacccaaattctcaacctctaaataaggatttagctctgatctcatgctgatatcttggataagtcttctcatctgattggcttccatcacctgatgagagtttgctgagattccaacctgactcctgaatttcttccatgtaccaagtggagagagggccaagttccaggtatattttgtcatccctaacttcacaaatatcactggaagtaaagggccccaagtttacacttgacagaccatttataaaagattttatactacaaggcctaaccagcaatgaggaaatagagttttcatttgtgactttttcccctatcagaaaggaatttaataacaaataaaatatatccatttcagcagccaaccagacaaacacatggaactaatcagctaattttaagttagtatttgatgaccttttttttttttgtaaataagaaaagagaagtcagtggagtttggaatttatgtgttctgtgatttctgttggccaaggtcagttttacttgatttctcttcccctctttgcctaccacccaacccccaggagcacataagcaattattaggtgggatctctctctatgtatcctaggggctgagcaacaagcagttagagaggaatcaaagctgggagaaggtaaggaaaccatttaattgttgagctgagtcctgggcagctccttctctttctgcctagtccagtcttacatggtcttcgtatttcagcctaaaccatcacttctttaaggaagctctccctgattccccacactggactggttctagttcttaaacactctttacaactctttgtgcccttccagctatctattgttctgtttatcattctgcacttgaactcctggtctcagtcaatcctcccacctcagtctcctaagaagccgggactacaggttcataccacgataaatagagcaacaagctctatttattgtttagtacagctgcttcaggtttccctagggttatgttcttcaggatattccatataatttaaagcttacagaaataagattaatactgaaaaaggattaagactaaatttttaaaccagctgtaaagtggtacagctgtgcaccaataacataaacacagcttaaaattcattcagtcaccagctttgaaactacggttcttgcaattttttaatttggggaaagagaatttgcattgttttgcacattttgtgcacagagtggctttactaatatttttaaatatttttatatgtctttattaatatttttatgtttctatgccttatgacatgtccatataggtccaaatcagactgctctgtaattatttgtttaattaaattaactggctcccccaataaaggataagttccaggaactgtaactaccctttgttcatttcattccacccagtgcctagcaaaatggtatgtggtagacactcaagaaacctggaagggatttagaagggtagaaactgacaccttctgagaataaaggaggaaaacttttttcttctctgtgggcaggaaggacagcatgttttccatctcaaagacaggaaagagttatctcttcctctgggatccatcagcatcctgcctactcctgcgtcacagcacagatcctaactggcaaaattattaatctctcttccactgaaatagatacatcagacagattcctttctgactgaaactgttctgctgtgaaagactaacaacaaagcagatgctccttcatgcctggccagttctatcagttatcctactggccatccagggtaggaagaagactaaagccttctaacacctgacatctcccaatccaggagagaataagaggaaattcccagttactgagaagtgaattgcagctcccctttttgaggatctaataccatcagccaccccatctccttatgggcccagaaacccatgatctcttattttatctcttcctttataagaattattgagtaattgctatgctgcctatactgtgtcagttgcacatcaattaaacaattgcctaattggactatacattctctaccctactcctggtaccaaaatctgtgttagagttctccagtgggacaaaaccaataagatatatgtatataaaagggagtttattggggagaattagctcacacaattacaagatgaagtcctatgataagctagctgcctgcaagctgggaaaagagagaagctggtagcctggcccagttcaagtctaaaagcctcaaaaccaggaaatctgatagtgcagccctcattctgaggtcaaaggcccaagggctcctggaaggccactggtgcaagttgcagagcccaaaggctgaagaacctgaggtctaatgtccaaaggcaggaggagaggacgagtcttcctctcccagtccactggctcaaatccagtccactggctcaaatgtcagtttcctctggcaacaccctcacagacacatccagaaacaatattttatcagccatctaggcattcttcaatccagtcaagttgacgtctaatattcactgtcacacctgccctaggctattgtttccctgagggcagagactatgttttgttcatgactgcatcactatctcccagcctatgcaaaacaaaatagacaactagaagtatcaaatgaatgacagataacagaatggatagatgaactgggattctggggttcactccatctcttgtagtaatatcaaggaaatgtcataaaagacagaatctaaaccttctttaaaatctatattagttaaatgcattatgcttcctttaatctataagggctgcaaaaatctctcatattaccctcaacccttgggcagcaatcattagtatcttcaagataccacatatattagaaataacacgggacaaactctctatatgatgaacacatccttttccttacctttcattttctgtgtcatctttgctttttccctgcattctatgattttatggcagactctcaagaaaggcattagagttggttgggactgttactatatccccagctccagcaccatatctgatatagagttagtgctgaatacatgttactcaacgaacttgctgcaagaagtcttcacttttaagagaatatttcaattacttaaaacgatcatagaagggaggaatatgtacgtactaacaatctaataaggttactcagaattgtatacacaaaactgctgaagctaacagcatttatatgcttaagttttccaaacaatgagttgaaaatataccctgaagaattgtttatgccaaataaggctgactattcatgatcatgactggaattgctgcatgttttgtgccagccacttcattcctgccaaacatcctcccaatttgcaaggattcttgggtttcgttttgaaaataaagcagtaaaatgcttcttaagctcaacttatgtggggtcttattcttcattagtacttacttaagctatactgattagagtaacatcttaactcttttgaaatgcttattttgattgacaaagtgacatggaatttctaaagtgacaaattgaccaaggagcacagaaacaagtcaatagaattgtgatgttagcttgagttctgaacactcaacacttggaaagaacctcataccaccttttgtgccagagacaccgagaacctgaaaggctgtcagtcagatatttctattagctgaagcaagaaaacttcctcatcctggtggctcctaggccaaaatttgcaggggaaaaaaaaaaaaaggaaaaagaaaaaagctggcagaccaaagccttacattgaccaaggtcttaaacacagcaactagagattatatgcttggaaaataatttataacaaacagcgcaaaagcactcctgataagtgagcctgctgaagacccttcagactcagtccagacctaggttctaaaccagtgagtctccttatttggaagaactgcacaagagtttagcaacccagcattgtaccaattctaacaagaccattacatctaaagctttattaagcatgtagactctgcagtcagaataaatcctgcctccaccacttattacctgcaagaggctaggcaagacatttaactcctctgtgccttggttttctcatatattaaatggggataataataatactaacttcataggactaatgtgaggatgaagttaattaatttatgtaaagcgctcagaagagcgcctagcatatattcagtgttatatacttggcagctattattatgaccctttttcatgatctatttcttgccttggaccccagttctcataactgggtcttaattttcatgcatgtgtcaattccatagatagttaaggactgcctgctatccagctgactctgtcctttataaaatggcctttttccccagcaagacccatataggagccctggctttgcccttccagggatgaagtcccttccttgctccttctaattcttccaagcactagaattctgccttttattgctgccagacctgcctgatgcccagtgtctctatcaccatctgctcctaatccctgatctcgcctaacaccaggggatttctggcctgcctgctcatcccaataccgatctttctgtctagtctttaacctcagctgcctggtctggtcttgattctgacagcacccttgaaatttgttcaagcaatgaataagttattcaaatcctttatttccctccaagggagaactaggaagccagaccttataaagccaaaggaattcctgttgcccccttactgcaataatttaatctctaagaaactcaaaaaagcactaaggaaataaccctctaatcataaacaatccctctccatcaagagaaaacagacctctcctgcctggaattgcttaaacaggagtcttccatttcaccagagctccagggacaaaccagccaccagctaccacaatgggctgcaagtttcagaaacttgcaaaggggaatttttcatcctgattattgcctttgcagtgttctcagctgccagcatgtgatggagggcgtgggtatgagcctgcttttgtgttcttaaataaggctaagaggctgttctccttcgcttcttagccctagacactcatcaatcaaccagatttcctgagtgcacctactatgtgcaggtctttggaaagcaagtcacctcctatgtactttttaaattttttttttttttttttttttttttttttttttttttttttttttttttttgagacggagtctcgctctgtcgcccaggctggagtgcagtggcgcgatctcggctcactgcaagctccgcctcccgggttcacgccattctcctgcctcagcctcccgcgtagctgggactacaggcgcccgccaccacgcccggctaatttttttgtgttttttagtagagacggggtttcactgtgttagccaggatggtctcgatctcctgacctcgtgatccgcccgcctcagcctcccaaagtgctgggattacaggcgtgagccaccgcgcctggccaaatttttatttaaatgtttctgcatacagagtgggtttatatgtgtatagggtacatgagatgttttgatacaggcatgcaatgtgaaataaacacatcatgggtaatggtgtacccatcccctcaagcatttatcctttgagttacaaacaatccaattacactttttaagttattaaatatttttaaatatacaattattgaccatagtcaccctattgtgctattaaatactaggtcttattcattctttctaatttttttgtacccactaaccatccccacttcccttctgtccccctactagccttcccagcctctggtaaccatccttcaactctatgtctatgagttcaagtgttttgatttttagtccttttgtactttaaaaaatattggagggaagctaataatcaaggcaaaacaaataaagttctgatgctgccaaagcagaagggactttcccaaggtcacagagttcaaaaggagcagatccaggatttaattacatcaccctgtgtaatacagattgtttgacacatctcactcagttcactggaacttggcctgttccagcttaatctcatgccctctgcaaatcatactcttggctccacatccgtccaggttcctagagagcagcctctcattctgatctccaggcctttgcacaggctgtttcctgtgattgccaccctccatccagcctctatttcttcacttgactgtttgcttgccaccctttcattctctgcattaaccccactgcctcagaaagccgtttccaattccccagtctgtattggcggccctcctcttttctgctctgtggctatcctatcacggcactttccacactgcactgtaattgcctgtcctcacgtttaatcccctaatatgctgagagaccctcaagggcaggacccttgtctggtttctctctgaatccccaggaccatatgtaggatttagagcacaaacgtgacagtgaatttttgttaaagtaaggtggaccaaactctctctttaccaagctgcctccctgacaggtcaaatcccagactaaaaatagtagctttgcaactcctggctaatggctccaggcaggcacttctgtcccagagcacctgacctctgatctgtaaaatgttctggggtaacatgtgtcctcccacctttgcctcttacaggctcactgatcatcactgtcatttccctgataccacccccattatgggagaaggaaactttcagttttcatccaatgcagctcaagcatagggtaggccagagtgagcctggagagacaagacaagaaaagtaactctgcttctgccgtcactcagttagtttttctttattaaaagggaactttttattgaagcataacatatacacagaaaagtgggtaaattgtaagtctatagctcaaagcttcacattcatgtgaacacgttcatttcaccagcacaaaactcttaaaatgactaggactccagaagcctccgttttgtccccatccagtcactactacatcttgacttctatcatagattaatttggcctgttttaaaacattttataaaaggaattttacaatatgtactcttttgtatctggcttcttttgtttatagtatatagttaactttatagttggtgagattcatccatgtggttgcatatcattttggtatatgttctttctcatagctgtataatattccattgcatgaatctaccgcttttcatttatctatcctattatggatgaacatttgggtagtttccagtttggggctgtaatgaacagtgctgctatatgctatatccattcatgtatatgtcttttgataaatatacatttgcctttctgttggttagatactagatgtggaattgctgggttgtaatgtaagtggcttagctttaataaatacagctaaacaattttccacaccaaaagagatctaattaatctacatccttgcccatacttgatattgttgatatggttttgttttgttttgtttttccactttaactactggatgtagtagtgatatcacgttgggattttgatttgtacttttttgaattttgcctagtgtgttgtcattgaccatttggataacctgaagtatttgttcagatgttttgatcgtttttctttttctattatattctctgccattttcttattgacttgtagtaattctttatatagtctagataaaagtcctttgtcaattatatgtattgcagacatcttctcccattctatggcttgcctttttacttttctaatcttttggtaaatagaggatttaatttaaatgtggtccacattatcttttttttgttcatgattagcaccttttttgctccatttaagaagtttttgcctacctcaaagtcgtgaagatgttctcttgtatttccttccaaaagcttcatagtttttatctttcatatctagatattgaactgatctgtaattgaatttgtgtatggtgtgaggtaggagtcaatagtctttctgaatttttttttacaggactattgattgaagtgtccatctttttcccacttcattacagcattacttttgtcatacatcaagtgactgtacatctgtgggtctgtttcaggactcttctgttcttctgttccattgctgtatttgtctgccctgcaaataatacactgtctttattatggttcctttacaaaaagctttgatatctgggagtgttctctgattttttttcttcttcaagattatttggctattcttggtcatttgcatttctgcataaatgttagaatcatgatcgatttatatttttaaaaaacctgttattgagactgtttttgaactcatagaaaaacgtggggagatttgacaactttacattattaaatctttcaatcaatgaccatattattccatttatttagttttactctaagttctctcaataatgttttatagctttctgtggataagaagtcttgttcactttttcatgagatttattcctgggtattatatgttttatgctattgtgaataataactttttaaaatttcattttccagttgtttgtcactggtatataggaataaaattgacttttgtattttgaattaattttcagagactttgctaaattcacttattgcttctattactttgtatatagattattttggaatttacgtacacaataagttatgccaataattcccttctaatctttatagcttctctttttccttcttgccttattgcactggctattacctctacgatgttaaatagaagtggcaataatggacattcttgacttgttcccaatctcatggggaaagcttttaatatccatcattaagtaagattattgctatggcttttttgtaaatatttttatcacattaagaaagtttccttctattattagtttgctgatatgttttcttatgtgaatgtatatcaaatataatcagatactttttctgtgttctatgaacatattcatgtaattttttctgttaatgtgatgaattgtattgattaaattttgaatgttagactacccttgtattcttggaataaaccctacattgttattatatagcatactttttctaatttactggatatagagtttgctaatattttggggttgctacatctatggtcatgaaagagattgggcttccatcttaacttttacctcaattttgagatggatttttttctacctgggctgacccctcttttgtcctatatatagacttagttaaatagactttgcttctattattagcttaacaaacttcacccagatcctctagtttatttcttattgacagaacaaaagctttctcaacgacaaactagtcatgagccaagtcatggtccaaccactccctggcagtgtgtccactgtcacattatagatcctccctgagcctgtttccttatcaatgaaatagcattgaaaaagaagttagacaatgcataataaagcacctggtacaggcaggtgctcagtaattcccatttctcactacctcttctcttctgcttaaaaacttttcaaatacagaagagcattggcttacttatttacagggcttagccatcagagttaagattgaaatctgaaaaaatgaactaatgggggtgggagatgtccattctttttgttatactctaaaaaacaaagcgaagttgtttactgctcctgctaagcttctttaaatacaagctcctagatttttaaaattagataaacattgctagaatttatcatctgtagtgctacagttccttccctggggcttcaaactcaagtgttagtggagtattacacatttggaagttgtccaggaatatagcctctctcccacatttaacaatgtttatgtgtaaaagtcagcttggaaggacacctttaaataatgctctttctggatatataattgcagtgttacttgtcagtgcataataaaccatcaaccagcctttattgtaccagtgggaatgagagtttgagggtgccctgaaattatgttctttgtgtctgagatgagaattaggttagtagctaggctttatttatagatatccaaataaatcaggagtcagaagttcagaaagactgggctgggaaggctgagtccaaagaaggctgaagtctatgaacaccaagagtcaatacccctaatgctatcaaggacactggataggtcccatcctacttctccccattatctccaccccaagaactaatcccggtgacaggcatgagtgacatcagaatgaccttctgactaaatctgaacttggctcaagctgtggatccccagtggagtagaaagggcaaggccttaaggttggcagatcaatggcaaatctcagccctgccacctacttgcaactcagttctctcaccataacatggggatggtaactgacctacctagcaagacaactgtgagaatggaagggtattagctgatacctgtgaaggacatgatgcagggaacatgctcaataataaatggcagtgattgtgatgatagtgatactgatgaggatgagacaatgacaatgaagacaacatctctagctttgaataaaggggtggtagaggattacctatattatgcttatggaaacaggaggagcatccctaactgccttttttctaatccccacaattattttatggatctctgggcccagacacatgatcttagttggacaagccatgtctcaatttgtgttctcctaaaagcaggatctgaggcaaggactgcaggtacttcgtgtagaaggtgatagaggaagcagaagtgaaggaatagggagagagtgacaagggaggaggaagggtcaaggtaagagtgcattattcaggtcactggcatcagcgtacctctgagaggtgtatagaatgagtccagaattgtccactttccagaattttctactagcacccaccccctattgaccaagggttgtctgcagtagtgtgaacttccccacactcccaggcacttgcttgctggctaaattgactctcaaagcttcagagaaggccatgagtcagtcaacaggaagaggcccttgaggtagacactcactgatagcattagcaagtgctcactgctgcctgccatagttgtggctgaaattggaggtggatggagagtctgtgatacagggcaccaaatgtagctgctgcaggccaagtcttagttcaagtgcagactcctcctgcaagctgtctacttgccacatgtgatacacaattgtgagagtcccccgtcgtcagtagagtctttcctctcccatccccttgtgacagaaaggactacctgcacagttggttcttatatttagcagtacacaaacgtacaccaaattctagagctgtactgtccagtacagtagccactcgatacacttaaattgattagtttatttaaattaaataaaatttaaaatttatctcctcagtcacactggccacatttaagtgctcagtggccacatatgagaagtggctaccatattggacagtgaagtatagtatacttccaacttcttggaaagttaaactggacagtgccactcttgagagagtcagtctggatcctaatcctggctctaccatatactagctgggtggccctgggtgagtcatttaatctgtctgtgctttaatttgctaatctgtaacatgagtttatttccatgattaaataacaatatgtaagcatatagtaaagtctcactacatgttaatgattattatttcccaattcccagggtaatatttatgcaaggcaggaagtacttaaagagcctccaaccctgattcaggccctgggtcccttgaggctactctctgggcttctaaattatctctgtgctcaatatggccatgcccatatacctcccagtctccaaacagggatgttgctttagccctcactgccttttcagcttgtcagttccccaccctaagtccagaggctggagctggaacagtcacccccagcttatgtcaggagccctactgcctgcttctggaaacttctgtctgtgtgcctgactcattctgtcaccattttcccaccacttgcccaccctcccaatgggcctctgcactcccaatgctgactatgacctgaactgaccacctcactttaaaatgcttgctgtcctctaagaccttgtcctaccctaatggacaggtcctgtgcatgtcctggtttgctaccaatttctatctttcctagagaaataaaatattaatatttaaaataaccattattgaatgttttcttgtgtgccaggaactgtgctaagggctgtaatatggatttccttccgtaaccccatcacaaccatagaagataggtactattattatttccatttcacaggtaagaaaactggatcttagagaatttacatagtttgttcaagattgcacagcaagtatatggtgaaaacaagaatgtgatgaaatccttaagccagtaggaggtccttttcttctttcaagacaattgaaaagaaggagggactgatgcatacaacaacatggataaatctcaaatgcatgatgctaagaagtcagactcaaaaggctacatactgtgggagaccacttatatcttggaaaacttaaaactatagggacagaaaacaaaccagaggttgccaagggctgggagtggtggtggggttgttacatgggaatgtgggtaggtaatacaactattcattatcttgattatagtagttactatgtagttgcctgcatttgtcaaaacttgctagactttacattaaaaggggtgaatattactgaattcaaagcatacttttatttttaaatggaaaataaagaagatagagagtaattttcctctgaatgccccccagcaattgttcaaatgtgggaatagaggggaacaaacatcagtttaaagatttggtggagaaaataagctcgggttcagattgcaaggaagataattcaaggagaggaaatggaagcagtgggttcagactgaccttcctgaaaagcctggaggtgcaggaaaggcaaaagatgggcttttgtgagaacaaagcattgatggaagatttttttttcacccagaatgagaaaacttgaacctctttacttaaagggagaagctcttcagtgaagaagagattaaaggtgcaccttacccacatatttcccatttccagcactctttattccttcatgtagatctgtatttccatctgttttcattttccttcagcctaaagaacttcctttaatatttcatatactgcagatgtgctaataataaattcacacagctttcatttatttaaaaaaacgttttatttttaccctcatttttgaaggatatctttgcaagacacagaattctaggctgacagtttttttttttaagctttaaagttgtcatttcattgtcttctagtttgccttgtttttgaagcaagtcatcattcttatctttgtttccctcattgtgtcttttatcgctttttgttgctttgaagattttctctttttctctagttattagattatgatgtgcttaggcatcattctctttgtttttattctgtttggggtttgttgatctgggatctataggttggtatttttcttcaaatttgggagaatttcaggcattgtctcttaaaatatttttttttatttatttatttattttgagatggagtcttgctctgtcgcccaggctggagtgcagtgcacgatctcggcccactgcaagctctacctcccaggttcataccattctcctgcctcagccgcctgagtaactgggactacaggcgcccgccaccaggcctggctacttttttgtatttttagtagagacagggtttcaccgtgttagccaggatggtcttgatctcctgacctcgtgatctgcccgcctcagcctcccaaagtgctgggattacaggcgtgagccactgtgcccggcctgtctcttcaaatatttttctaactcaatctatctattctctccttctggaactccaattaccactatgttaaaccacttgtttttattccacagtcatttataccctagttcatttttttcagcccatttttctctgtgcttcattttgaattgttttcatcaccctatcttttagttcactgatcttttcctttgctgtgttcaaatacagatattatatttttcacttctgaaatttccatcagagctttttaaaatagtttttatttatctaccaaaattccctatctgttcactcattatgtccatctttaaatccttgaacatattgataatagctgttttaaagttcttgtacgttagttccacatgtcagtcatctcaggaactcctgttattgactgtggggctttttcctgatttggggttacatttcctgcctttatactgctcttgtaattttttttttttttttttgagacaggatctccttctgtcacccaggctggaatagagtggcaatcatagctcacttcaaccttgaactcctggaccaagtgatcctcccacctcagcctctggagtatctgtgactacaggcaggcaccaccatgcccagctagtttttaaaaaaattttgtagagatgaggcctcactatgttgcccaggttgatctcaaactcctgtgctcaagtgatcctctcacctaggcctcccaaagtgctgggattacaggcatgagcaccatgcccagccatgtctagaaattttttattgcatgatggacattgtaaatactacattgttgagtgtctggattttttatcttcctttaaagagtatgacaaatggttaatttactgatggatctgcttcattcctttcccaggcctgttttctaagctgtgttggggtaagtctagagtagcctttactctagggctaatgtagttttgctactaaattgtagcctttctagggtttcagttgaacatatagtgttcagcaagttctctctaacatggatgggtagatattttatatctctagcattgtgtgacctctagaatctctattcagctcttagctccccaggggctgttctctgccaggccttgtaaagtgtcaccctgcacaagtgaagcttagtgtttggtcaaagatttaaggggacttctatgcatattctgaagttccatctccatgcagcttcctcctctctggcattctagcccataaatcctatctactttaattgccccaaattcttacctctacctcctcagctcagacagtttaccatggtcagttctactccaccttcctgcaccacaaacaagaaagtgtctgtggcagaaagcctgggcaaacacgggctcatctcttgtgtttcccttctgtcagtgatcatagtcctttgcggtctgttttccaacatccgaaaactggtgcttaatatattttgcccacttatagttatttatgtccagagggctaatgcagtgccacttacttaatcagagtcagaagcagaagtcaagtgagcatatgcagatctgggagttgtctatagacaggactatcttattctcttctctgcttcacattgccttaaagataaaatgtttctattaagacagtcatatcctatcatgatctgcctggctgactgatctcatcactgatcatccagtctttatacacacacactcacacacacacacacacgcacacactaccatgacctactcgtagtcttacacatatctctagctttttcttatgcctctgcttttgcatctattattttgtctacaaaaataaccttcccccaactccctacctgccttcctaactgctacttatccttcagaatttagctcacctgccatctcctccaggacacctcctctggaaccatctgggttaagtgcccccttatttgtgctgtgacattctgtgtttgcctttatcaaagttgtatcacccacgctttattgtaattgcctgttatgacctatcttccatgcccttcacaccccaccctccagacagaacatctctaagaccgggatcaagtctgagtcatctcagtgtctctatgacctggcacaggttttgaaactttttgtatgaagggccaaacagtaaatattttagagattgtaggccagacatcttcagctgtaactactcaactctgccgttgtagcatgaaagtggccataaacaatagataatacataaaatataagactttattgaaatagaaacaggcaactgtagcttactgatccttggactagcacatagtataatcccagtaaatattcattgaatgaattaataaaatattattattggaggcctcagaagaaatagaaaataatgtaatcaattttataagtgcaagagttttcctgggaacggaaaagtggcactttccttgaggccctagggaaggaaaaaaagacagtggagtgaagaaggcaggataatagaaaactgggggatttctggcctaaatgacagacttccccatgcatggcttttgccaggaggccattctgggatgggaacctgaaaaccagaatggtctggtcagagtgagttcccaaggcagccaagaacagagaatgccaaaggacaagtacaagctgtgtcctgggcagcacccaggcgcaaacccgcagaaggcatgttttgcagccaaattcaaagtgtcagaaaccaggcaggttctagaactgcatctagcatgaaaataacaagggcaagagggatgtgagatccaaaacaacttttatgaatacaactggcaggtccacaatacttttctgttggtcactggccacattgtgcatggatgagtctgtagatgggttaaccttggctttttcagaagagttaagtgaccagttcatctactaagaaataaaaggaggaggggagcctagaacttagaggctggaggagatctgtcatatataactactatagcagattccataagggcccaatcagggctcaaaacaaagatttgctgaaaagtactatgggtgaggctgaggttagacaacagaaggttgcagcaatctaatcactaaggttgtaggacattctgtagagaagcattatgaatgagtatcaaggaaatgaataggtggcttgctgcagaattgggattggcaggggaatgcagccactggccaggagatccagatagtcactgaatacctgttgtattagtcagggttctcctaagaaataaaatcaatagggtatgtggcggggcagggcggtggtgaagagatttataaggatgtggctaacctgagtacagaggctgagaagtcccaagacaatgcagttagcaagctggagtcctaggggaaccaatggtatagttccagtctcagtgtgaaggcctgggaaccaggattgttgatggttcagttccagtcctaaggccagtaggctgaagacccaggaaaagccagtgttttagtttaagtccaaaggcagggggaaaaaagcaaggttccagcttaaaggcagttaggcagaaggcatttcctcttcctccagggagagtctgccttttatgttctattcaggtcttcagctgactagatagggcccacccacaatagggagagcagtctgttttactctaccaattcaaatattcatccagaacaccctcatagacataactactttgatcaaatgtctgccctccccatagcccagtcaggttgacatataaaattaaccatcactctgccatgtgcagaacacctcagagaatctatctaccatgcaccctgtctccttcaacactagataaaatatcagacagaattatttgattagcactggtgttttaagcatcattgtgaatgctggcaatttagtaccaatgatgacagcagaaaggatgttaggaaagaggttactacacatatactcaaaattatctccctggagtagctttttagacaaatgcacctggttggccatcagtatctcaaacttacatgtctaattatttcttcctcccagcttccccccacctctgggcctcatctaagctattgggaataaataaataaacccagagaggctacttgaactctgctggaaccagtgagggacatgcaaaatcaaaaagccatgtccttacctgaaagccaaaaaggatagtgatagtctgccgcttccccctaggtctgagttcccagtgtttcaccaaagactccagaggctctgagttttcctttaaggccacaagctttaacctcgtctcctttttcccagccctcctgatacctgagtcttttctctctcctcctctatttactagaggatgtggggcccaggtgtaaactttctcgtgtcccagctaactgagatctgcttaaccacctcattctgcaggccccagatcagagtcccatttagatgattccttgactccttttttcagattcagatccttgcatgtgacattcctgtcatctccacacccctccccaatcacccaatcagattctctttggttaccatgccttacagaaatgtgtctgcattttccctgctctatttagatttaattttactagctaatatttattgaccctattttatgcgccagccactagtcactatttcatggacttcagccttggaacaacactaggaggctgatcatattactatccctattttacagatgaagaaactgagattgagagtgactaactgatgtgtttaatgtagaaagtttcagaaccaagactagaatatacatagatctgacctccgaaaaaaaaaaaaaaacccagttttaactactttaccaaaatgcctcccaaggactgttcagtcttctgtcttattgtctcacactcctggccccttgtccccattccccctaccactgccctaagtcagacactgcatgattcatgaagggaatgtcaaagggccttctatttggtctcctcaccttcagaccctctcccttcctatccctgggtatgtcctaccaaaggtatggtaccatgcagcagagaagagctggtctttggctctttgactcaactttgaatcccagtgtcataactcgcctgcctctgcatttttgggttaactgaatgagaatagcatctgtattaacagttttctttttgagcgtttaatgagataacataggtcgagaccttggcattgtgcctgacacatagtaaagtctcgtgtattagtccattttcacatgatataaagaactacctgagactctaatgtaaaaagaggtgtaattgactcacagttccgcatggctggggaggcctcaggaaacttacagtcatggcagaaggtgaaagacaagcaagcaccttcttcacaaggtggcaggagagagcaagagtaaaggggaaactgccacacacttttaagctatcatatataataagaactcactatcatgagaacagcataagggatatcacccccatgatccaatcacctctcaccaggtccctccctcgacatgtgggaattacaacttgagatgagatttgggtggagacacagagccaaaccatatcattctgtctctggaccctcccaaatctcatgtctttctcacatttcaaaacacaatcatgccttcccaacagtcccccaaagtctcaactcattccagcactaactcaaaagtccaagtccaaagtctcatctgagacaagggaagtcccttctgcctataagcctgtaaaatcaagagcaaattagttacttccaaggtaaaatgaggatacaggaattgggtagatgctcccattccaaatgggagaaattggccaaaacaaaggggctataggccccatgcaaatccaaaacccaaggcagtcattaaatcttaaagctccaaaataatctcctttgactctgtgtctcatatccaggccacgtcgatgtaagaggtgggctcccgaggccttgggcagctccacccctgaggctctgcagggtacagcccccgcggatgctttcacaaactggtgttgactgcccatagcttttccaggtacacagtgcaagctgtcagtgaatctaccattcaggggtctgaaggatgatgaccctcttctcatacctccactagacagtgtcccagtggggactctgtgtggtgagtcttcagccccacatttcccctctgcatggccctactagaggttctccatgagggctctgcccctgcagcaggcttctgcctggacatccaggcatttccatacatcctctgaaatctaggcagaggtccccaaacctcaattcttgccatctgtgtacccacagacccccaacaccacgtagaagcagccaaggcttggggcttgcaccctctaaagcaatggctcgagctgtaccttggcaccttttagccatggctggagcttgagcagctgggacagaaggcaccatgtcccaaggctgcacagaccagcagggccttgggcctggcccagaaaaccattttccctccttggtctcccagcctgtgatagcaggggctgctgtgaagatctctgaaatgcccttggagacattttccccattgtcttgactattaacatttggctttttacttatgcaaatttctcttgaatttctccccagaaaatgttttttttttcttaccacataggctgcaaattttccaaacttttatgccctgcttcccttttaaacataagttccaatttcagaccatctctttgtgaatgcatatgactatatgcttttagaatcaaccaggtcaaatcttaaatgctttgctacttagaaatttctgctgctagataccataaatcctctctttcaagttgaaagttccacagatctctagagcagaagaaaaatgctgccgctccctttgctaaagtgtagcaaatgtaacgtttactcccgttcccaagaagtttcttacttttatctgagaccacttcaacctggacttcattgtccatatcactatcaggattttggtcaaattcactcaacaaatctccaggaagttccaatctatcccacatcttcctgtcttcttgtgagccctccaaactgctccaacctctgcctgttacctgcttccaaagttgcttccacattttcaggtatctttatagcagtgccccactttgggtaccaattttctatattagtccattttcacactgctataaagaactacctgcgactcggtaatttataaataaaagaagtttaattgactaacagttcgacatggctggggaggcctcaggaaacttacaatcatggcagaaggtgaaggagaagcaggcgccttcttcacaaggcagcaggagacagcaagaatgaagggggtactgccacacactttcaaaccatcagatctcatgagaactcactcactatcatgagaacagcataagggaaactgctttcatgacctcccaccaaatctctcctgtgacatgtgggaattacaactcgggatgaaattcaggtcaatagtcaatagtcaaatagtcaatcatcaaatagtcaatcctcactataaccttatcctcatgttacatatgaagaaactgaggcccagagagcttaaggaatcagcccaagctcacagagcaaggaaggagcaaaactgaggttcaagcccaggtctgcctgactccagaacacatgttcatctccctacatcccactgtgaggtcatgatacagaagagatgattggatggactctggaaacaaagaaattagatgaaaaagaatttcagggctaggttgtggtgggtgctgagtgcccttggtggtaaatggcattggaaaagggggaaacatgatcaaaagttcctcctgcgaagaatgacataacaatagttaacatgtattaggctgatatggtttgtctctgtgttgtgtttgttctcaaacccccttataccagttattctgacattgtgcttacataatttagttaaatcttttgaaattgatgagatatgagtgagaaaaggaaggcattttttatggctgctctgaaaggactcaacagaggcaagttgtcaaaactattgtcaaatagtttaaattaaatcagataagtgtaccttcaatcagaaatataaatcatgccaataatttatcacccctgatttccagtttaggcttcttgaaaatgaatctgtacttaaagatacttgcagaaccttctgagtatagaactcctgagttttacaacttttcccaatcttttacagatatcttgctctcacctaattatatattattttcagcaacttgcctctgttgagtcctttcagagcagtcataaaaaatgccttccttttctcactcatatctcatcaatttcaaaagatttaactaaattatgtaagcacagtgtcagaataactggtataaggaggtttgagaacaaacacaacacagagccaaaccatatcagcttaatacatgttaactattgttatgtcattcttcgcaggaggaacttttgatcatgtttcccccttttccaatgccatttaccaccatcggcactcagcacccaccacaacctagccctgaagttctttttcatctaatttctttgtttctagagtccatccaatcgtctcttctgtatcatgacctcacagtgggatgtagggagatgaacgtgtgttctggagtcaggcagacctgggcttgaacctcagttttgctccttccttgctctgtgagcttgggctgattccttaagctctctgggcctcagtttcttcgtatgtaacatgaggataaggttatggtgaggattacacataggagatcatcatcctaacacctattagatgtttgagcctagcatctgtattgttcattgaatccctgctccgactagcctgccagtcctgcgcccggcaaactatccccttttctatctatttctttacatctctaggcaccctccttccaactggaaagttcccttgctccaccaccttcttttggattggtgcttcatatctgtaataatactgagagctttgttttgtacaactctttacagctttcacaattctttcgaaaactatctcaattaatttgtacaactctgggagattctccagcttggtaattattatttctatttcttaaagggaaactgaggctctgagagattgaatgactggtttgtggttataaatggggcctggagccagagtcttctggctcctggtcaccatgcctttcttccctgcaccattttgcacctgaatgactgctgctcacctgacatcaataccctttgtaatgttgcaaattgtttttccataggtgcctgtcttgtcccccgagggcagcgacatagtcttattccttccccctggccaagtgccttacaaatatctgttatttggttgatgtcattaaatgtgttaaaaatttgaattaggtcgggcgcagtggctcacgcctgtaatcccaacactgtgggaggccaaggcgggcaaatcacaaggtcaggagtttgagaccagcctggccaacatggtgaaaccccgtctctactaacaatacaaaaaattagctgggcgtggtggcggacgcctgtaatcccagctactagggaggctgaggcaagagaatcgcttgaacctgggaggcagaggttgcagtgagctgagattctgccactacactctagcccaggcaacagtacaagactccgtctcaaaaaaaaaaaaattgaattaatatgttatgttgtaaggccattgtaggaaactaacagctgtattggctaggaggttgaacttgtgtaattaaattttatttaagagagagaaccataaagataggtcccacgcttgaggtgcctgtttctctgcactcgtgcctttggactttgattccttggatctggggaatttggagttagctgctccatcctctgtgctctgcattcttgtgctataaaaaaccctgaccacagtggattgtaattaatccgcttatccatctgtttcccctgcccccagactgtgagtcccttcagggcaacaccatatccagtcctcctcagtgtccagggcccgccactgtgcttggcacataatggaagttacaagaataagccagaaaactccatctgggtccctcccctaatcccctaggattgtacatgttcccattatcttatcatacatatttcttatctcttatactgaattaaaggcaagtttcatgttttactcagttttgtagcctccctaccaaccatgaaaggaagaaactataattattgactgtctattgtgtgccagtagtgatttcaatatattatctcacttttaaataatttaatttaattctcataataggttgataaggtaggcattatcatccctgaattacaaacgagggaactgagactcagggaaataaagtaattgaatttaaccaagtttacaaagccagtaagtggtaatgctaggatttcagtccctgtctgctggctctaagaccaatgcctttcttttttgttgttgctttttgttttttaacagcacataggatactgccttagcctagcaggtgtcaggaactctgctgaaataagacttgaatttaatcacggtgaatcaaatctgtgcaagcctgttcccaactatgtcaagtgcatatactgctgccctcccatttgattgtttggatgaaatgcttctggaaacatatactgagcactaacaacacactaggcacagcactaggtgttgggctgaagtcaggctccctcaagaaacgttcagcctagtgagataacagactgtaagagtgataataaatgtgatttgtgctatggcaagacagaagacaaaagtttaggttggcttgtggtggtcttgagtaacttctgagtattttataaaggaggaatgggagttggctaagccaaacaagaggagagtacagagcaaagagcatatggtaattctgcactaaggtacagaattgcaggcaggacacgcctagaacaaggagtattttggtggagaagggcagggagagcaagagtttctgaagctgcttcactctgtgtccacatcacgaacctaaggccattactggttaccagccattgcccctacacaagtgtactttggctttgatgacggctaggactcttcacccaggaaatgagttagagaaacggctggcagcatctctatctgtctactctagggatatgagagatgaaggataaacatggggtctgcattttcccgatgtgtaggaaataatgaacaagcaattgggcaaacccgcatggtgatgtcctctgcctggggtgggccgtggctgccctcagcaggccaggaaggtgcggcctggctttacacctatgttcttgatgtggccctggagcagagggccatggggaagcgatgtgagctgtaaacagaaccaggccatgttcagaaccactttctttctttcttttttttttttttcttttttcaagagtgtttattaaaataggcagtaatggggtgaagagttctgcccactctgggccacaggatgggaaactgaaaatgttagttgggttcacccagttcaagttttcctctttgatatgcctgaaaatgttatttaacttgagactttgtttaaccaaccaaagaatggctgagaattgagccaactgtgtgatgaactaattatatgtaacttagtcaataataaatgtatatgcatctgtattcatcacatgtaaaaaacaaatccagtaaggtgctgatactatcagttccttcttcctccaggacttaaataaaatcctcaagtcaagttctgtcttgctccagcccagatcttactctgttttcccatgctgttgtgttgtgcattaattccctcccacatcccactgcagccaccatcccatgtgatcttcaccaaaccactgtggactggtcacttccacatatccaaactgtccatcacatcctttaaatatagctaacctgcctgccccttgtactgaaatgtacatagaagtcagctgaaatcaaccatgtttacttctaaggctggtccccacacatttcttttatcttttgctccttgcttacctctccagctctccactccaactgtgctctctccaatgcattcttcacactgctgtctggatgatttatctaaaattcaaatgcaattatatcactcctctgccagaacccttcagtggttctcagatcctttcaaatgacatccaaactcctgaagcatttagagcaaggccattcatgagccagcttcttcctacctccctggcatcatctcctaactttccccttgacagtttgtgacacagcaatgctgaattagttatgactctccaaacacacaatgttatttaatgtttctgagtctggtctatggctataccaccctgaatgcacccaatcttgtctgatctcagaagctaagcagggtcaagcctggttagcacttggatgggagtctgccagaacagtcctttctactctattttgccttacaaatatgatcagcctttaacgttctctcaactatccccttctctgagaccttcctagacagaacgcatctctgggctgcctctgcgtcttgttcaacatctgctgttgacctgtctgtacattcccaagacctatttgcttataggaactcagtcttatcactgaatggcacagggcctaagacagaataggtgcttagtcagtgctctttgaatcgatgtccaattacgcatcctccccatcatttaagggactcgtgtttcagccacagccatgctgataactgcctcctgattggctttcccaggtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacaggtaagacaaaaaaatcacagaatgaccaaataacagaaatgcagtcaaagcactccttagatatctttcccaggggcttgaaatttgcagtacaatgtggtggaagaaaatctatttgctgagtttgggggttttatgttaagtagaggacagacagaggcacaaatatccattttgttgtctcagattgtccctgactgcattcatgttttcttcagcctgtgctaaatgctgctgctgtggccatattgttgggatgccttgtctctagtctcctgagagtcaaagccatgaattaaggttttcttactgtgatctttgagagggtcagaggagtaatagtcaagctgtccagccaaatccccaaaataaatgtttgagtattggcacgtgctttttgcaactatgtcttgaggtacttgataaattagtcgttcgttcatcataatcattatggactgaggcatcttctgtgtcctatgctgtgtgggcccaggagcagtcccactctctaggccttcactgatacctctgtgagataagggagaaaaagtccataattcttatcaattcatttggctgacagtgccatcgtccttcatcaaaagcctaatcaggttgacaccagagagaggctaatgagagaaccttggaagaagagccacgtggctcagtggtggtttgctgcaagacatggcagtgcagctttagccatcactacccacaaaagcctgtccagcctgagagagcacatggcagcatgtcccactgcccaccaagtgctctggaggaagtaaggaaagagcaaagcatgcttgggatgtgatcattttacaacacaggtcactgagaggctgttgccctccctgtgctcctgtcccacatctcctgaaacaatgcaggaggctaagaaaacaccagggaccccatctcacagtctgcatgtgcccagaggcctgagcagcacagcagggcaagcacagctgaggcccgcagtgttccccaccatctggactccaagctgcccacagaccctaaattggaggcaacaaaggtcactctgactcctgctataaatcccctgaggaatcagtttggactagagtcgaaaaatgccccagaatgagcttatgtttcttattaatttgatttgaagtctttcctcctttcttggaaaaaaagatgtttgaccagatgttttaagagtgcatgctattcatccaagatgagctatctaactatgctctgtttctctgactctggctgccatgcctcataattggcatcactccttcagactatggcaaagtcatgcagggctctatattggtgctagtctgtctggcctatcatgggggaaccattgtttgggatcctggaggttcacattcccagttctcaagtatggaattatgcctccctgatttgtcaagctccatggtgtggaatcttgaaaaccttttgttacaaatagtagttgaaatactaaagtttgccagttaattacatcagggtcaagggcatcttcataataatgtcagtctcacttgttggctttcttgagaggtttctggaaaagaaagaatcctgcaggaatcatacataactggaactatattgtgctggtgaacattatctgacatgtcatagcaataaaaagattgaaaactcatggatgggaccccccaccaccaccactgccagcctcagaatccctcttaggaaaaagttctttggtatgttcctaatcagcatggctgtgattggcttgtattaccacacaggcaatgtctgtctgcctatcccagctggctagtgtttcagacaaacagtcgtaataataagtttaattatgggtaccgcacatgggaatgaacatatctcagtgcctgtcaccacctttcaggccccctgggtgctggatatctacttttcgcccccctcacatctaggctgaggatgctattattatcccagttttacagataaggaaaccaaggcatggtcaacagcagagaataccaggacttaaacctaagtctgtctggctccaaagcccagacagtactagacatataatctgctccgtgtaaacctgaggccacttgtttgaaacttgttgagaatctcaagatggcagtaccgtgaatttcatagcatggggtcctgtgagcctgcatgggtcacctgcccctgaagccaggcctacctgtataatttccctgtcccacacagctgccccacagagaaattcctcttgccagcctctgaatctggcctctgctaacagtgcctcaggttccccagctcctgggaaagtcagttggatagggtgatttcaggattccaaataactcatctttctaaatattgttccccgcaagcacacaattgatttatttttttgtaagtcaggtaagaaacaacattaaaataagcaagaatatgaatcctcctagaatacaaaagtgtcctctgaataaccagaaacttgtttgaaaacatctgcaaactaacacagtgttctcgggctttaatactttatatcctaccaatcactttgtcaaagaacctgagtccagccatgatgaaaataaaaagccctcttttctcaagaaagacatttatatgcttaccagcattctcttattataaacttacggctcactgcaagtttcaagggcatgaagaatcacaatagatattcttggaggtaaattttatgctaatggctttcaagcacaaatgaacaaaaatactaatcctattaatagtggaagtattaataataataacagtatattaataataatactgttgagtataaattttaatgttactataactgcaaaacaccaagaaaattaatgaaaaattacagcagaattattggcagtagtgacactagtggctggggctggggaaggccacaatgctcaccctttcgtggaaggacaaaggcaaatgtgtcctggtggccaggacacctggggactgggaattagaaatactgagctatggctagcctggcaggtcacaaatgggtaatccaaggcaggcgggggctgtaggaaatggtagatcacacttgtaggttggtgtgggagtggaaagtgagcttatgaatactcgttatgaaaacacttcatcccactaagaccatttctacttcagtaagcccatatttctggcatgtttactaagtgtctggttctctgctggatgctggcccaaagatgatgcccctttcactcggttattcaggctagaatccttgatctctccacacccaaacttgtgccttctcttttaaattcatccagttcaatctgccctcatcaccacctccctccacttatctcttgcctaaattgctgcactagcctcctgatgcccctgcctctgattctcctcctgttgcccatgctgccccagggccatctttataaaaaacaaatcagatcatgccactcccccacttaaaatgtttaatagcttctccttgaccctaagataaagtccaaattccttatcaaagcctgaataccctttatgtcctgcccttgtcttacctctccaattttatttcttgctgcaaatctaagttttgggcatacagaacctctttcagtctatgcacaagggccatgcccttcttgtctctggaccttctctcagccagacatcttccagcagccttctaactggtgaactcctattcatcccttaggacttagcttagatgttgcctcttccaggaggctttccctgattctgtactaaattgatcttgccaggtgctctcccagcactttgtccttctcctattgttagcatcatcacacttacatatttctttgatgtctctccctcactaaacaacaaggtttaaagctgccgttcccactattatatcccctgagcttggcatagtattggatgcttcctaaatgtttcttgaatatatagtttgttcattcaataactttataaatatttattgaacttattagtttattcatttggtaattttactgaacacctactatatgctaggcattggagatgcagcagtaattaagaaaactcctttccttcatgagcctacatcctaacagtggagaaaaggaaaacatgtaaaatatatatatatatatttaagtgaaaagaaaccaacaagggtggtagtgacataaagaggattaggagtagggaggggcctgttttagataaaccggtcagggaaagtctccctaacaaatgaccatgaagcagaaacccaaaagacaagtgtaggggaaaatcattttagatgctaacaacagcacatgcaaagggcctgtgggagaacataacttattgtgcttagaactaaaaaaagactagtgtgacacaaggatagtgaggggattgtggcacaaaaggaggctggagagttgaatgccggaccactttgtctctactcagacgaaattaacaaagtgggagaggcacatacatgactatttccatagaaggtacttattccttaggggaatctgtgcatccattggggaaatgtggacacacatttgggcagggccttgttgggtttcctctctgctggagtctccttttccaatccacgtctgcttctttccactattctagtccttcattagggctacttttatgtcttcaataattttaaatatgtctaattgtctctttcagattattctattttctcataatcttagagactatttttccttttcattgaacttgctctctcagtgacattagtttcttctttggttttaaattgtttgatcatcttcagtggtatttgttttgtttttttgagatggaatttcactcttgtcaccctggctggagtgcagtggtgcaatcttagctcactgcaacctccgcctcctgggttcaagcgattctcctgcctcagcctcctgagtagctgggattacaggcgcctgccatcatgcccagctaatttttgtatttttagtagagacggggttttaccatgctggtcaggctggtctcgaaatcctgacctcaggtgatccacccaccttggcctcccaaagtgctaggattacaggcgtgagccaccacacttggcctcagtagttttttttctttttcttttttttcctgttggaggaaaaaaggttcaagtgatggtgtctttacagtgactttgtattttcttctcctggtcccacccaagtttttatgtcctttctcagattggaattgcccactgcacagctagtatacgtctggaccctgcactaacacatgagagcaattgggagttccatttcttggaggtgtcttgggcagaaacaaccttccttgccatgttcccgaatgcttgatggagggttttctcatgccctattcacaaacagggcagccctttaaaacatccactgtatgcaggcgtgccccccccatgccccacttctcactggctcaagatttccccttctctccatgcatgggcttctaaacccccgcctccagctcctggggcctgtatcccagtccagggccccaacagctcaccacgcactagctcctgcttactgttctgagttagactttcctccctatttctggcatctgggcagtttttctaaacttgtttacatatttttgtaatgtgttttgttatatttgtccagcatttctatctgtttgtagaaggagagagaactttttgtgtcagttcagttttccacattttcaggtatccagctaatatctgtagcacctaacaaatatctgaattgatgacaagcaagccatgaatggttcttgcataaaactctgagctttgaagagtcacccatttattaaaaatccattagaaaaatcattccaacttttatatttctctggattcaaggctttcctgaccataagaggtcagataatggtggaccctaatacaggcattgattatttcaccttcaggagaccttgttttggaggatgacttgaaccagcccacaggattatcacaccgcctgtggcatgagaagcaatagacaagcagatgttctttttctttaaagttgaaacagtttatatggctccaggaactggaagaaaaggtttgagaattttcttttctcatctcctttaaatcattggagatgacatatgtctactaaactattgtttttttctgatttttgattttctaaatttttaatcacttttctttaattaaagccatggcctgacttcaagtgttctctatgattcatgacatgctgcctcatccggtttggaaaaaccacacacaaacacacacacaccccaccagcttttatttataataataaagctccagtgatcttccatgcttatgagaagtagtgatgtataatgtctaaaagcattgcctctgaatcaagatttcctgagttcaaatcctggctccatcccctgccaactatgtgactttgggcaagttacttaacccctctgtgtctcagttctctcttctatgagatgaaaatggcgattgtgccaacctcatagagtcattctgaggactaagtgagctgataagtgtaaagtacttggagcagagcctgcccttagaaagagattgctggatgttagctatcattaccatgttttcattcttcagcctctgtttccttatcagtaaaatgaggggtttgtcctaagaccccctgcaggactagaaaatttaatgttcaagttcgtgtcatttctcagtgtgaaaaggtccagaggatgaggccacaactcctttaccatctacttcaactacttcagcatccccaggcactgcccaagcctgcccctcctatccccacttgacagtgtcatctcccaatttgccctaacattttttcccaaagttgatcataagcaattaagggtataaattaagccttcaaatatagaaagagctacagtaaaactccacgcccattcccaactcactgctttgcacatgctccctcccttccttggaacagcctcatcaggatgctcgctggagctagttcgatgccacctccagaacagccctagaggcagccatggagcacatcttcctgaatgtagcaagacacaagccaaggggcagaaatgtggctcccaacctaaggagagaggtggtttagtgaagtctagtttgattgtaacaggaacccactgaaactaacttaagaacaaaggaaactttattgtagaaagaaagtaggacacatgagaacacaagtttgtgcagagtacaaaaaccctcacgaaagctggaattggaaggcatcaggctgagacgaccactaactctctctccctcctccacactgcccccagtgtcaggtggtcttttccatgcccttccatgcaaatctctccccgactatttctcaacagagctgctgcctctgcttacttgggttgcacatggccccaaatggtagccataggatcttcctccttggcttctcacagctagctgagcagttttggtgactcttagtgaagcaccagaaaaacaggttgatcactggatagcctgggcaatggtgccccctgcatcagatatctacccttactccaatccagtggccacctctgtgtaaagaaccatccggcctgttattatatccagtggctgtgggcagggcagtttatactaagaagggaactgaaggcctgggtgtggtggctcatgcctgtaatcccagtattttgggaggctgaggtgggcagatcacttgagctcaggagttcaagaccagcctgggcaacacagtgagcccttatctctacaagaaataccaaaaattagccaggcatggaggtgcacgtctgtagtcccagcagttgggggactgaggtggaaggatcacttggcccaggaggcagaggctttagtgagccacgatcacaccactgcactccagcctgggcgacagagtcagaccctgtttccaaaaaaaaaaaaagggcaggggaaactgaaggtagaagataaatttatatttcagggcagcagtggatgggcaagaattagactgagttgcagggccctagccaaaggacaggagctcagggcaggatttcagtcctgtagaagagaggggcactgaagagagaagaagttcaggagcactaaagaaagaagagggaagatcagcagaaacccagagttcagagctgcaccaattgggtgacaaaatgctgggtctagagtttggtttagcaattgaggtgggatcaagggacattactaggcctaaacacaaggatatggaaaggcagaggtcagagaaagagtatggggccccaaagcactgttaaggccacttatttacccttgccacctgctgccttgcattgttacttaagaaccatgaaaacagtagagaacctgtacttcttaagtctctgacctcgagtaggtcacctaagctcactgagccttagattttacatttgaaaaacaataacaagaatatgaattacctctgttggttatgaaataatacgtgtacaaagcatggcttggagtatgagctcattattactcttattattgcaacaaaaaaattaaattggaaggacttagaacccttttttccttccatcttctaaaagggtatttcggttttactgggtgggaatacaatggaaagaagacataaattgggctaggtagaatctactagagcataaagacaaggaaaagggagaaagaaagatccaaagaagacttttagaccaggcgtggtggctcacacctgtaatcccagcattttgggaggccaaggcaggcagatcacttgagttcaggagttcgagaccaatctggccaacatggtgaaaccctgtctctactaaaaatacaaaaattagccaggcgtggcggcaggcacctgtaatcccagctactcaggaggctgaggcaggagaatcacttgaacctgggaggcagaggttgcagtgagctgagattgtgccactgcactctagcctgggtgaccgagtgagtgagactccatctccaataataataataataataataataataataataatgaaaaataaaaagtaaaaacccaaagaagactttgagtaaatttgatttctaaaagaggaaacttcaaaagagaacttttagcagtatactttgcagaatattgtgtgatgtcattttccctttgctgccttctcaagaaaacttcagcaaagacctctaatactttttcaaggcttctgggagtcagattgggtctgtttttttaggtgtgtcaccctgctgcaaatggcccccaagggtgcccaaccttatttgggttacattgatgacacacacctcctttgttctcccctacctcattcaaggcttaattccatgtagtatgggtaagtgggcacttgtggttggtagaaataaaatgacactcagagtggtgatagggtaaggagtcaaataaagattctgtcacagatactcgatacagaaattaagacattgtttgaaaggtatgatttgagtcatatgaaacctcttgtttgctttcagttgagtcttcaaacaaatccagattacagtaggacaagctgccagagtgatttcgtgatgcctgttctttaataaaactggcacaggctgcctttgctggaagggtatagagctggcctcttagcattacttcttaacctctacagttttataagacagcatcatgatccctgggaatttttctgagaatctctgtatgagagaaatgtgggacagtcttattcaagacttacagaatatttgactcactaaaatatctatttttacagtaactgagccaaaatattgcaaatagaaggcaaatttaagtgagagatcattaatatattaccttaagatttagaagacaatttagcaatatctatcaaaattatacgttttcttttttctattgtagtaaaagaaaacacataatatttaccatctgaaccatttttaagtgcacagttcaggagtgttaggtatattcacattgttgtgtgtatattttccttatacatcaacataataaaataattctatatctaggaatatgtctttctgaaatagtcttgtgcaaaagtatatgaggaagaatattcattatagtattttatttttaagagatggaacaagcaaactttcatcaataggggtcatattagaaactctggatgcatttaacgggtcaaataccatgcagctattaaaaagaataaggcagatttgtgtgtactgatacagaatgctccctggtgtatatagttagatgggaaaaaagcagaacagtgtgtatagcttgattccatatatgaaaaatggcaggttagagtgaaatgattatattcatgtataggattatatatgcatagaatatctctatgaacatacaccagaaactccttgcctctagagcacacagagagtaaggggcagaactgaaaggttcattcacattttgccatacggcctcttgtattgcttgaattttaccatgaacacaaattactatactttttttttttttttttgagacagagtctctgtctgttgcccaggctggagtgcagtggcaccgtgttggctcactgcaacctccatctctcaggttcaagcaattctcctgcctcagcttcccgagtagctgggattacaggtgcccaccaccatgcccggctaatttttacatttttagtagagacggggtttcaccatgttggccaggctggtctcgaactcctgacctcaggtgatccacctgccttggcctcccaaagttctgggattacaggcgtgagccaccacacctggcctactgtacctttttaaaagaataatatttaaatgaacaaagaaaacttggataagaaaccaaatattccccccaaaaaaaatactgcataacttaatctgtaaatttaaagtgttccctcaaaaatcccagataattttttaaaaattatacaggctgacgctatagaaatagaaaactaaacagtcaacaatagtcagaaaatgtttgaaaaagcatataatgaagggaagactggctaaaccagatataaaaacgttataaaacaacattaactaaaactgtgtgaagctagagagtgaatacacagatcaatagaatctaatagaaagtccagaaatagacacaaattctttgtaagttaagtatatgaaaaaagtataattttatatcagttggaaaaacactagatccttcaataagtggtaatggcacaactggaagccatctggaaaaaatatttttcttcataccttaatcctggaaccaatacaagctccaaatatatcaaaaatttaaatatttttaaatgaaaacataaaaacgttagaagaaaacatgaaagaaccttttttttttttttttttttttttttttttgagacggagtcttgctctgttgcccaggctggagtgcagtggtgcgatcttggctcactgcagcctccacctcccgggttcaagcaattctcctgtctcagcctcctgagtagccgggactataggcacctgccaccatgcctggctaatttttgtatttttttttagtagagacagggtttcaccttgttggtcaggctggtctcaaactcctgacctcaggtgatccacctgccttggcctcccaaagtgctgggattacaggcgtgagtcactgcgcctggctggaaccatttttataacctagaacaaagcttcttccaagcacatcacaaaacccggagatcataaaaggttaatgaagtaaactaaaaacatttctttttttgagatggagtctcactctattgcccaggctagagtgcagtggcacaaacttggctcactgcaacctctgcctccaagtttcaagtgattctcctgcttcagcctcccaagtagcttggattacaggcacccaccaccagcctggctaatttttatagttttagtagagatgggctttcaccatgttggccaggctggtctcgaactcccgaactcaactgatctgcctgccttggcctcccaaagtgctggtattataggcatgagccaccacggctggcccaaaacattttttaagtagtggaaaatactaagactttttttttttttgagaggagtctcgctaaacaaagggctaatttttttttgatatataaagagcttcttatggtcagtttttaaaagaccaacaaaccaatagatcaaaacacatggacaggtctcagaaaaggaaaatgagatggcttttagatattataaatgatgttcaacttcatttacaatcatagaaatacaaattagtttcacagagctacaatttttgatctgttagacttttgacaactatattgtcagaggtgtagggaaacacctttctacactggagagcgctttcttctgactcagcagttcagtcagaaatttatatacacagatatactcacatttaggcacattctatttattggacattgtaacacaagagtggaataaattaaatatccatgaataggggaccagttaaataaatatgagattttgatattaaacatttccaagacaaattgtttcattaaaaaagaaaatgcagcagggtactcatgattggtcccatttgtgctatctttctaaagatgtgtacttacgtctcttgaagggtatataagaatattaatagtggttgcctctggggtggagagttaagagattgcggaaaacgaagagagggacctttcactgtattccctttggtgcctttggaatgtggtaccatgtttttgtgctatctattcaaaaagtaattattttatagttgaaataaaaaaaaataagccaaccaaccaacaaacacccaagcttaggaacatttaaacgatgctgtatctgaaagcacattgtggggtcttggtagatcgttctcctcctggtgaccaagagagctacagtccacctgttattttaggtgagaaaactgaggctcagaaaatatacttcacatgtccaaatgctagtggcaacacaggacttttgacttccctcctggtacttttttctgtctctgctaaaagagaagagacataggcagccctgaaaacgtcactctggtgtatgtactcctccagtgtactgaaacatttacttttcaccagattgtgtctctgagacagtttagagctggacttttcaatgaatacttgccatctagtggtaaaaaaagatgtgtgcacctaacatagactgcattcattcattcattcatgcatcaaacaccatacagtcatgcactgcataacatttcagtcaacgacagactgcatccatgacagtggtcccttaagattataatggagctaaaaattcccattgcctagtattcactatactgtaatttctatcattattttagagggtactcctacttattttttttaagttagctataaaacagcctcaggcaagtccttcacaggtattccaaaggaaggcattgttatcctagaagctgaaagtgatgagttactgcccccgaggaccttccagtgggacaaggtgtggaagtagaagtcaatgatgttgatgatcctgaccctgtaaaggcttaagcacattttttaaaatgtgtgtgtttacatcttagcttttaacaaaaaagtttaaaaagttaaaaaaagaattaaaaaggcctgtagaataaggatataaagaatgaaaacattcttgtacaacatgcactgtgttgttgttttaagctaagtattattacagtcgttaaaaaggtaaaaaaaagtgtataaagtaaaaagttagaataagctaaggttaatttattattgaagaaaagtgtttttataaatttagtgtagcctaagtgtacagtgtttattaagtctacagtagtgtgcagtaatgtcctaggccttcacattcactcaccactcactgactgacacagagtaacttccagtcctgcaagctccatacaggtgtaccatttgttatcttttataccttattttaatggtaccttgatatgtttaaatatacaaatacttaccattgcattacaattgcctatggtattcagtacagccacatgctgtacaggtttatagcctaaaaacaataggctataccatatagcctaggtgtgtagtaggctagaccctccaagtttgtgtaagtaccctctatgatgtttgcacaatgaagaaattgcctaatgacacatttctcagagcatatccccgttgttaagtgaggcatgactgggaaatcacttgtccttaaggcactcctagtctcttgggaaagactgacagaaaaacaggtgattacaccagtatgatgaagagacaactgcactcccatgtttattgcggcattattcacaatagccaagatatggaatcaacataagtgtccatcaacaaatcaatgaataaagaaaaattggtgtatatacacaatagaatactatctagccataaaaaagaatgaaatgccatcatttgaggcaatgtagatgagcttggttgacattttgttaagtgataataagccaggcatggaaagataaatatcacatgctctcactcatatgtgggagctgaaaaagttgatctcataatagtggagtgtggaatagtggttactggagactgggagtcaggggatggtgagaggttagttaacggatgcaagattgcaactagatagaaggaataagttccaatgtcactggagcatgactgtaattaacaacaatctacagtatgttttcaaatatagctagaagagcagattttgaatgttctcaacgcaaagaaacaataaatgaggtgatatgcatgcaaattaccctttgattattttacattgtgtacatgtatcaaaatatcacactataccctgtaaatatgtacaaaactatgtgtcaactaaaaataataataaaagataaaagaatagaaaaatggggaacaaaaagacccatggtgagcgtgaaactaaaaaaatagaatagaaaatgtctcattaatgttttcgttatattgattacctgctgaaatggtaatcatttgtgaaaaagaaaaataggtgattccactacagtgcaactaaggctaggaaagtcaagtacaggacacagggagcacagtgtagggcttaaccttgccttgggaaattgcaggtatcaggagcaacactgaactcacttttctggattctcagtagatgctaaaattacctcctttcttgtcttcctcttgctggaccccatcaggaccaggatagcagtttttgttgttacgttctctgtgtctgaggatggactcattaactgatcatgttaggaaggcagccagtgtatgccctttggctacatggagtagctgttccaagagctgaatccgtgccaccgttgcatctggtctgcagatctgttttccaaagagccatatgcgaatgcattgttcatttcccacctctggtcagaacatctgtggaatgtccctcctgcccatgtagtttttcagctctgttatcctgaagctctttcaaaggttagcctttcattctccaagcaaacaagttcttgtagcccatagaagatgtcctccatagaaaccaaagcagtccacccagcttgcctagaatgaaaggtgcctaaagtggtagggggtggacctgcaaagaaaggtggagtcctttcataaatgaacttaaataccaggctggagagatgcagagattacaagtagacctaaagtaattaggaagccattgagggtttctgagcaaggaagcgaccagagaccaacgtatttgttcattcaacaaataattgtcaacatctactgtgtgcaaagctctgagtgagaccctgtgctacagaccccagcacagagatgaataagacccagggtgggagacatgtcatcctcctgggttataatgccttctacctccatgcaacagcttaaattttttgtctcagagaaggaaagaaatgtcagagcataagaaattagtgacagaaattataaactataaatcacagttctaattgttctataatcatgtaaacatagcaatttttctttaacatagaaatatacaaatcaaagataaaacaggagccccatctcatggagagatagtctgctgcctcttcagattctacctcaacattataacatgtccttttgacactgtggagccaataaggtttccatccctagaagacctttctctcccaatctgtatccatcagaattccactcaaccttccataccctccttgccagaatacctttccaactccttccaaatgcatgtcatttctgcctccttggatcttccagaccatattgtaaccccatttggcccagttcctgccttgtattatgggtgtctgctcctaaaaacaaaagtaggagtcagtctgagctggggtgtagtctggaatcacccctccatctccctagtcatgcttttcatatgtctcatagtacattgagaagtgtctgttgaattgagttgaatgctttagacctcggttcactgacagagggactcctttagcaaagttagccattttacctcctttgtctccatagctacttccagttctccaaactacaacctatttcccaacagactccagttacagtacttcttaatttatcttctattcaaaggcaaaactactgcttcattaatcaatgagtaaggaaaatcaaaagcttattaactagcaagccaatgctcttctaaagggcattgatccatgtatgttatgggcagcctgttcattgatagctacagctcttggagagcagctctctggagtagcattggggaaactgaaatcttattttgaaatagcttttaaatgcatggaaacacatctgattcttactgggaatttcttgatagggaatacagaagggaagactatttgcttgtcagtaatatgatatagagacaaatcatttcataggatttcataagtgcatatatgtaaccaagaaacacaggtactttcatattatcttgagaaaaatgaattcattctttaaaatgcaatgacttccctgcataatgcattcaagaatcaatgcaaatataaaggatgtgtttattggcttgtgatctgtattcatgactgcaagcatggttggatcttttgagatgggggtttcctctgtttcagtggccaagggatattctttctcaaatggacatggtgatcatttgaaacttatcccatgcatagtgaccccaaattcgagtaaatatatatcaagtacatataatacacaaagaagtgagtctgaagtcaacctccaagcactccaaattagggccctaagacaactgcagaatttgttgcagggcagatgtatggcctggtttagaactttattattttgacctccattcgcatgttagttttacttcttcttctatcttcaatcttttacaacatacatcctttacttattagattctaatatattagcatttaacatacttttactatttcttggacaatggaaaaaccttagaacactgtaattccctttagcccatgtattagtctgctctcacattgctataaagaactacctgagacttggtaacttataaagaaaataggtttaattggctcatggttccacaggctgtaaaggaaacatggctgtggagacctcaggaagcttgcaatcatggcagaaggtgaaggggaagccagcatgtcctataaggctggagcaggaggaagagagcagggagggccacacacttttaaacaaccaaatctctgagcactcactcactatcacaaggacagcaagaggaaagtccacccaatgattcaatcacctcccaccagaccccttctccaacactgaggattacaattcaacatgagattcatgtggggacacagagccaaaccatatcattctgcccctggccccttcgaaatctcatgtccttctcacatttcaaaacacagtcatgccttcccaacagtctcccaaagtcttaactcattccagattaattcaaatgcccaaatcccaagtctcatctgagacaaggcaagtccattctgcctatgagtgtgtaaaataaaaaaacaagttagctacttccaagatacaatgagggtaaaggcattgggtaaatgcttctgttccaaaagggataaattggcaaaaaataaaggggttacaggcgctatgcaagtttgaaacccaacagggcagtcattaaatctcaaagctccaaaataatctccttagactccatgtctcacatccaggccatactgatgcaaatgatgggctctcaaggccttgggcagctccacttctgtggctatgcagggtatagcccctgcagctgttttcacagactggcatcaagtgcctgcagcttttccaggcacatggtgcaagctgttggtagatctaccattctggggtctggagaatggtgaccctcttctcacagctccactaggcagtgccccagtaaggatactgtgtgggggctccaaccccacatttcccctctgcactgtcatagtagaggttctccatgagggctccatccctgcagcagacttctgccatgacatacaggtgtttccatacatcctctggaatatatgtcagcctcaacttttgccacctgcacactcacaggcttaacactgtgtggaagccttggtggcttccagcttgcaccctctggagctgtgacctgagacatatcttggccccgcttagccatggctggagctagagaggctaggatgcagggcatcatgtcccagggctgcacaaggcagtgggaccctgtgcctggcccacaaaaccatttttccctcttgggactctgggcctgtgatgggacaggctgctgtgaaggtttctgaaatgccttacaggcatttttcccattgtcttggctactaacatttggcttctctttacttaggcaaatttctgcagcaggcttgaattcttccccagaaaatgggtttttcttttctaccacatggccaggctgcaagttttccaaacttttatgctgtacttcccttttaagtataagttttagtgtcaggtcatttctttgtttatgcaggttagtgtaggcttttagaagcagccaggccacatcttggatgctttgctacttagaaatttctaaatttctaagataaaatttctaaattttagataccctaaatcatcactcttaagttcaaagttccacagatctctagagcagggacacaatgccgccagtctctttgctaaggcatagcaagagtgccctttactccagttcccagtaagttcctcatctccatctgagaccttagcctgggcttcactgtccatatcacttcagcttttggtcacaacaatttgacaagtctctggaaagttccaaactttccctcatcttcctatcttcttctaagccctccaaattgttccaacctctgcccattacccagttccaaagtcacttacacattttcaagtatctttgtcgcaatgccccactccaggtaccaattttctgtattagtccattctcacattgctataaagaactgtctgagactgggtaatttacaaagaaaagaggtttcattggctcacagttccacaggctatacaggaagcatggctgggaaggcctcaggaaatatacaatcatggcggcaggtgaaggggaaactgacatgtcctacatggctggagcaggaggaaggcaggggaggtgccacacacatctatttttttatttatttttattttattattattatactttaagttttagggtacatgtgcacaatgtgcagtttagttacatatgtatacatgtgccatgctggtgcgctgcacccactaactcgtcctctagcattaggtatatctcctaaagctatccctccccactccccctaccccacaacagtccccagagtgtgatgttccccttcctgtgtccatgtgttctcattgttcaattcccacctatgagtgagaatatgtggtgtttggttttttgttcttgcgatagtttactgagaataatgatttccaatttcatccatgtccctcaaaggacatgaactcatcattttttatggctgcatagtattccatggtgtatatgtgccacattttcttaatccagtctatcattgttggacatttgggttggttccaagtctttgctattgtgaatagtgccgcaataaacatacatgtgcatgtgtctttatagcagcatgatttatagtcctttgggtatatacccagtaatgggatggctaggccaaatggtatttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatagtatctcattgtggttttgatttgcatttctctgatggccgtgatggtgagcatttttttcatgtgttttttggctgcataaatgtcttcttttgagaagtgtctgttcatgtccttcgcccacttgttgatggggttgtttgtttttttcttgtaactttgtttgagttcattgtagattctggatattagccctttgtcagatgagtaggttgcaaaaattttctcccattctgtaggttgcctgttcactctgatggtagtttcttttgctctgcagaagctcttgagtttaattagatcccatttgtcaattttggcttttgttgccattgcttttggtgttttagacatgaagtccttgcccatgcctatctcctgaatggtattgcctaggttttcttctagggtttttatggttttaggtctaacatgtaagtctttaatccatcttgaagtaatttttgtctaaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccactgatgccacacacttttaaacaaccaaatctctgagcactcactcactattacaagaacagcaaggggaagtctgcccccatgattcaatcacctctgaccagaccccttctccaacattgaagattacaattcaacatgagatttggtcgaggacggagagccaaactatatcaatccactaccatcttaagtattattgttaccaaataattaaatttcatatatattttaaccctacaacacattattagtattgctttgcccagtcaaaattcatttggctttacccatatatttattctttctgttgttcttcctttttttatgtccattttccttctgggatgatttccttctacctgaaaaactccttcagcattttttagaatttgcaggcaaagaattctcagttcttatttatctgaaaatgtctttattttgtctttatttttgaagagtatttttaaataagttgccacttattttcattcagtatttttaaggcatcacttgtctgtctgtggctttcatgatttctgttgagaagtcatctgtcagtcttatggttgcttgttagaaaataacatgtctttttacatagctgcttttaagattttgtctttatctctgattgtcagtagttttactacataggtaggcatgactttatttatatttattgtttttgagatttctagcacttcatgcatccatgtcttggtatcttttgtcagttttggaaaattctggcccttatttcttcaaacattggttctatcccaatattctttctcctttccttctggaactttaattatatatatgttcaactttatcatcattttccatatgcttcttatgctttttttgtatattatttatcattttccctccatactttagcgtggatatttcctagtcctctcctctgctagtctgaaatgctattaaacttgttcttaattctagttatatttattaatattagttctagaattttcatttgattcttttttttagaaattccagtttgttgctaaaattctccatctagatttctatttccttgaacatattaattatagtttttaagtccaagtctggtaactataatatctagatcatttgtaggtctatttctattatttgtttttcccttgcttcagtttcttggtatgtctcatcattttctattgaatgccagacatgtgtatgataaattataggggctctggatgacattatcttccttcacaaagatttgcttcttctagcaggcagttggagtatggaaaatcacctaatcaggccttgggttgggttgtttttaagctggattctgtctttgtgagggctcttttacttatggttcactcttattccatgggtgtagctcttcagggttcctcacttaaagcctgtagtgcttaccagtgtgtctcttccttatggtttccaatttccaattttaatcttccccaaatctgaggctgctaaaagctctgtttaatctcttagccactaatttctacccagagttgcaaacttccttcaccatgactcttacaaattagcaactgcctcagaagaaacagcagtgccaaacatcaggctcacttctctgtccctttctcttcagggacttgatcttagctcaagtcattttctctccccagtcttatgagactgatgaaagctgtactcagcttctcagcctcttagccttgtgtggctgatgaaaaagccagagcctgaagggaaaaaagcagtttggaatatctgactcacctccatgcatttcccttctctccaggatcttggccttcaagtcctggctgcattgagacctttccaatactttaaaccaagttactttgttttgttttattcattttttgtagttgttcttgggagattgttggcctcatataagctcgcttatcagtgttgcaggtgaaactagtatctcttctttaagtacttgggttctgtctctcctacatgcaagtctttctcttgcatctttctgatttgtgtctctaacccaatctcacttgctggtatcagttctaatatgctaggtgtggagaactgtacgtctgtctgcaattgttcaaatctttcctcttaagtaatatctcttactttgtttctattcttaatttatattgggaaatataatattacatcaagtgtgacttccttcaatgtgagtgccttggtaaaactctgcaactcttaggactgaagaaaaaaacctctatggatttaacataattaattacttatagtaattagtaagactctaattgattattacctctaagatgtcatgaattgatgccacttttttctgttttttgagttattagatgtgaaacagtcattattaaaaatttttttgatgcctttggaaagaaattacgggaaaggtgctcaacatcatgatcatcagagaaatgcaaatcaaaactgcaatgagctattatctcaccccagttaaaatggcttatatctaaaagacaggcaataaaaaatactgttgaggatgtggagaaaagggaaccctcatacactgttggtgggaatgcaaattagtacaagaactatggagaataatagtttggaggttccttaaaaaactgaaaatagggatactatatgattcagcaatcccactgctgggtatagatccaaaagaaaggaaatcagtatatcaaagagatatctgcactcccatatttgttgcagcactgttcacaatagccgcaatttggaaatgaccaaagtgtccatcaacagatgaatggataaagaaaatgtgatatatatacacaatggagtactattcagccataagaagaatgagatccagtcatctgcgacaacatggatggaactggatatcattatgttaagtgaaataagtcaggcacagaaagacaaacatcacatgttctcacttatttatgagatctaaaaatcaaaacaattgaactcctggacttagagattagaaggataatttccagaggctgggaagggtagtggggggtgggaggtgggggggatggggatggttaaccggtacaaaaacatagtgagaacgaatgagtacaacctatttgatagcataataggtgaatatagtcaataataacttaattgtacatttttaaataacttaaagagtataattggattgtttgtaactcaaaggataaatgcttgagggaatggatactccaatccccataatgtgcttattacacattgcatggatgacccaaatcatctcatgtacctcataaatatatacacccacaaaatttttttaaattttttttaaaaagaaaagaactatagatactccttgacttacagtgaggttacatcctgataaactcaggatgttttatcagttacaactgaaaaaagttgaaaatatcactaagtcaaaaatacacttaatatacctaagctactgaacattatagctcagcctaacctaccatatatgtgctcagaacacttacattatttttatatatatatttatatatatatatttatatatatatatttatatatatatttatatatatatttatatatatatatttatatatatatttatatatatatatttacatatatatatttatatatatatttacatatatatatttatatatatatttatatatatatttatatatatatttatatatatatttacatatatatatttatatatatttatatatatttatatatatatttatatatatttacatatatttatatatttatatatatatttacatatatttatatatatatttatatatttatatatatttatatatatttatatatttatatatatttaatttatatatatttatatatatttatatatttatatatatttttatatatatttatatatttttatatatatttttatatatattttatatatatttatatatttatatatttatatatatttatatatttttatatttttatatatttatatatatttatatatttatatatatatttatatatttatatatttatatatatatttatatatttatatatatttatatatatttttatatatttatatatatttttatatatttatatatttatatatctatatatatttatatatatctatatatttatatatatttatatatatctataatttttatatatttatatatatctatatattttatatatatctatatatctatatattttatatatatctatatatctatatattttatatatatctatatatctatatatttatatatctatatatatttatatatttatatatatctatatatatttatatatttatatatctatatatttatatatttatatatctgtatatctatatatatttatatatttatatatatatttttttatatctatatatttatatatatataagatggagtcttgctctgtcactcaggctggagtgcagtggtgcaatcttggctcactgcaaactccacctcccaggttcaagtgattctcttgccttagcctcccaagtagctgggactacaggtgcacaccatcacacccagataatttttatatttttagtagagacgggctttccgcgtgttgtccaggctggtctcaaactcctgacctcaggtgatccacccacctcggcctcccagtgtgccgggattacaggcatgagccactgcatccagctagagcacttacattaacccaaagttgggcaaaattatcaaacacaaagcctattttgaaataactgttgaatatctcatatagtttattgaatactatattgaaagtaaaaaatagagtggttgtatgtgtactcgaagtacagtttccactgaatgggtattgcttttataccatcataaagtcaaaaattataagttgaaccatcataagatggggactatctgtatattaaaataatgaaggttttccacaccaggtgtggtggctcatgcctgtaatcccagcactttgggaggccaaggtggggcagatcacttgaggtcaggagttcgagaccagcctggctaacatggcaaaaccccatctctactaaaaatatacaaaaaaaatggctgggcatggtggcaagcgcctgtaatcccagctactcgggaggctgaggcatgagaatcacttgaacccgggaggcagaggttgcagcgagctgagatagtgccactgcacactagcctggtcagaaaagcaagactctgtctcaaaaaaaaaaaaaaaagacaaaataatgaaggttttcttaaaatataaaatgaaatatgaacactaacccatgtatattacacatatatgtagagagaggggggaaacactaaccaatgtatatataggaatgtctagtttggtagatgccctccattccaattcaaatgagagcagaagttgattactataacctaaagaagaatgtgttaaagcagggaatttaaaaattaatacatggatatgtcaaatagtttaacttaaatcagataagtgtaccttcaatcagaaatataaatcatgccaataatttatcacccctgatttccagtttaggcttcttgaaaatgaatctgtacttaaagatacttgcagaaccatctgagtatagaactcctgagttttacaacttttcccaatcttttacagatatcttgctctcacctaattatacattattttcagcaacttgcctctgttgagtcctttcagagcagtcataaaaaatgccttccttttctcactcatatctcatcaatttcaaaagattttaccaaattatgtaagcacaatgtcagaataactggtataaggaggtttgagaacaaacacaacttactcttggtaaacatgcaagtttactgcagaagcagaagcgtgctgccacagcggagagtgggcacccagctgaatcatccggatgccctagctctgtcagtgtttataatactacagagggaatggcaagcatcggctggtcctgcaaagaggttaagtgttggctagtcaagagagcttctgcaatacagttattttgagtatagttattttgcttaatcttgggttgaatctacatctttttgaagtcaccttccttgtcaccactcatcttatcctcacattcactggcatgatttcagaatgattggagatagcttcttccaatctaaatatcacagattgcctaagtttaataataacagtgcactttttgtgtgttaacaaataccagacttctaaacactttacatgaatgtcattgaatctttagaaccctaagaagtagggctattattatccacattttgtacttgaggaaatggaggctcaaaggaatgaaatggcttgcacataggctcatagaaagtaatgataagtgcaaaattcaagtccaggtcatgagcatctacaacttacatgtgtaccacacactaagtgcatcccttgtcatagaacttgggggctggtggtgggctcccgcctgtcaggctggggccagctccccaccctgccattctccttttatttctccagtcagcctccctaaactcagcccactttgccttctttcaggaagtgattacttcttatagccccccagattctccccccatacctggcaaagggctgggttcaggcatcctccattccctctttcactgactctgaggatatttgtttgagctccttgtgatttcagaattttactgtcatcactatggagacatggggtgagagaaatacacatgcagaaaaatgacaaaggcttcagaaacttactacattcttggattctggttcctgagctaccattcttcatgcccgtgctgtggtgggaaccaaatgctcccatggactgctgtcctccatattgattcctgagagaaaggctctccaattccctcccccgctttagcaacagccctggttacccccacacccataaaggctactttgcccagcacagttgtccccttgtttatagtggagacttgtgctctaaagcccttcaaactgggaagcattcaattctggcccccacatacagcagcagtaatgacccctctgggcattacctgatggtcactatttagaactaagtatcatgacttctggaaaaactgttaaaatgccaagtatttttgcctggcacaaatcaggttgagtggccaaggcaaaagagccacagcttcagccaccgttaaccgttaaaggtgaaaagaaattcgtttatccacatagcctatatccaagatggttttactggctgtgctgaaatggcagaaactcacgggaagtccatggataaatttaaatttccactatccagtgcatctaacatgtatcccagtatcaatcctcccactccttttaatatcaggataccagttgtcagctggatacatggccacccagaataatacatttcccagcttctcttgagatagccatagttatgaaactaagttctgaccaataaggtgtaagaaaaataatgtgtgcaatttcctgaaagagtacttaaccagagggagcatgcccctctttgtcttctggactgtccacctacaaacttttttacataagacaaaaataaacccgttctaagctacgatatttgaggtttctcagttatatgcagtcaaacctaatcctaactgggttaaccacccaagaagttcatcttgcccactgcctagatagccgattcatcacgacaggggcattgcaatagagaaagagtaatttatgcagagttggccatgcaggagaccggagttttattatcacttaaatcagcctcccctagcagtcagggagcagagattttaaggataacttggtgggtggggggaagctagtgagccaggagtgctgattggtcagagatgaaatcacaggaagtcagagctgtcttcttgtgctgagtcagttcctgggtgggggccacaagatcaatgagccagtttattgatctgggtggggccagctggtccatcaagtgcatggtctgcaaaatatctcaagcactgatcttaagagcagtttagggagggtcagaaacttgtagcctccagctgcatgactcctaaaccataatttctaatcttgtggctaatgttagtcctacaaaggcaatctagtccccaggcaagaaggagacctgctttgacaaagggctgttaccatcttcctttaaactataaactaagtttctcccaaagttagttcagcctacacccaggaatgaacaaggacagcttggaggttagaagcaagatggagttagttaagttagatctgtttcactgtctcaatatgattttgcaaaggtgatttcaatccctccttttgggtttttataacaccttgatcttaaggtgtaggctatgaggatgggaaaaggccgtcgatcactctggcttctttctgctgacaggagatgtagtgggaatgggagtgacccccaaggtgagaagagtagaaccactttgcaattgtctgagtgtactcatgcaggcctggctgggttttcaaggcttgcatggcaaaaaacattagtactctcatctatagttttactacagtgtttaaagtgaccagcctactataaggtaaataacgagtccgaggatgaggagtacaattcccaattttaaaagcaaagatctgaaagcattagtttggggacttctaacccacaaagaatttagaatttagtctaaactgcagaaaaaacctcaagaacagctaacaacagtgtactatagcttttcttttgaagcataatttttctgtctccagtccccatttttattcaaaacaaatcatgatagaactgacttgtttacaaaataaactttactcttactgtacttggcctgattattggcaaaaagtgcagcaagaataattatttttcacttaggctttttaaactggctttgatagaactctgctctatgaagactctcagataagactttttaaaaggtgagcccaggcatgggtttgtatcctcaaatacctatgagttgggcaaattcctcttctcttaaggtcccaagataacttggggttcctgggcctgttagaaagtggcattctttaactttccacaggtcaggaacctggtacagggactctgtgtacacaaggtatgaggccagattccccaatggactttaattggctctataagtcaactttgattctttaaaagaagcatgccattccagtcaaagccttggtaaaataaccagtttatccaattgtgtcctgttacaaaaggaaagagattcttactgtgcttatacaattaactatactataatgccataaattgagaatattcacaaatagtttccgaattctggagaaatcaggtagaaaagaacaaatatgatccaaattttgttcacaagagtatattttactcacttgttaaaagttgcaaatagctctaaagaaattagtcctcttgtctctgaaaacaaaaggtttagcaatgtttaacacattagctctccatgagagtcctagaagtttggctttttcatgtactccaatagcacaatttttaaagttatctgagtcctgcacttaagagtcctatatctgatcataaactgccttttgaaaaggaccaaaacaagacaaaatgtctgtggatgacaaaagtctatagccactattaaagctacaattgactaggaatttgggttacttctgtggcataaaacaattttatataacaattacaattaataatgtacactaaattatactaacattatagaagtttcccataattttggaacacatactcataacatttatacaaacacagtccaaagtaaaccaaacagcatttactcttctatttgaaactttttcttctaatctcacaatctccagcattattcatcagaatcctgcatttaagagcaccttaaatagctcattataaaaccatcttttaaagaggaccgaaacaagacaaatgtctgtagatgacaaaaatattttagggcagccacagttaaagacacaattgacaaggaaatttttacctccatggcacacagtctgttaccaaaataattataatactgataacatatattaagtcatattacaattataggagttttacataattttggaacatataccaataacacatttacataaatatagaccaaagaaagccaaacaccatttcatatttgatgatgcttcctgtataatttttgtaccaaataagccaaatgtcattactggactttagaggacctaacatctaaaatattaggctagaaagagacataatttataatttttttttggaaagttgtcagatatcaaaggtttaaaacactggatatcacaaaatagaatcacaggtcatcataagtcattcatttggccaaaatgataactccaaaatcttaaaagaaaaatctttactcagataggaaacttagccaataaagatagcatgaggccagctgaatttgtctcttctctctcctcccctttttttccctgccatttacccaaaggagaaaacaaaaccattttcattatcttttaacattacttaaaaatcgtcttcaaaaaaggaaaccaaatttcatgtttgcattacagcatctttaatgttaaagctagttatttaaataaaattttatatttctatccagttttaattaatttggccataaggtaagattttcattaactttttagaacactttacaattttccatcaaatagcagattaattttctaagaaaaccctgttacttggacacatgggcccagattctggtcccacatcagtatgattttaatgtgttaacctgtggaaaaaacctaaataatttctcttaaatcttagccaccttgtttatacccacagaattttttcataaaattaaccaaacccttttcactttgcttaagacttcagttttgtcccattactcttttaggttaagacaatctataaaatcctctgaactggacaaaattacattctctttaacaaaatccatattcctatgccttcttataatcttttaccaaaaacaccttccctatacaccttgtacgtaaaactgtttctccagtggtctcaactacatattatactgttaactcttactccttttagcatagctagtaggcatggctctccatatgttcccaggccttatttataacctaatgctccaaagtaggtaaattgaacaattttcaaaagtcaaacagtttgaccttaaagcatttagcaaatctgatatctgaccttaatttagaccaaatgtctacattttcaagacattttattttaccaataatccttaaaactgtctttatttccaaaagattactaaagtcacgtgaacaaaaaggcattaaagcttcttttttctgacaaaatgtttgatttaagtgctttttctaagccaattaatcagagctcttttatagataaacatacaacacatacaaaaatgcagacagaagattcaatgcttgtaaaatttttctttttttttcttttatttttattatactttaagttttagggtacatgtgcacaacgtgcaggtttgttacctatgtatacatgagccatgttggtgtgctgcacccattaactcgtcatttagcattaggtatatctcctaatgctatccctcccccgcccccaccccacaacaggccccggtgtgtgatgttccccttcctgtgtccatgtgttctcattgttcaattcccacctatgagtgagaacatgtggtgtttggttttttgtccttgcaatagtttgctgagaatgatggtttccagcttcatccacgtccctacgaaggacatgaactcatccttttttatggctgcatagtattccatggtgtatatatgccacattttcttaatccagtctatcattgttgaacatttgggttggttccaagtcattgctatcgttaacagtgccacaaaaaacatatgtgtgcatgtgtctttatagcagcatgatttataatcctttgggtatatacccagtaatgggatggctgggtcaaatggtatttctagttctagatccctgaggaatcaccacactgacttccacaacggttgaactagtttacattctcaccaatagtgtgaaagtgttcctatttctccacgtcctctccagcacctgttgtttcctgactttttaatgattgccattctaactggtgtgagatggtatctcattgtggttttgatttgcatttctctgatggccagtcatgataagcattttttcatgtgttttttgactgcataaatgtcttcttttgagaagtgtctgttcatatccttcacccactttttgatggggttttttttttcttgtaaatttgtttgagttcattgtagattctggatattagccctttgtcagatgagtaggttgcaaaaattttctcccattctgtaggttgcctgttcactctgatggtagtttcttttgctctgcagaagctcttgagtttaattagatcccatttgtcaattttggcttttgttgccattgcttttggtgttttagacatgaagtccttgcccatgcctatctcctgaatggtattgcctaggttttcttctagggtttttatggttttaggtctaacatgtaagtctttaatccatcttgaattaatttttgtctaaggtgtaaggagatccagtttcagctttctacatatggctagccacttttcccagcacaatttattaaacagggaatcctttccccattgcttgtttttgtcaggtttgtcaaagatcagatagttgtagatatgtggcattatttctgagggctctgttctgttccattggtctatatctctgttttggtaccagtaccatgctgttttggttactgtagtcttgtagtatagcttgaagtcaggtagtgtgatgcctccagctttgttcttttggcttaggattgacttggcaatgtgagctcttttttggttccgtatgaactttaaagtagttttttccaattctgtgaagaaagtcattggtagcttgatggggatggcattgaatctataaataacttgggcagtatggccattttcatgatatttattcttcctacccatgagcatggaatattcttccatttgtttgtatcctcttttattacattgagcagtggtttgtagttctccttgaagaggtccttcacatcccttgtaagttggattcctaggtattttcttctctttgaagcaattgtgaatgggagttcactcatgatttggctctctgtttgtctgttaatggtgtataagaatgcttgtgatttttgcacattgattttgtatcctgagactttgctgaagttgcttatcagcttcaggagattttgggctgagaaggtggggttttctagatatataatcatgtcatctgcaaacagggacaatttgacttcctcttttcctaattgaatgccttttatttccttctcctgcctgattgccctggccagagcttccaacactatgttgaataggagtggtgagatagggcatccctgtcttgtgccagttttcaaagggaatgcttccagtttttgtccattcagtatgatattggctgtgggtttgtcatagatagcgcttattattgtgaggtacgtcccatcaatacctaatttattgagagtttttagcatgaagttgttgaattttgtcaaaggccttttctgcatctattgagataatcatgtggcttttgtctttggttctgtttatatgccagattacgtttattgattttcgtatgttgaatcagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgccagactttggtgtcaggatgacgctggcctcataaaatgagttagggaggattccctctttttctattgattggaatagtttcagaaggaatggtaccagctcctccttgtacctctggtagaattcagctgtgaatctatctggtcctggactttttttggttggtaagctattaattattgcctcaatttcagagcctgttattggtctattcagggattcaacttcttcctggtttagtcttgggagagtgtatgtgtccaggaatttatccatttcttctagattttctagtttatttgcgtagaggtgtttatagtattctctgatggtagtttgtatttctgtgggattggtactgatatcccctttgtcattttttattgcatctatttgattgttctctcttttctttattagtcttgctagcagtctatcgattttgttgatcttttcaaaaaaccacctcctggattcatggattttttgaagggttttttatgtctctatttccttcagttctgctctgattttagttatttcttgccttctgctagcttttgaatgtgtttgctcttgcttctctagttcttttaattgtgatgttagagtgtcaattttagatctttcctgctttctcctgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagttggattgcactgtggtctgagagacagtttgttataatttctgttcttttacatttgctgaggagtgttttacttccaactatgtggtcaattttggaataagtgtggtgtggtgctgaaaagaatgtatatcctgttgatttggggtggagagttctgtagatgtctattaggtccacttggtgcagagctgagttcaattcctggatatccttgttaactttctgtctcgttgatctgtctaatgttgacagtggagtgttaaagtctcccattattattgtgtgggagtctaagtctctttgtaggtcactaaggacttgctttatgaatctgagtgctcctgtattgggtgcatatatatttaggagagttagctcttcttgttgaattgatccctttactattatgtaatggctttctttgtctcttttgatctttgttggtttaaagtctgttttatccgatactagggttgcaacccctgcctttttttgttttccatttgcttggtagatcttcctccatccctttattttgagcctatgtgtgtctctgcatgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcatttgttgatgcagtttcttcctagcctcgatggtctttacaatttggcatatttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggttatgaaattctgggttgaaaattcttttctttaagaatgttgaatattggcccccactctcttctggcttgtagagtttctgccaagagatcagctgttagtctgatgggcttccgtttgtgggtaacctgacctttctctctggctgcccttaacattttttccttcatttcaactttggtgaatctgacaattatgtgtcttggagttgctcttctcgaggagcatctttgtggcgttctctgtatttcctgaatttgaatgttggcctgcctcgctagattggggaagttctcctggataatatcctgcagagtgttttccaacttggttccattctccccgtcactttcaggtacaccaatcagatgtagatttggtcttttcacacagtcccatatttcttggagggtttgttcgtttctttttattcttttttctctaaacttctcttctcacttcatttcattcatttcgtcttccatcgctgataccctttcttccagttgattgcattggctactgaggcttgtgcattcgtcacgtagttctagtgccatggttttcagctccatcaggtcctttaaggacttctctccattggttattctagttagccattcatctaattttttttcaaggtttttaattgctttgccattggttcgaacttcctcctttagctcggagtagttggatcttctgaagccttcttctctcaactcgtcaacatcattctctgtccagctttgttccgttgctgatgaggagctgcgttcctttggaggagaaggggtgctctgatttttagagtttccggtttttctgctctgtttttcccccatctttgtggttttatctaccttttgtctttgatgatggtgacgtacagatgggtttttggtgcagatgtcctttctgttttagttttccttctaacagtcaggaccctcagctgcaggtctgttggagtttgctggaggtccactccagaccctgtttacctgggtgtcagcagtggtggctgcagaacagcggatattggtgaaccgcaaacgtttctgcctgatcgttcttctagaagttttgtctcagaggagcacctggccgtgtgaggtgtcagttcaccccgtaggggatgcctcccagttaggctactcgggtgtcagggacccacttgaggaggcagtctgcccagtgcttgtaaaatttttcaattgccagtttcttaattggattactggcttcagggtggagcccttggaggaacagggccaggaaagcatgcatttctagggccaaataagcagctgaaggcaaagacagttccccaaaattaagggtgccattttatactggatcctggatccccaaaaggagggaaagactatgggagaagatagtgcaatgcttctaccctgcatttcagcatttcattgcaaggcaacccaaagccaatcagcccattttgtaatcaccccatctctcatgagggagtctcatctcccatttggggatgaggatgtttccttgtcttccaggtggccacgagcctgcttctctgatccaagtgtgctaagagtcaagtatccctccctaactactgttagccatcccttaaagtgtatttcctacctagttataatgtgaagtaatttgatacccccaaaactcaaaaccttcagataacacaatgcaaaacagaacacagcctttgattttgagagggatttatctgcttttaattccttgggtttcatgaggaaaacagaggggttttttttttccccaaaatggggcctgtggcacctcctctgttttcccaatgagtccgaggctaccggaagttatcttagggcctctcctgtgtgcattaagtgtggcaagacaaaaaaaagaaaaaaaagaaaaaaaaggagaaaaataattcagtcaattgagaagaaaaaacctttttccagaaaaacaagttccaagaagagaaaaacataaaggccttttaaatatatctgtagcttgtttatccacttttaattaagctgatttttaatcatagtgctctctaaaaaagaaatcctttcaaatctcttattacctgactttatccatgccaagtggccaatatttctagcttctaaactttatgaaaggtaacctcctaggtgcttcaaaggcatggtaagcagtttctttttttataggagttagaagctctacaagatagttcagagaaaggaaaattaaagagaggaaatcagaagataaccatgggtggggggagggggagactcaataaatggcaaagttacacaaataacaaaccagaaaggaatcattccagaagccaacaattgaacctaggccaccactgtcagaagataaagccttagctactgagctgtacagcattgagcagtttctattgcttttcccagaaggagcctagagaagccagtttcaagctttcaaggctttaactgctcacaaaaaatttttaggactaactatgacaagaacccccaaattcctgtcctctggatggtggaaatcaaaagaaagtattcccacatggtcactaagttaagctgttaaggacacaaaacaagacagagaaatttcctacagtattggtttcagggacccatagcaaagtttgtaactgaccagcctgccaggctggcttgaaaagcagggttataggggtcctaaacccacatgctatcctgtgatacccctgtctccattacagaacacagaaagacaaattcttattacaaagtacaccagatttgctacagcctaagactagtctcacaaatccttttttctattaatcaaacccttgcagaggacaccagtagtttactgttttactcaaacagagaaagagagagcaagcagaaacttggctggtaagaatttcttaccctttttgctggcataccaggtttctaggttccctttctctgcagtttccagaagaaccgagtggcttctggcgaccctgctcacttgtgctatagctggggattcaagccactttacaagagaaaattaccctttactgtcttacagaaccataggcaaggttcttaatttgcaagatgctgcccaatgggctgcatgggaaactgaattaacattttccgttccagcaaaacacacataacaaaacagacattacttaccttgttcagcacccactatcagcctggcaaagctcaaactttttcccattggtccctgtcatctttgatctactctatgtggggacagatgacctctgaagggtaattcatattggggtctctgggaaaggcaaagagcagacaggcactccgagacaggcctgttaagccctctttagggttcattgaatgtgaccagacgaataaggagggttctctgagttaggcctgctggacttccatcagcaacccctctgagatcccttccacatatgcaaacacacacaaagatgagacagacagaaggccttccaaatcagatccctaaccaagagctccaagaatatcccttattccaaactatcctcctattctccgtctgagaaaccgcctcaaaatctttctgattgagaagtctccaaagccaggactcttcctactagttagaaagagccaactgagacccccaggagccgaacagacaccctgcaatgaggctacaggtatcccatggtagagctacaaagagacaccccacaatggagctacagacaccccatcatagggctacagacaccccaccatagggctacagaaccagtcgggagaaggaaggtggccttggcagcaatactcaccaatccagacacccctcaatggggctacagacagatatcctgtgatggggtacagttaagggacatctcaggactatttctccattgcaattaaatccatgcacattgggtcggcagtgccccaccagtagagagagtaccagagtcagtccccagcccaagagaactaggcgactgcttgggttggcttctggatccatccataaaaggggtgccaccgaaccacaggcatgtagccacaagggcaatcccagacaagcccttaaatttgtaaccacccgaggggttcgccttgcccgctgcctagacagagccgattattcaagacagggaaattgcaacagagaaagagaaattcatgcagatcctgctgcacaggagactggagttttattattactcaaatcagtctccctgagcatctggggagcagagttttttgttgttgtttgtttgtttgttttgagatggtgtctcgctctgtcacccaggctggagtgcagtggcgccatctcagctcactgcaagctccgcttcccaggttcacgccattctcctgcctcagcctcccgagtagctgggactacaggcgcccaccaccatacgcagctaattttttgtatttttagtagagacggggtttcaccttgttagccaggatggtctcgatctcctgacctcgtgatctgcttgccttggcctcccaaagtgctgggattacggtcatgaaccactgcaaccagcccagagtttttaaggatagcttggtgggtagagggaaaccagtgagccaggagtgctgattggtcagagatgaaatcacaggaagtcagagctgtcttcttgtgctgagtcagttcctgggtgggggccacaagatcaatgagccagtttattgatctgggtggggccagctggtccatcaagtgcagggtctgcaaaatatctcaagcactgatcttaagagcagtttagggagggtcagaaacttgtagcctccagctgtatgactcctaaaccataatttctaatcttgtggctaatgttagttctacaaaggcaatctagtccctggccgtccccataggtgaccaaccatgctagtccttctctagcaagaaggaggtctgctttgggaaagggctgttatcgtctttgtttaaactatagactataagctaagtttctcccaaagttagttcagcctacacccaggaatgaacaaggacagcctgaaggttagaagcaagatggagtcagttaagttagatctgtttcactgtctcagtcataattttgcaaaggcgatttccctgacacatgtaagaattccaaaagtatttcagagattgaaagacttgtttcttattcctgttcaaagtacttgtcacatgaaatacattaaatccaagattctctgattctctcactgttgtaaaacacacacacaaacacacacacacacacacacacacacacacgctttggtctccagtgactggggaggagtcgtttgctctcacagattattgtattctacacacaattcttcaattaaatgaatgtttagaagtcacaaacactttgggaggctgaggcgggtggatcacaaggtcaggagatcaagaccatcctggctaacatggtgaaaccccatctctactaaaaatacaaaaaattagccaggcatggtggcgggcgcctgtagtcccagctactcgggagactgaggcaggagaatggcgtgaacacaggaggcagagcttgcagtgagccgagattgcaccactgcactccagcctggggaacaaagcgagactccgtctcaaaaaaaaaaaaaaaaggaagtcacaaacaacacagaatcctgcacaaacttggtctcagttttcaaccaatccctaccctcactcgcgagatgagaaaacaaaagaaatcagcctgcctttttttattccttgggctaaattgttacatactctgcaaggaaatgagcatagatatttccaagactaaaccatcatacccaagcagtcagtaataaatatgatgaatgcctaaataaattatggctagagttggtaaagtaattcttcaccatcagatgattcctgtaaaaagcactaaagtgtcaatctacatgaagcccccggccctgtttcaagttatctgttaattacacatccctcatttatccagtgactctgctattatggtaagtgtcggattcattttatcccattgctcaatagattttaattgcagctgctgcagcagacaccttgagatacatttcctattgagaccgtggcagcctgctagactggcccaatgatgattaatttcaatgacttgaatcactgagaagaagggaagccacttccattttaattacatctacaagagtgcagcacttttataccagttcattgtccttaaacaaaagaatacctgaaaggaaaacaaaattcagggtatggtggtctctatttgtactgatctccttttttcagttcattgcaccacaactcagtcagctctgtattgggaaatattggcaagccattgggatttgcacacagattagaaaccatgaagaaagcgtcattcagcttgtttttgtttatcttacttgggcaattagaatccattgagcgggttaagatatgacacagcattttgccatcatcgcagatgttccacataaaagggtcaagaataattaactctgacatgcatatgtatttatttattgttccagggagacagagccaaagacattcttgggattttacagaacactccatactcattcatacccttggatgctggcacatgctagtcccttctcttccccatccatttggataaaattttccagcaaaggccagctcaattgtcatttcctctgtcctgccttgagataggggtggagtgagggtgggggttgaaagagcagaggccttggatgagacatatctgactgggactgccagtgctgtgtgaccttgagcaagttacttaggctctctgagccacagtttcctcatctaaatgaagaaaaattaacattctcctatgttattatcatgtggattaaatgagatactttctagaaagcacccagattgatgcctggtcataaaagggtgtgatgggtataagtctactttcctcttctgcacttctcgcagtagcacttaaaaaaaaaaatctcctttatgatgctaattgatcagcaagccagaaaacaggaatttaggctctgtcctttcctccttcccctccccgcgtaaaaagatgatgaaatgtatttgtctctacttcctatttcagattcattctcttctcttcgtcctcactgctaactaccttgattcacacctggtttcttcatccctcacctgaattaatgcagaagactctttacagatccccacacctcccatctgacccttctattgcatcttccatgaggcttgcacagtgatcttccctgcccctccccataggtgaccaaccatcccagtttgtccaggacagcaggggttcccaggatgtgagacttttcagttttaaaatcaggacattcccaggcaaaccaagatgagttagtcaccctgcatcccttagttaaaatctctcaacagtttctcaaagattccaagataaacttaaatttgtcagtgtaatacacaaaactgtttgtaatctagcccttcctctctaccttcatcttcatcatgcctccgtatttcctgcacaaacacacacaccctttgctttggcaatactgggctcctagaacttcctccgcagatatttcatgctctttcttgactccttctttgtctttgcccttgcagttccttccacttgcaatgcccattcccctactcctttcatcggctagctccttcagatcctgatgcatcatctccactaataagtcacccctgagagtctaacgtagaagctcctctactgtgacttctatcgcaccctgttttaaactctgacctgacatatcttatgcttcactgtgattatgatctgcctgccctaatagactgggcagttcctgaggacagggactatgccttctttaagtcagggagttgacgcatgtctgtgctcattattggctggacgaacaaataagttgtatatatttgccttctcacctccactactaagtgacctcctcaaaggcagaaaggacacatcttgattttctttgatctcttgattttctcccccagcacctggtccacagcagggcttaattaaatgttttgaatatatgaatgaatgaataaatacatctttctttagatatgagcctagctttcctggtgaaataaacttcccttcagtttgttcactaccccctgccccagctggctgtgtgccctagacaaggaactagttgtcagaactaaacatggccccacactgtccctcaagtggccatcagcccgaagacactggggtcaggacctctcctataggcatgaactccagaaggaaaaagatttctgtccaaaggctgatttcagtcaaatctaataaaattttcaactagattccttacacaattaaatataaagaccactagcatatggggaggaaagctacaccagatggctttcccactacaaagagatgaaatatatgtcatttccacttccatagtggtttagtcttcttggagctcagcattaaacagctgggagccctttctgacagctgggagccctttctgacagtgcagattccactgctgatggcaggaagtcagtatcaggcagcatccatccattttctccaactacctttccagccaaccacctatgactttctctcctacaaaagttttatgacaagttaagtagaaagcttagcaatgaataagacctcaagggatttggcaggatggagaaaatgaggaaagtttggaataacattgattgttcctgggaataaatgtaaagtggaaaaaggtctaagggcattgtggtcgcacagaccagggatcaaagcctcactcttccatgtagaagccacctgaccccagttcactgggcctgggcttcagttttctaatctcaacagggagaagaatgacaagacctagttggcacagagtatgttcagtacattttagctctcttcccctctcttgactcctattgtatttgctaaaatgacacttctggtctgaaatggattttttcttttcctcatgtgtgggttttttgttttttgtttttagtaatgataacgcccataaatattgttttaaatgaaatcagatttagatatgcatttttaaattacttacttttgaatagaaggacaagactatgctgaacagaataaaattagaattgtcaaggggtacctgggaaatgtgacagctctatccatgaggcaaccatgacagctaaaaaaattggtaacttgtaattggctttgggtctccagtatattctgctgtgagtctcacatttgctctcctaagtctcccaaatggagaggggtctctaacactcttaagctccctgatataccccttgatacctgtccctgagactacttgtttccatacactattgttcctgatattcattcacctccaagtccactcatcttttaaaatcacatttgaataggcatgtgtgagagaggctaacacacctgtaagtcaaaatcccatggcgcgctgtagaagacatcccagtaaggctaaatgagcaagggtttcagaatcagaggcctaaattctaaccttggccccttcatctttgtacaagagcagcgcttatgtctgtgggctgttatataaaatctacaaatacctgtcattcagtccagtttcccattcaatgagaagcccctttcatcacattcctagcagatagtcaccccatctctgcttcagttcctccagtgacagagacctcccttttctgaactgccatataagtttgtgcaatttgggtattgcacaaaagcaccaacctgaagaggcaaatgggagctaaaatcgagtccccattctgcatgtaaagcttgttgcctaaaagggatgcctttttcttatttgacggtccataaaaggctcctttttctaacctcacaaaggcaccatatagactatcagtgaccctgccaggtcaacacactccagcgctcactgaaaaatagaaggaacttcaacctctgccatgaaggatgttgtttcagatgccaagtggacaatgagactgtgtcctttggctcctcttagcaagggccacgaccccaaatgagcccaggtgttgagagaccagcaattagttgccgtccaagctagtgtctctgcaagagaagaatataacaaaataaataaagacctgcagcagcacaccatgcttgatcatttatcaaattgcaaaatcttatccatgactgtgaaatggctttatagttaggaaaatgtactaataatgttattaggcagcaattaaacttaaattccttttaactgtatttgatgtcattctttttctgggcccattagactaacattaaggtgtttgtgcagatagctcagtcatttcaaattactttcttgtctaatgtgggagcctttaatagcatactcttaggttgaattcaattttggagacaccaggcatgctaattagattgtctcagtgttccttgcagaagaagccaaagaagagctatttttctccctcttctgcttagcaatgttcatggaacacaactttctgtgcaattagaggtatagaccctttaccacacaaaatctcacttgaaccgtaagtattgctagcagacacaatgtctggttaatatgccaccattgttgaaatgtttttaagttctcattagagccagtaagttttctcccctattattctgagtatcgtagccagtgtttgttctgtctcagcatgttagagttggaagagagggagaaataagtgaacatttattaggcacctaccatctgccaagttctgggtgagatgtttaatgcctccaacagccctgtgagctgtgggtcattatctccatttacagatggggaaactttgactcagagagggtaagtaaagtgcccaaggtctcacagctggcaggttatggagttgggatttaaacagatctgactctaaagatatggtcttccccttctcttagctcctctgcttactggtttggaaacttagaaagtcactttaacatcttgatcatcaagatcacatctataaaatatgataataatattcaccccctcacagtacattgtatttatcaaatatagtaataaacgtaaatggcccttggagaaagtgaaatgctatacatatgttgatgaaaagcaactcctgagggaccttagtttccccaggctgatatatggatcagatgggatagtattatgtcaaacatccagcccacggcccagaactcaaacattcaaccgaacaataatttcatcatcatttcaaccagccttagtccctggaagccttccaactatgtaatctctgctcatttacagattcccttttctaagtctcctttttcattgatctattaacataaattctttcttcaagtagtcattgcacttggcattgatctactaacttatagctattacaatcatgattgcaattaccatttggctccctgcaatgctatcatcattttctcttggttaccatgataaatcttactaataactcctgcctcagatcctttgtggaatgaggcaagagattaatttattaattgatggattaatgactcataacagttacagtcatcattaattgctattacctctgaagcatcaaatggttgagggggaataagagtaaggctaagtggagtgtttcttcctctcagagggccagcctggtagagaaggtgaaagctgtcaccagccaggcagagaaagtaaatgtcaccttgggagtatgagtgtattaaaactgttatggcacaaaccaccgctgttccaacccattcctttgtcttccctggctctgacttggctttccccataactactgtgattctttcaacattagacatccagctctgggctgctggcccttccctcatcccaaggtcattctccacccaggaattcctgagagccagccaggcaagataagaaaacaacaggcctatttgcccctccagcctttgggatccctgaaagctctggtgagtgcagcaagtagctacaaacttgtcaccctgtctttgagagatcactcatccttgagccctcagattccgtggaacccatggaagaccagagctcaaagtcagaagaagggtacaccatgaagaacccaaacttttcatcagtccacactaccccatctccattcatacccagctctcctgtgtaagaaaggtaacccttccagagccacatgaatctcttgtgcaaccctcttagccatgcagcatttctgcttagatacaagagtggtgccaatgcaatgcacatgcttttgctaaattattcccatcaaggaaacagtattatacattctgcttatcacagggtctacctgtaatgaccccccaccatcagcaaagccaatcattttcccttaaatattatagctattgttcattactattggctatagagtttagtttgaaggtttgcccatagcatatcccccatcctttaccatccaagatctatatgtatgaactgtttttcctctatttactatcaactttgaatgtatgtgccccccgctcctttctcctagagagcctttctcatatagacctgacctctctcataactcatctatagaatcttgcaaccattttcctgaaaaaacaatggaaacagaccaggggcttggttcagtgaaaatgttagttaaacctgagtctacatggtaaaatggattatacatagtttaccaaacagatgaaatgtatacacagctaccccaaatagcacacaggcatcactgcagagtaaagttgggttaatgatcaatccctccaaaacagggcattaggaaagcccttggcctaggccagttgaatggatttttcttgggcttctccagactccttttgtctttgtgatggttctgtagtttctgctgattgacctctgaacccaagatgagcagcgccccttctcatcagactggccacttccttatatcagaactgatcagaacattgcaaagagttatttaatatgcccgtctaactgatctggcaaagtggaaggaagactgggcaacctttcaatgccagactttgcatttgatctcatagtcagtaaagattattgagctgaggagtacatcttggtaataacaatatgcatctccctgagttgtctgaggatcaaatgaaataatatatgcaaaatgaatttgaaacctatataggcctgatgattgttattatttctttctgaaggagttcttccccattagtgattcctggcttgtctttggactcctctttcagaaaagcaagccagacacatgtgacaagttaaacaggcatagaagatatttttatctgctcaagccaacaacagtaaatgcatccaacacagtgtgtgattaattgccaaatgaattgtgaaaagaataattgccagaagagtttgaacaagggagggctcagctctaacaagtgggcaagggaagaaggaggatcaggagaggctgtatagaagaacagagattttgtttttggtcttgtgggccagataggatttggattggcagggagaggacattccagggaagataagttatgtatggttgggtggacatgctagggattggagtgttcagggagctgggagtgggggagatgcatttgatgtagtgggaaattgtgaatggtattttctttgactctgtacctttaaccatgccctacataattgtgccacccactccaaccagcctctccaatcctggctgtcccatttatccaacactcactcctgcttatgctgtacccaccctttgccatcctggctcatcttcatacctaatcttgactacatttcccatttatatccttgtgcagggccctgtgaacttgattcaaatttttgacctcagaggtttcttcctcaattcccactcaagcctacagaagtaaagctaacactaagccagatcttcgtgtgagatcttgaaatcttctatctccttaaagtaatcctgtgaagtgaaatttcttttacccccattttgcaggagaggaaactgaggcttgagatgttaattgtgagcactgtgtattattagtccactttgcattgctataaaggaatacctgagactgggtaatttataaagaaaagatatttatttggctcatggctctgcaggccatacgagcacagcactggcatctgctcggcttccggtgaggtctcaggaagcttttactcatgacggaaggcaagggggagcaggcatgtcacaagatgagagaaggggcaagagagatgccaggctcttttaaacaaccagctgtcctgtgaactaataaggtgagaactcactcattacctcagggaaggcactaagccatttatgagggatccacctgcatgacccaaacacctcccaccagacccaactccaacattgagggtcacatttcaacatgagatttggaggggacaaatatccaaaccatatcagggtgagatttgaaccccaacctgtctgaccccatagcctaactcccaccactaggcagatgacaaagcctcttattgccttggcccaccatattggtttttttcatcgttagtacccttggataggatattttactctaggcaacccttggaacttagaccctgcctcatattgccatcctgccgcaaatccttgggtagcaaggacatgtcataggtaggaattctcagtgcagcagttagtttggggtcctaaaagactttattttctttttgttgttgttgttttttgagtcagagtctcgatctgttgcccgggctggagtgcagtggtgcaatctcggcacactgcaacctccacctcccagattcaagcaattctcctgcctcagcctcctgagtagctgagattacaggagtgtgccaccatgcccagctaacttttttttttgtttgagatggagtttcgctcttgttgcccaggcctggagtgtaatggcgcaatctcagctcaccacaacctccaccttcttgggttcaagcaattctcctgcctcagcctcctgagtagctgggattacaggcatgtgccaccacgcctggctaattttgtattattagtagagacagggttttgccatgttggtcagactggtcttgaactttcaacctcaggtggtctgcctgcctcagcctcccaaagtgccaggattacaggccactgtgcttggccaatttttgtatttttagcagacggggtttcagcatgttggccacgctggtctcaaactcctgacctcaggtgacccacccacctcagtatcccaaagtgctgggattacaggtctgagccactgtgcccggcccgtaaaagactttcaacaccagcatttatatttgattctattgacagtgcaagccagtgaaggttttaagatggttataaacatgaggataacatgatcaaatgccatattttcagaagataagtcctggacacagtccaggactatcctgcctcttccctcctatacaatgaagaggtggcaggaagacacaatttgcaccctattttgtggtttaagttaaggttataagagtctgaattaggtagtggtggtagaaatggacagaatatgataataagtaattgactcattttactctgaaataaatgtatttcttctgaaaataaactttctcaccaatagcatcatctggaaagaataagctcatagcttcataactctcggggacccaggatgtatctcaggtgtatcattgttccttggttcatattcttgaaacttttggcaacagcatgatgtggagggaagcttagggggttgaagtcaggcccgctttctagtagtgactctgccactcaactaaccatgtgaccttgggaaagtccttaatctctctgagcctgtcttctcatctgtaaaatggggttaatgtctgtcacacagggtagttgtgaggcttaaatacaacagaagatagaaaagctatgatgagcacagaataaatgtcagtttttatactatcttttcttagccaaacatctcattaaaagccctgagtaatcacccttaaagtcatgtttgaaagaaaagtgattgggtttaaccaaccttttagaaagaaatttggctttccaaatgttttccactgtgtattaagacacataaaaatgttcatatcttttgacccagttgttccacttctcagaatctattgttaggaaattgtcctcaatacagaaagagtggaatgcacaaagaggttcaatgcacagatggctacaatagtgaaaaatcagaagcaatttgaatgtccagaagccaatgattgcagagtcccactgcagtctgctgatactttaaacatgctttaaatcagtataaaatacacagctcaaaacaatatgaaaacgggcaaagtaaatcaaggatcaaacattcttttcttcgattcatcacctcccacctctgatgtccaaccccactcttctgcagggcttccctgtgtggcccatataccaacaattctctttttctgccatctgggtactaccagggctcatttgcacagcattaagcttcccacccagctgcctaagccccctcggaggcaaatctcagctctttcccctgcagacacagaggttctctccaagcttggcagttttttggcacagctctctctctgtctcccaaggcttccttgctctggccccaccccatatccctattaccttcccacttccaacttctttcccgattgtctccaacgcagttcgctgtgcccttctaagttagagaaagtattttctcaggtgtccaaaatttgttcatctacataaacttaaggaagagggaaaaaagatagattttgatgtcaaagtttatttagaagccagtttacactcagtctccaagtctttcagtcttgactgcttcgtggaatccctcaagagaagactaaaatgttattaaactacatcatttcaaagctggaattcatgaagttagaaacacagacagttagctggtcaaaaataaaaataaaaatcacataaagtcatgtggtgctacctgtattttgtaagcgggcacttcctcttttggtaactccttgaatgaagagcatttggtttctcttgagtttgtataattatatgcattgtgcaatttcttagctttggcaggcgctgggtagcatttggcttcagcactttcaactctaaggacaatttcacaattgggcttttcctgtcagctccaacatctggacccaggggagactgggtccaccatgcgatgaaaccctatgtgaacttcctcagccaagcaagaacaagctgtacaagggcaggtccttccctcactccaggagcctgaaagcaggtctttcactgtggctgccaggttatggccattttttaaaagaaaataagctgatcattttttaaaatgctgctttactggttgaacaataatcactatttcaaatcaatatttattcagcacctactgcatgccatgagttccaccctgtgtgctggaatacagagacagctcctgctaatccatcctgcctcttctatcttccttcttctttcctccttcttccttccttccttccttctttacttccttccttctttagttccttccttccatccttcttccttcctccttccttccttctttacttccttccttctttggttcctttcttccatccttcttccttcctccttcctcccttgcttcttttcttttctttttctttttcttttttttttttttgagacagagtcttgctctgtcacccaggctagagtgcagtggcatgatctcggctcactgcaacctccacctcccagattcaagtgattctcctgcctcagtgccccgagtagctaggattaaaggggcccgccaccgtgcccagctgatttttgtatttttagtagaggtggggtttcaccaccttgaccaggctgttctggaactcctgacctcatgatctacccacctcggcctcccaaagtgctgggattacaggcatgagccaccacgcccagcttcctttcttaaatattgtttaaataatgctgaaaacaaaaaagaaaaaagcacttacaatcccatcacttggtatataaagaataaaaaagagcattgttctaaagcttatttagaagcccatttacacttagacctcaagtcttttagccttgaatactttgtgaagttcctcaaaagaagagtgaaatgttattttaaaccacatcatttaaaaaatacattgctcatcctaccctctctgagtccgctgctgcctctggtggcctggggcagggaatccaatgcctgccccaactggccacggcagtgatggaaggtggaccaatgagaactagtctctgcctaggaagcactcgtaggttatgttatatacaaaggatgatgccttcacagtttaaactctccccttaatttataaccttgtgctgagctttctgcctctcccacagatcttccagtcccacctcctctcaagtagaactccttaaatgtagagttgtttccttcttccttccccacacacttaaaacaggcaggcacattttgttcttcatgaacgttcaggacccgcacactgtgaaacaatgagtgaaaggagtagacagcacggactctgacttcctggctctagaaaattccttccagagtaagtttgcatgcagttcactgttgcacacagtcctgggccaaaggatcccaaatgaaagcaaaaacccatcaagagaattgtgatttaaaagttaagaaaacagcctgtgcatatttttagaacagcccagaaaagaatacatctgtgacttgaaacagctggaaatctactttctgccaaaattatgctgattatgaaagctgtaatggtcagacaagagacagtcagaatccaaggagtcctgtattttcatgtattcaactttcaaataatctttactttcatacattaaacattgacccctctacactgcctttcaaacaccaaatgccagccagccatgaagtttttacagccatgtttgtataattgaggattttattgtattttgcccttatcagtttagtagtaagaatgatcaaccaaaagaacaaaagtaatcagaagcgtgggttttataaactcataatatacttcagaaaataaagaaaattatgaggcatcctgaaaacagaataacattagccctggatagtcattgggttacaccagtcaaccatgtgttcaattctgaaggaaaacaaaattttaaaatatgtgtgaaatgttaaaaatattggtaacaacttatggctaaaagacaaggtatcattagggatatatatatatatatatatatattaggattactgaaaatgaagtcttctcctacttggcactctgctagggtatgtctgtcattcactgttatgtcctcagtgccttgcacataatagatgctccataaatatttgttgaataaatgaataagtcatttgtagctttgacattttaaagaatttattatgcataaaagtagagatatatttgcctgtctctaaatatagaaagagaagtagaaaaaggatttctgaagctgccccgtcaatgtgcgtagagatggatcaatctcttacaggggtacaaaaggtgaatttaagcagaaagggtgacagtgagctgtttgtcagactattgtccaaatgccctccctcacggtacaccctcctccaagccacacatacccctgactgaaatcaggcaaaaaaacagacctggtaaggccaggacaaagacaaggcttaggagtgaggtgccccaccccccgcccccatcacaggatgcaacgtctggaaagaggtgggacaggaagttgtgcccgggggagaacatcaaattctagtccaatatagtccaaactgaggaataaaatgaaaatgtacaaccaaggtaaagaaccaaaccagagatgctggtgagtgaagagcattcaaatggacatttctagaggaattctcggggtagagtgcaggcatccaaactggtgtttcccaccaacttgctgtgtgcatttgaagaaaccagagcagaatgcatgcagctcctatgcaaaagacggataaattacaacacagaaaagacagtctaaactcgtgcaccagcagagcaagtctctgatgtatttgctccaaaatgtaaatgatgaagccaaatattggacacagttgagatcaggcactggaaaattatttcaatggtgccaaggccacacgcatggaggaaaagcagtgtcagcagcaagtgtggtgagaaacagggtaaaagcaggatggtcctgagattctaagatcagaaccaggaagtgttggcaggaaggcctgggagatgatcagaacagttctccctccagagaggacccaagcctcactcgcactgccacgccaccccaatcttgaaggtaccccatgccgaacctcatcactgacagcttgtgaaggtgtataacgcccaggaggagttgtggtaaacgtatgcacacatatatataaatatcatcttgctccaaggtttttgaggatggtgagctctgcttgtcacaaaggtaacaggggtggtcattggtttcactttatgtgaccttaaagtgcattttaagtgaactcacattcaatgtcactttgtgggatgcttggggaagagggtctcctttagtgtccagtcttctgaggctctgccttttccctctctggccctcctcagacaagcagagctgagactctgccttcaaagctcgggtattgcctggaatccctgaggcagtgctagctggggaatccagtcagctaacacatgcctctcagacagtctatactctctcctctgacatccaggagggctcatggcagggccacacggtgagaccttgcccatcacacagccattacagaggattcccacagagccttttgacagtggtggccactcatggctttcagagtatgctgcttccctgaggagctcaccaagggctgtgatactctcagaagtgcctctgaaaggcagcagtttacagaaggacccctgctgagcccctggtgaagctgagctgctgcacagcttgcccaaggaacacgttttagaaatatcttcagatccactgggactgccagaggctcctcatcctgtgcccagcacaggccagtggttctagcccttttggttcaggataaaacttcacccttcctaggtttttgtctttccactcatccctcactggtgaggtaaaatatgcctattaaatcttcccattggtgtgcgagagtcaatatttagggtacttgacaaaagctctagattcctcttcctctgagtccttacacagcatacacctatgggcatggaattgaataatctgccagtcctccatttccttcagctccctaaacagcaaatacaaactgaacttcattagcaactccaacttgaatggcaaatgccagccactgggtcagctcaaagctcaaggataaatttcagtggtgaaacatccacagaaaaccctcaagtgggagaatgctaagaaacagtgggaaagaactaatgggaatctaggcctacttcacacacacacacacacacacacacacacacacacacacggactgcctgcgtggctggtacaataaaagtgtgtatttacactcgctcatctatttcattacaagggaccaatcacaaagacatttattttgtcttctttcctgctctggtaagctaattacaaagtaattgaattagctacagaataaattagttgttatcaaactgcaagtaaagggattcttctaaaaatgattttagggtaaaacactggcttgcacaattattccaggttaggaaatatttttaaaatttattttattaatatgtttattgtaggaggaaatcctaaatttaaaggtaaacctaaagtaaatatttattctacctttaatgaatgacaaagaaaggaaagcatgggtaaattcttgaaaatgctagagggggcagtctacgtgaaatgtttacatgataatctttgttggttgaagtcactgaaatattgaaacgtctttagtggtgagcaagtggggtggaatggtgcttactctacataatgttcgatttagcacccttaccacatgtaattactaagtagccagaaagaatgtctttttcaaaagtacatactctgccctcttaaaaatctcaaaaatagcatgttttcttttcaacttctaaattacacttctattaaatgctatgcagagttcagaaaatggctgcctctgatcaatctggtgtgcaaagcccttcatgaagtcatatccatttgatcataaataagctcaaagataccttgcaataaaagtgtcaggctttcagctctctggcaaagtagaagttatttatacattgaaagggtgtgggatattaatggcaaagacaaaaatgattggaaaaggcctggaatcaaaggacaaaagctggaattattaaacacaatacaacataatgccacaatcagaaacactgtaataccatggaattcttacagtgccggtcaaattatgcccatgagcataatacttgagacttgagggtgaaatgtcaggtcctatacttgggcctggaagcaacagcacaattacaagatcaaataacagtattgggaataaaaatagtttgcaggttttagtgggcagtgaactcagagttcatggcatgcagaggctgcagaaaggccaatttgaggatggacagtcctacaaggcatagtctggaagcagggttcttaactggggctctgttggtggggagtggatttgggagtcacagcctctattgtcagacatttatttcacagtttcatagcaacattgtcatgattagctatgtacatataactttgcaaccatccttaatgaatacctaaggatcatcctagaagtgaaatttctgggtctgagggtgtatacattcttagtgcttttaatacatactaccatgtgcctctagaaacattttctgtttctaataagagcagttgaaaattcctgtttccccagctatccaccatttgcctcatgattttctctaggactaaattttaaagtagagtctttaaagtagaagggagtccaaattccatccctttcattttataggagaaaaaaaattgaagcccatgaaggataggcgatgtgtcctctaataccagagcttctcagggggagagaagatgggggtggctatagctcccttctcctggccttaggcctgatatagaacaggtgcatggaaacgtccagcatagagaaatctacagaaacagaaagtagattagtggttgcctaggcttgtggatgggagggaagatggggagtgacaactaacgagtatggatgggtgttttggtggggccattgaaaatgttctaaatctattgcggtgatgtttacacaacactgtgacgatactaaaaattattgagttactttaaagaggtaaattgtatgttatataaaatatatcccaataaagctgctattttaaaaaaaaatgtgctcagtaaacatttgtagaaggacagaatagagggaggaaaacagatcaaacatccttgttccttcatttccaaccagtggtctttccactttctcactttcactgaagtagaacatgtctaaaattgtccccagctcagtgctgggtttcccctaggtgtttccctgtgtttcaggaatgtgtttttttagtaaacactaacctgcctcttccagaacttttgagtagagaattttttaaatctgagcttcaggccaggcatggcagctcatgcctgtaatcccagccctttgggaggctgaggtgagtggatcacttgagatcaggagtttgagaccagactggccaacatggcgaaactctgtctctactaaaaatacaaaaattagccagatgtagtggtgcatgcctttagtcccagctacttgggaggctgaggcaggagaatctcttgaacccgggaggctggggttgcagtgaacagagatggcaccactgcactctaatctgggtgacagagtgaggctctgtctcaaaaataactaaataaaatctgagcttcagccttttatattttcctgagaatctagctcagggctggtcacaaagtaggcacttgatagatgcttatttactgaaatactggtgaactgtatgtacattaaatattaagtaataaggcagtaatatagcattattttctaatattgatgcctaatttctccagctgtcagttcaagctctgtcaattcagttggcagttaacactctggcatttcagagattctgatctccccccttacatttcactgtgcatagtgagttgttacgggccccactttgccctcagtgcccgaaagcacaggactaaatttaaggctcagaagtattgactgcagcatctggggggcaaatctagaatccatgaagcttaaactttattcactttggaaggaggaaaggtcctctttaaaaataaataaataaataaataaataaataaataaacaagtgggggctgcgcatggtggctcacgcctgtaatcccagcactttggggcagtatcacctgaggtcaggagatcaagaccattctggctaatgcagtggaaccgcacctctactaaatatacaaaaaaaaaaaaaaaaaattagctgggcatggtggcacgcacctgtagtcccagctactcgggaggctgaggcaggagaatcgcttgaacctggaggcagaagttgcagagagctgagatcacaccactgcactccagcctgggtgacagagcgagacttccatctcaataaataaacaaataataaaaataaaaacacaaaattataaatgctaagtacagcaccttggaaggggcctgaccaaagaagcttcctcagcttcctgataagtctgcttgtggctttgttcgtttctctctccttttcattggatttaattttgtttttatgtttaaaagtccattgttagtagcaatttagcatcataagcctcctaattcttcttaaaaatacagtgcatttaagtaattgtgtaattaactacccacaccatctagacgataactagaatggtggggcatcccatctggagtggaggatgggctctcaaatcggtgcctaatgtgaaaatcacacatagtcctaattgtctttaaaatctcttaaattgcctgttaagtacagaatgtgtggttttatgtgtctgaccttgtcagtagttcttagacatactcaagtttgaaaatcactaagccagaccaaaggaaggaaaatccaaatgcaggtgcctggaggtaagaacctctttgccttatgaccgctctcaaatctctagcttgaacaaaggtaggtgctcacctgggatgttgactgcctcttgtttttgatactgagcccttataaacttaataaatgttaccagcttggtttgttgctatggaatttgaaaagatgatatatttgaaagctgatagactgggacttggcacaagaggtgctctgtgaatgtcagttggatttaaatctcatttgatcaggtctccatacacactgctctgctaaagatggtgtcttccaagctggtgtttctgtttgtggcctcactacatgacaatcccactcattcagggcgtgggccctggactcagcacctctttcggggtaaataaaggattccttttacctgagggagggttctcaagtctcccatttgaaaacatttcttcatgacaactacatgatgtaactttgtataaacaaaagttatttgaaatgaacttacttaataatttacttgctacatttgcttttttacttctttgtaaagcttaagcttagaaaaggtgcttctgttgtatttgcatttttttaaactgactcgagtaaggcaatgaatgaggtttccgaaagatgaccagagataaatctagctaaaatcagtctcaggacttgagttagttttgttcctacccttatacttatttcactgacataagtaatagtgtttcctactatctactactttgggggaagaaaagagagtccctttggtacagagttactaagcacctaaatatcagccctgtttgctgggcatgtgggattcggaaatgaataaatagtgcacagccttgacctgaaggtcacatatgtctgaagatatttagtcccctagatactttcttaaggagatgtaagggcactagctttcaatgtacttttgagggaagtaaccatattcctccaatgtcttcatagttacattgctttatacaaaaactctcttcgtaatagcaccaacgtctgcctaggtgttcaatccagacaccatgagtcacccagaccactccttcccttcacccccacaacagttgaccaccaagacatagtagctctaagtcccaaaatatccatctctccctcttactcctctatctctttcctggttcaggcctcatcacctcttgccttgactatcaccacttcctaaacttttctccctgtctcccattcccacttcctgccttttcccaatctccctgccttacccagcccatgttccatactataactagaaagggctttttaaacacaaagctaacaatggcaccctcctgcttaaattcctctgtgcttccccgttactctcagctgtggtcctgcacctttttctcctgctaatgtgcatgctcatatgtatgtgcattcagaggttcattcgctcatgcacggttctgagcatgccagctataatcttgccccatcactctggagggtgcaagccctcagtggggaacccctgccttagagcatgaagctcaagttccttggccttgcctaaaggttctttctgatctggcctattcacatctgcaacctcatttcctcccagccacgcatatgtgccctgttcatcagcctattccaaaccgcttacagtaccctcaaagagaccatgccccatgcgtttttacacattgctctcttttccttgaatactttccccccacccctcatccacccatttagcaactactaaccctccaagacacaacttaagaaccaccacctccaggaagccttccatgctccatttatgtccctattctctatgttatatgtccctcccctataagatcatttatggcttcatgcttatctgtaattaatagagtgttcaagtttatagcttgtcttgtgtgctagggaataagctccttgagaccaagaactttgggttatcaattgttaagatctcagttctttgcacagtgcttttcatcctaggaatccgctaacatttgatatttgtgggaggaaggaaagaagtaagagaaggtggaactttgaagctgtgatcattttctttccatcaaagccatagcaaaaagaacaatatttttaacatccatttaattaacttctataaagattttttgttgacttcatgaatcttaaaattctttattaaaagatcttttggctggtttcttcattctcacttttgaggatttgtcttaaagttatataaaggattcataggagagaggcagaggtggacagattacttggggccaggtttgagaccagcctggccaacatggggaaaccccgtctctgctaaaaatacaaaaaattagctgggcatggtggtgcatgcctgtaatcccagctactcaggtggctgaagcacaagaatagcttgaacccgggaggtggaggttgcagtgagccaagatcacgccactgcactccagcctgggtgacagagcaagaccctgtcttaaaaaaaaaaaaaaaaaaaaaaaaaaaaaaaaagatttatgggaacattcaatggtcccaggtttcaacaaaaactctgtagctctagaggatggtggccggaagttgggctttgaagtgaaacagacctgtgtttgaatccctcttggccacttagtatctgcatggctttggcaagttacctacctctctgagcctcagtttccatatctgtaaaatagggatactaaaactaccaactcctggccaggtgcggtggctcacacctgtaatcccagcactttgggaggccagggcgggtagatcacaaggtcaggaggtcgagaccatcctggctaatatggtgaaaccccatctctactaaaaatacaaaaaattagccaggcgtggtggcgggcacctgtagtcccagctacttgggaggctgaggcaggagaatggcgtgaacccaggaggcagagcttgcaatgagccaagatcacgccactgcactctagcctgggtgacagagcgagaccccatttaaccaaaacaaaaaaacaaaaaaacaaaaaaaactaccaacttcatagcattagtttgatttttttttttttctttttgagacaaagtcttgctctatcacccaggctggagtgcagtggcacagtctcagctcagtgcagcctcaacctcccgggctcaatcaatcctcccacctcagcctcccaggtaggtgagatcagaggcctctgccaccacacctggctattttcttatttttagaagagatgaggtctcactatgttgcctggtctggtctcaaactcctgggctcaagtgatcctccctcctcagcctcccaaagtgttgatgttataggtatgagccacctcacccagcctagtttgaaatttaaatgataaaatacatacaattgagtatatacacataagtatttaatgtatgatgatgattattattattacaaggacaaaatctagtgcatctgatcttaagctatggtttcatagtaggtgactgtgaagtggtggggggagtccttgaaaggagaaacaaaaaattcagtgggaacttagataaggagaagatggagaagtcattttttttcctaatctgtttagctcattctcttataattaaactgcaagattattccttcaactacaaaatggataaattattcattatattgacttgtttgaaaagatatcatagtttaaaattgaatgaatttctctttaatatgattttctggcaagattagattctaatgtggattaatatcctaaattgagagctctaattgaacactgtgggaaccaagcatgagtcaaagacatcgtccctttacaagtggcagtcaccgaggaaacgttcacttgtgtgtcagagggacacctaacatcagcaagagtaacagtagctgaggctgaatgaaggcttgctgtgttgggtacgcatgtcaagggagacgcaggacgctatttgcctcacatctccctcatcttgcagtcatcgccgtcctgtgccttggtggagtttttagtgtatgcagcttctgtgaacacaaggacctccccatcatgtccattgcactccctccatacctagcacaagtgcatggtccggagtagtgcccagtgaatatgtgtcaggacagtggggaagggaggaggacaataccctctaacggccccagagtctgtgccttctggcccagattcagtcagactccaccaaagtcagtctccaggactctgttttccaagtttgttcagcccttccccctcagctaacctgttcgtccctttgagccaaactcactgattagcattcagcttctttcactttcaatcatgccagacccggtgtttcatgcttaaccgttagggaaacatcctgtcttttaccatgatttttgcaggtggctaatatcatcaattattttactcactcaactctcagagggtaatcacttctttgattcaagtttcaaggccatctcactgtgggctcctatacatcaccgattacaccgggcagagtcaagcagaggtgctggccctgttctttacagattcatctggaaactatggtgctgttaatctgctctgtgttcatgctaatagtgtctgtctataatcaacctcaatctaccattcaccacgccaaaaagataaatgccagacttcagaaaatgaactaaaggcagccctcaaaccccagaaaatctcctgtccacccctgccagggcgcaagatgtcctgatttaggaggttgatccctcctctaattcctccttagaatgtatttcaaaatcaaaagccaatagttacatttctaagcaacggagcagaccaaaaatgttttgtttgacacagaagcaatagaagcaagaccatgtttctattttatgaaacctctgagggtaattcactgaaatcttgacatttaatatcacccaatcacctctctagcaagctattttctttggctccattaaccccacacacacagactgggctgctggcacttactgggtcttgtcgttaggtgggctgcttttaataccagggcaggatttggcaggaagaagtggcacctgctttattgaaagacatcttcatattttagcctctgaaagagaaatgtgcaacataaatgtccttaagagacgattatcgtacatcaagatgtccattccaaaaggcattgtaccagatgcccaatcacacacagtcacccagaacagacgtgacagatggagactttgagcttttaaagaaaacaaatgtgcaaattccaaagtgtctgtgtgctccaggccagcacatgcccaggtaatttgagttgtgcccattggctgaaagataagattcaggcctcagagagggtttggggagaggatgagtacaggtttcttgttgcccagagtctccaaatagatacacacaggatacaccacctcagcccagagatatttaagcactgagttaaaagaaaggattgagcatgcagcatcaattgatacattaatgctggttctctggcatcagggaagacattaacatacagaacttgtcttctccactgttcaaaaatgggaagaatcattccaacagggagagcagggaagtccaaaatccataatgctcaggtacaaagtaatgaaaccagaaatccagggtatttttgctattactaccaagggcctatcttcggtgtaatggcaatcttctaaatctctgcatagtttgacacctgcaaatctgattgagtctgattgaaccatttgctgtctaaaatccttgggagaccccgataacctagagctgtagctttcaaattgctccatgggctcgggccaaggcttccacagggactgagggaggaagggtacagctcttgggcacatccccttggctccagtcagaaaagttatttcctctgttttacaaattgagcttccaagtaagattttcttcttttctctttttatctgtctctgaggttgggtacagtggcatgatcgcagctgactgcagtcttgacctccctggctcaagtgatcctcctacctcagcctcccaagtagctatgaccacaggtgtgcatcacctgtggtctaatttttttattttttaattttttgtagggacaaggtctcactatgttgcccagactggtctcaaactcctgggctcaagtgatcctcccgcctcagcttctctaagtgctgggattacaggcgtgagtcaccatgcccagctccaagtaagattttcaacaaagagtcttgaggcttaaaaacaaagtatgtttgaaaagaaggggtctgcaggattaaattcagataagatcctccccattcttttttgtttgtttgtttttggttttttttttgtttgccaggctgcagtgcagtggcgcagtctcggcttactgcaagctccgcctcccgggttcacgccattctcctgcctcagcctcctcaatagctgggattacaggtgcccgccaccacccccggctaattttttttgtattttttagtagacacggggtttcaccgtgttagccaggatggtcttgatctcctgacctcgtgatccacctgcctcagcctcccaaagtgctgggattacaggcgtgagccaccgcgcctggccgatcctccctattctttatcctgtcttcctcttagacgttccccagcacacccagataatccagtcatgtccagtgacttccttctctctatatcaaagtttccttccgttccatttgcctggaatgttctcccttttctcttctctgcatggtaaatctgtattcttgttttaagattcagttcaaattttgccttcggagtactaccattcctgcttagcagcaattatccatattcccactgcatttgtgcatgtgttgacgcatatcgtattattacatgtgtctgaatcttggatcagtctgcacactcatagaatatagagtccctgtcttattctgtcctcctccatcttcctccagggcctggtatgctgtgggcactcaataaatatttgatggatggatgcttagctatttaattcaccactagatagcaatttggcatattcccaaacaattttattcagaaggaattcaaagaaataggcccacattctcataaccaactcaagcagctctatgttaacaaagaatataactacttctaactacttctgtttaggtcggagttttatttttttaataaaatttatgattgcaacaacattaaaagagatattgtatagaggtcacatgctgaaagcccatggacaacaacagtcttttaaattggcatggtttgaccctgccaatctgattgggtcatttcttcacttaaaattctcacgagacttcctgttgtctgtggagttcagaggtttctaggacacctccaatgctaaggcctccacatggaggcctgaatggaaaggaagtggctcagggtctcacaccttttgcttcagtcaaagaggttctacagaatcaaagtgttttttgtcttaatttctttttattggaatggctatggctgagcctgactctccaggtttccatagttcccaacacttgctactttccccatccatcttcacctgcttgattcctgatatttgagtttgcaactcaaaactcacccctaaccccagccctctaaaaccgttttcatttttatgaacctatttccaggcccagagcactatgcctatttttatatatacttgcaattgtattgcatatacaattttatattctgttttcttcacttaacactgtatcataaatatttttccagtatgtgagatgtgagacacagcctctgatggttactttttcttttttgagactgagtcttgctctgtcacccaggctggaatgcagtggcacgatcttggctcactgcaacctccgcctcccaggttcaagcgattcttctgcctcagcctcccaagaagctgggactacaggtgcacactaccacacctgggtaatttttgtaattttagtagagatgggtttcaccatattggtcaggctggtctcgaactcctgacctcgtgatccgcccacctcagcctcccatggttacctttttaaatgacaagtttttaagttggttggctctaatttatttaggtcttctgttattgttgtatcaactttttatttttttgctcttagaagtaataattgtgttgaaaatcttcatacatatgaattttttctaacaataaaagtgttcctcatattcccattcacaattgccacaaaaaataaaataaaatacctaggaatacagctaactatggaggtgaagaaactctacaaggataactacaaaatactactcaaagaaatcacagatgacacaaacaaatggaaaaacattccatgcccgtggatagggaagagtcattattgtgaaaacagccacactgcccaaagcaatttatagattcaatgcaattcctattaaactaccactgagactcttcacagaactagaaaaaaactattttaaaattcatgtgaaaccaaaaaagagcccaaatagcaaaggcaattctaagcaaaaagaacaaagctggaggcatcatgctacctgacttcaaactgtactacagggctacagaaaccaaaaaaacatggtactggtacaaaaacaggcacatagaccagtggaagagaatagagaattcagaaataagaccacatgcctacaaccatctgattttcaacaaccctgacaaaaacaagcaatggggaaaggatttcctgttcaataaatggtgctaggataattggatagccatatgcagaagattgaaactggacctcttcattacaccatatacaaaaattaactcaagatggataaaagacttaaatgtaaagcccaaaactaacctaggcaataccatttaggacataggcacagtcaaagatttcatgacaaagaagccaaaagcaattgcaacaaaagcaaaaattgacaaatggtttctaattagagcttctgcacaggagaggaaagtatcaacagagtaaacagacaacctacggaataggagaaaaattttgcaaactgtgcatccaacaaaggtctaatatccagcgtctataaggaacttaaacaaatttacaagaaaaaaaccaaacaacctcatttaaaagtgggcaaatgacatgaacagatactcttcaaaagaagacatatgcgactaacaaccatatgaaaaaaaacctcaacctcactgatcattagagaaatgcaaatcaaaaccacagtgagataccatctcacaccactcagaatagctattattaaaaagtcaaaacataacacatgctggcaaggttgtgggacgcttatacactattggtgggagtgtaaatttgttcaaccattgtggaagacagtgtggcaattcctcaaagacctagagacagaaatgccattcagcccagcaatcccattactgggtatatacccaaaagaatataaatcattctattataaagacacacgtacacgtatgttcactgtagcactattaacaatagcaaagacatggaatcaacctaaatgcccatcagtggtagactggataaggaaagtgtggtacatatgtaccatagaatactatgcatccataaaaaagaatgagatcatgtcctttgcagggacatggatggagctggaggccattatccatagcaaactaacacaggaacagaaaaccaaatatcacatgttctcccttataaatgggaactaagtgatgagaacacatggacacatagaggggaacaatgcatgctggggcctattggaaggtgaaaggtgggaggagggagagtatcaggaaaaataactaatgggtactgggcttaatacctggttgatgaaataatctgtataacaaacgccagtgacacaagtttacctatgtaacaaacctgcacatgtacccctgaacttaaaagttaaaaaaaaaaagttgttcctcattttagcacattccttatacgttattgattgtattattttgatgcaaatatatttcaatatgtttttcttttcacttctcatatttttatgattaaaatatgttaaatgttacccagatgaatcttttgatcacttccattgttatttcttctattgcttcaagctagtgagagttcttcatagttcattactaatagctcccaagatctcatgcaatcttcattctcttttcctttgattgctctatgtatttaaaaagtatgcatttaactctttaactcatctgagcatatttggcacatgtttaataaatggtttttacattgatcatatcattattattaaataacttctcctttgcccattgtttattgtacttcatataaccaaattgtcatgtataaataggtgtatttcagtgctgctaattctcctctactgttctatatgcctggttttgtgagtactttattaattattattgcttcataatatgtatagaatttatagtactgtagtactagtcttccccaattgaaggtcttcatttttcaaaatatcattttatattcttggcattttgtttgcctcataagtgttaaaattgctttgtcaagttataaaaataagtggcgattctgatttaaaatatatcagcttcttaagtcattgcatacattctaagcatcttatttttgttgttgttgttgttttcgttttcttatggagagagagagaaagggagaagttacccatagttgcatagttgcaccattgcctgagatatcctgatgcaactttgttattgacagctcacagaatggagcaaggttttttgaggcccaaagcttatatgagtgagaggagacttctttaagaaaaataatttttttattatactttaagttcttggatacatgtgcagaacgttcaggtttgttacataggtatacatgtgccatggcggtttgctgcacccatcaacccatcatctacattaggtatttctcctaatgctatccctcccctagccccccacaccccgacaggccccggtgtgtgatgctcccctccctgtgtccatgtgttctcattgttcaattcccacttatgaatgagaacatacggtctttggttttctgttcctgtgttagtttgctgagaataatggtttccagcttcaaccatgtccctgcaaaggacatgaactcatccttttttatggctgcatagtattccatggtgtatatgtgccacattttcttcatccagtctatcattgatgggcatttgggttggttccaagtctttgctatcataaatagtgctgcaataaacatgtgtgtgcatgtgtctttatagtagaatgatttataatcctttgggtatatacccagtaatggattgctgggtcaaatggtatttctagttctaggtccttgaggaattgccacactgtgttccacaatagttgaactaatttatactcccaccaacactgtaaaagcattcctatttctccacatcctctccagcatctgttgtttcctgactttttaatgatcaccattctaactggcatgagatggtatctcattgtggttttgatttgcatttctctaatgaccagcgatgatgggctttttttcgtatgtttgttggccatgtaaatgtcttcttctgagaagtgtctgttcatattctttgcccactttttgatggggttgtttgtatttttcttgtaaatttgtttaaattccttgtagattctggatattagacctttgtcagatggatagattgcaaaaattctctcccattctgtaggttgcctgttcactctgatggtagtttcttttgctgtgcagaagctctttagtttaattagatctcatttgtcagttttggcttttgttgccattgcttttggtgtttttctcatgaagtctttgcccatgcctatgtcctgaatagtataggttttctttttcctttttttttttttttgttttttgttttttgtgtttgtttttgtcgaagtctcactctgttgcccaagcaagctggagtgcagtggcacaatctcagctcactgcaacctccaccacccgggttcaagcgattctcctgcctcagcctcccgagtagctgggacttacaggcacaagccaccatgcctggctaatttttatagttttagtagagatgaggtttcactatgttgaccaagctggtctcaatctcctgacctcgtgatccacccaccttggcctcccaaagtgctaggaggattacaggcatgagccaccgcacccgggcatctaggttttcttctagggttttgatggttttaggtcttatatttaagtctttgatctatcttgagttaatttttgtataaggtgtaaggaaggggtccagtttcagttttctgcatatggctagccagttttcccaacaccatttattaaataggaaatcctttccccgttgcttgtttttgtcaggtttgtcaaagatcagattgttgtagatgtgtggcattatttctgaggcctctgttctgttccattggtctatatatctgttttgataccagtaccatgctgttttggttactgtagacttgtagtatagtttgaagtcaggtagtgtgatgcctctggctttgttctttttccttaggattgtcttggctatacgggctctttttaggttccatatgaaatttaaagaagttctggccagggcaatcaggcaagagaaagaaataaagggtattcaactaggaaaagaggaagtcaaattgtctgtgtttgcagatgacatgattgtgtatttagaaaaccccatcgtctcagcccaaaatctccttaaactgagaagcaacttcagcaaagtctcaggatacaaaatcagtgtgcaaaaatcacaagcattcctgtacaccaataacagacaaacagaaagccaaatcatgagcgaactcccattcacaattgctacaaagagaataaaatacctaggaatacaacttacaagggatgtgaaggacctcttcaaggagaactacaaaccactgctcaaggaaataagagaggacacaaacaagtggaaaaacattccatgctcatggataggaagaatcaatatcatgaaaatggccatactgcccaaagtaatttgtagattcagtgctatccccatcaagctaccactgactttcttcacagaattagcatcttatattcttatattattatacgtgtagttttctaggggtttactgcttgtgtataataatgtatatagtaatgtagtatatatgaaaacatggtgtatagtaatatattgggcatagtaatgctactgacctttgaattttaataccaaactgtcctctttctaaactggttgatttagttccaggtgtacagcaaattctttgtaaatattttttcttctttcccagtaattattgtcctttaagtcttttgcagtttgtctaaagcaatattatgttataatagtagctatattattttcaggggccaatttttgaaaaaaaaagcttttaatcttaatccattattgattcattatttaaaataggtatctttatcaagttaaggtagtaaatagtatcactccaagtaaaggttttatcaatttttcttttgacatatattgaaatagattatgtcatctaatgttaatataatgttagtcttttattgattttttttttttgcatttctttagtaaccttccttaagatcaaatttgtcacacagaataattagatggagtccggccttgtctgtgctttgatgcagtcagcatagcttgggaattatctgttccttgtgagcttggaggaatccattagatctgtatgccttgctttttggggatattctgaatttttaaaaaatttctacctccattactgctttaatagggtttcctacctcattgcgtcatttttaaatataagattgaattaaaatcatatatgtttattataaaatatcatccatttgttcaggttttcagtcagttagcatataattagacatagtattccatataagtggtttaattccttttgctactgaatatattgagtcagacctgaattctcatccaggttccaccactgattcatgtgactttaaccaagtaacttgacttctatcatcatttccctataaataggggtcatattacttagagtataggattgctgtgaggattacagatgatgtatatgaagttcttagcacagtgcctgtcctcactaagtagaagatattacactgttctctttcctaatgctgtttgtctccttttttgctgttctttaattatatttgcatgggttgtctatttttcatagtctttccagtattttcagaagcaacatataagcaatggggagccactgaaggaaagagtaccaactctgataatcgaatgtctgagcatcatttgtgggtggatcatcaaaagatgggtctatgctgtgagaaatgacagaattgacaagaggccatctagactcttcttgccaagcaaaatgtggaagtgtagtccttatattcatagtcagtaaacacagtctccagagcttgggagagactcttttaagggcttctgagagtgggaaattgaccaggcccccagttgtcctgtgcctgcatccaagcctttagggcctggaaacagagatgctgacaaacaccatgacccagactgaacccagcttttcaatgggacaacaaaatgagctttgttcatccttttgaaatggagcccaattatgtttgattaataaatgaaactctgtgtccaaataggagagacactgtagaaaaaatggtcagaaaacactttgtgtaagaaaaggctgatgaagttttcatcagagggctttcatttgcctggagctagtctcagacagagagaaatgttcagcttccaaatccttctcttgtttctcattccttttttttttttcttaaatatgtttaactctcctgcttaagatttattttgggctccttagcgatggatttgtgtttattgtgtcatttaaagaaaaatgcactattaaaaacactcctaatccatttataaatgtcaacagaaaaacaagtcaaaggttgacaatagtaattaatcaaacgatatttattgagcactttctatgtacaaagcactttctatgtacaaagctatatgctattaagtaagaataggaaacagtctccagcctcaagagtccttcagttgagctgaggaaatagccaaataattgactagctataatacaagggaaatggaaataaatattaaagtcagtacataagccacgctgtactgaagtacatatcccagggatggattagcaaggacttcatgagcaagttgcatttgggttgcatcttgaaatgtaagcaggcttttttataaggatgtgttctcttagatttttaggtgagccagccaatgcacctatgtattatgccccagatgtcagcaaacacaagcaactattctaagctagtccatcaaacccatgtgtgcacacaagcacacaatcatgttgttcccaggtcacctatggttactttcctattcctcattgcatttgtcccatccaaatgcttactcccaaacatgcctctgaacctcttcaatttgatgacctccaaagcttagcttcttaaatctggtcctttttacatggtttttggttttgcttccttccttaagttttagcctttcactccatgttgtcctggggaaagaactctcggctctggtcctctgcgcgtagggcccccatccctagccggatcaaatcttggaatgaggaagcgttggaagaattccctgtgttatccacccaggagttgtgtaggtaatacaggttctcctccactccctggccccaagtaagatgatgcttcagaataaaaacatgcccttgcatagataggtggttcccttcacagctggctccttaccagaatggagaacagtcctgctagcatggggttcagagtcttcctgtgtgtgcatctttccaaagatattaagaggagaaaaagatccaagtgaatttccaggtttctccaacactttaaactatacatttgatattcttaaccaacttgatgaacatgttggcctgtctgttccacacaccaaggaggtaaagagaaggcaagtgagatgatgagccatggaattccaactgctatgtcagtcatcaggctagaaaaatgggaggctgtgcattaatttcaagagagcctcggagaactgtctcaggataaatcagccagagtgactggaacattgtaccattttcaactggcaaatttattaatgaagtaagagtacagtctcaagccaactcctcttgcccctgtaacaaactccccctgtgagagaggatgaaggggatgtgtttgttagaatacttagaggccatgagtaacacaaagcctaaccaacagtgctttaaattttgtggacttttactatttcattaagtgaaaagtttggagataggtaattccaaggttagtagagtggctcattcatgtcatcagggactaagacatttccatctttctactctgccttttttatgtttttgtttttgtttttttaagagatgagagtctcaccatgttattcaggctggagtggctattcacaagcaggattatagcacactacagccaagaactcttgggctaaagcagtcctcccacctcagcctcccaagtagctgggactacaggtatgcaccacacccagcccactctgccatttgtaatatgtcatcagtggctccctttatggccacaagatcagtattagcatagtagttccacacattgcctccttaggtgacctgggttatttcttcttctcagagtgctattggccaggttacttgtggtattcaaatacaaatgggctggtgtaaagggtctgagatggtattattcatatgactggaaacttcaaggggtatcttgaaggcagggactggcaactgaagtgtctgcatgactcttcagcatggtggtctcagggagtcagactttctacatgatggcttggggtcctcaaaggcagtattacaaaaggcagaaagtggaagctgccagtgtcttaaggccggggcccagaaactggccaaagcagtcacaaagccccccacattcaaggggagataacatagacccccatctcctaatgggaggagtgtccaagaatttagttatctttgggtcacatgtaggttataagttaagctgttgtaataaagagaccaaaaatatgccgacttaagatagaagtatatttccccttgtacatcacagtttagaggtgagcaacacaggctggtggtctatttctgccagaaagttcccatatctggatccagcatgctttgtctactacttcttctcaagtggtgggaaagggaaaatgagaattgcagacaaacagcttccttgtaaaagataatccaaaatttctacacatcccttctgtttgcatcacattggctaaatgttagtcacatggccacacctgtctgtaagttattgccaaatagaacgtagggaaaatgggtattgaggacaattgttcatcaaggtggttaagaatatcaaatgtatagtttgaagtgttggagaaaattggaaattcacttggatctttttctcctcttaatatctttggaaagatgcacatacaggaagcctctgaaccccatgctacaaaagaaataggtagtgttggaggagattcaactctagacaatgaagttggcatctgtggtggtttatgaatcaaccctgtacctgcaaagggttttcacatctggggctgggtggtaaatcatagggtgctctgaacagatctttaagtattgggctattcacaaaacagaagcaaacaatgtgcagatgcctccccccatgaggagtagctgcctatttgaatctctcactggatggtaatggaaatgatcagttgggttcacttggtagggtactccttagaaatagctaatgaggtttcttattgtcttagtctgttttttgtttctataacagaataccacagttagcttcatagttctggaggctgggaataccaagagcatggtgccagtatctgaggaaggtcatcccatggcagaaggcagaaggcagaagtgattgattacatgaaacatagaggcaccaggggctgaacttactctacaacaacccactcttcaaataactagcccactcctacaataacaacattaatccattcacaacccaaattacctgttattggaccccacctcccaacaaggttgcattggaaattaagtttccaacacatgaattttgggggaacacattcaaaccataacatttactctgaacttcacaaagaccacaaaagaattagttgataaagaatgagctaaatagttgactaaatggtttagcaatcataaatataaagcagcataactattgtgttaaaagcattactatgaggcagatatagcaacagcatcagcctgatctaaccaaacaatgccatctcagtaggatactggtgaagccattccctaggagaaggtggcgtgcgtcataggtgtttgctggactttcttctgccttattcctggttcagagaaactcagtgatccatttttcatcccactccaaagcagatcagatggttgtcttgcttgtatcagagctaatgcttccgtggggagagctctctgtttctgcctgcaagtgctcacagttcggttgtttcagccagcaccaacatttgtttcttagatctaaaagtagccctattcctgtctgctttatatattggagttctgagtatacttttgtttaacaaaatgtgttctattacgtaaagaaaaaaaaagattgatagctattagcttaggaggcttctagaactcagtgcacagccagctcttgctctctcatatatttttacaaatatcttcaagaaacaaatggcctttccactggctcttgagggataattttaataatatatttgcagaaatatttgaaatggaataagggtattatgactgtagacttcacttatttattgttgaatcttgtagcttctgtattaaaaagaaagaaaaaacacttttattgaagacagtatgtcagaaaaaacatggattttttttttttactcaaaaagacttgtgtttaaatataatttgtgccacttattagctctgtgatcttaggcaaaatattgagatctctgagtctccattttttcatgtataaaataaaaataataacaattcctgtaatatactgctattataaggatagttagctaatttatgtgaagtgccaagcacagtgcctaatagtatttgtaactactatttattgaacccttactatgtggcagacactgtctaggtcaatggttctcccttggggacttgttagaactgcaaattctttatcaggccccagcctacacctactgaatcagaaaccctgggggtagggctcagccgtctgttttataagccctcctggtgattctgatacacactaaagtttgcaaaccactgttctgagtgtccaagaaattgaatgtatgattatcatattcatattacactacagctaataatttgtgctgaaacaaatatagatatgtcctcttctattttgtttgatgacagccctagatttttcccaccttagtcatatctgtgaccattccttacaaggagataggcgacctggaaaacccaaatatcatacctccttctccctcccgagtcctctcttcctcccctagcgggtctgcatcctgtctgtgtcaagcagtttatgaaatacctggtgagaactcagccactccagaaagaatgaatagctcctcctgaatgcagctccagcacctggagtcagtatctccctgacttgccattatgtgttcccattggtccccctgataaaatatgatctccctgagggcaggaacaacatcctaatgatttctgtgtccccagcacccagtacacttaatagacacctaataaatgagtggtgaatgaatgaagtgtcagccccaaatcagagggacatttgttcctggagcattcaggtgttaggcataccctagcagccagtatatttctagtcatggtgacaagtaggcaacgggattgcctagagacccatgaaatgttatctgagccatgtcttcattcatccataggatcagttctgtgccacaaggaaagctgtgtgacagtctcatggcagatcagacccacattaggaacagcctagaaaagcaaactgcaaatatccatttcttttctctgtcataatttgttttcccagttgctggcgaggttgaaattagctctgtctgttgacaatttggatacaataacctttctgtttcgtgaattctgaacagtgaaggactgaattctgctctgggctgcagaaaaataacaaagcactcagtaggatagatgggaatggagcacggacttagctgaggaagaatttggccctgctctggagctctctttgaatttattattcctgccttccatgtcttttcatgctaggtgggtgtagaaagccatcctgctcaccactttgtcccccacccactgccacctatgctgtcagccattcatctaacccacttagaagaaccagaatgaatatagatttcttctttcacacattaatttatggagccttcctatttcttctcattgcaatgttcctacctgctgcagtcacattcaattttattgaaaagcagcagggaattcatcctttgctggaaaactttgacaattaaattcaaactataaggaaaaagttatcctagtttcagtctctctttaaatcaaagtgtagacagtatgtagtgggttatggtgaaaggcccccataatgaggagagcaggtaccctctaagagttgaggggaaaaatcgatgcagatgatatgagttaaaccacatacagaagtgaccctgagatctggattttaagtggatgatggccaaattccaatcacaactggtatgaatcctctaaagttgaatgtttgtcataaaactgccacctatttgggtcatattgtagcctgcttgaagaaagatctaactaggagagggtggtctgcatgacctctagaaagacaggagtttgtcggggtcttctgtgcagtccaagaagatagcatgaccagatgacatgatgtgtttatctgcaagccagatctattcccataatgggaggtaaatgcatttgacttagatagctccatgatgtccataaaaaccattcagctaaatacctttgcttcaactctgtgcttcccaggcaatattccattaagattatggcttatcatgaagactttcctccaacccaggcaacatggtgaaaccccatctctacaaaaagtacaaaaattagctgggcgtgatggtgtgcatctgaagtcccagctactcaggaggctgaggtgggaggattgcttgagcccaagaggtggaggttgcggtgagccgagattgtaccactgcactccagcctgggcaacagagtgagcacttggatcaaaaaaaaaaaaaaaaaaaactttcctacatatggaggctgtgttgccccacgcccataagtttacataaagtccacttggcattcctgtttctcactgttgggcatgtcttctacatcttgaaagtttgggtagtgtgagccagttcctctggttgaacccttctgcacataccatcaaattcaagatctggaccaggaaataataggaccacactccggacatggttcagtaaacatcctaggtaacaaaactcttgaattcaactgtgagaaggtgatttttcttccctatctctgtcttcagaagaccagcgttaaagttgactgataatcacagccttttttaaaaaaattcttactaaggtgacattgttaggctgttttgggcaatcctttgaagtggtttttcctcccaaattttctaatttttgttcattatatatttgaaaagaaattcaaattgcctgataatagaaaatgaaaacatgacaagctataaactctgaccttaaaagcatctctaatatagcatcataaaatataattagaaatccatttcaacatcacattacagatctatgacttacaggtaatttctgtcatttaaatatgagggtgagctgatggctgaattggattcttaggagaaaaacaatttcttctgcattaggagttattagtttaattgaataatatctggatcatactggtggtaatgttaatgttattacccattatcttggtgatggtcacaccactgtttccaggaaaaatatagcccattaactgaacagaaggattaaaataggaacaaagtggcaagcttttcatggcttattatgccagggtcaggacaaaggaatggccctgaccttgaaatgggacagaggacccagcctgagctaaatgcctcaaagaattccaagggaagtcctttcaggcatgacagagtgcatttggtttcctcagcatgtcgttctgaacatttctactcattaatttattcatttattcacttactcgttcattcattcaaccagcccattcatttattcaaccaacatattttgtgcatcctcctgaaaccatgaatggtgatagatcatggagagacaaagatgacttagtcaaggagagagggtcaaggcttattgagaacctgctgtatctcagacattataatgggagatttcagacaatatctgttttattcttctcgagaattcagaaggtaggtagagttgttatacccattttatacatgaagaaactgaggttcagacaggtaaaatgacttgtccaaggcctagaaagggaaggagtcagaactcaaacctaggcctgtcttaattcaaggcctaggctatttctactacacctggaatttggacttagaacataaacacatttttaaaacattataatacagtgtgatgaatgggatacacagtcatataaagcaagacagctgccacggcgaaagccagatttccactctaagtgactcatccgacgtttttaggtaataggaaatgtctaggtggccctaatatgtcctccaaatctcttcttcatcctcagccccacacccagctctccctccatctccttcttatcaatggggggttctctgctccccccatcttcacaagcgaagggcatttgttcttccacaccccacatgatgcagggcaagaggaaaggtcaggctccacctcattctcatcacctcctcacctctcattagaaccgtgatcctgtgagcctcctaatgcccagccattaactagcatctgtcctcctggtctctgctacctaccagccttctggtcactcccagccctcagtgaagatgttggccctgggatcactgtcttatccaacccaagtagctcttcctgggactaggaccactttcagctgctgtgaatactggagtcatgttggcaccatgagatattttatcatcctatgaactcatttgggaactcaatgacaggtgatacaatggcctaagcccatttcaaagagtatttctgacaaagctttgtgtaagtacaaaaaaaattttcagaccatgctttttcccattataacatttcataatctcttccttgttttgtccctgcacctctacctccattaaccaggtctcatcaagttgtgacataagccaggtttcatcaagttgtgacaggtgacagaggcgtcacatgacaggggacctgattaggaaatccatatcctcataggatgcactttaacatcttcttgagctgtcttgatattttgagacatacggcaaagattccatatactgttccagtgaccagtgaccttgagaacatatttaaaactatagatttctgtgccccacccagagatcccaattcagtagcgctgaggtgggatctgaacatgagtagacttagaaagcctctagctgattctgaagcacagctagtttggggagcactgacatatagccactgcccatgaacctggatgttcctaaatcttgataccaattgagtgacttgaatcctccctcatctgtatgtataccatcatcaggtcggaaaaatacctccagcttccagcttaaggttgccctctcctttcccaccaccagtaacatgctagtaaacatttaacaataggctctcagaaagaaaaaaaattaagccctgatttataatgtttgccagtttccatggtgtaaatactctcaccagggccaatttccagctaccaatgtgatgccactgaacgtagaggtgggaaaagatgcatgtaattaacattccttagacagaagtcagctccagcacatcactgtcccacccatcctttactgattcccaaagatcaaacaaactacacccaagaaacagaggggtctctctcagatcctacagcacagccagagcctctcagaagtaaggttgtctccattttttaaaaagctctggcatattaaaaagtggaaaagtgggccgagcatggtggctcatgcctataatcccagcactttgggaggctgaggcgggtggatcacttgaggttaggagttcgagaccagcctgcccaacatggtgaaaccccttctctactaaaaatacaaaaattagccagtgtggtggcacatgcctgtgatcccagctacttaggaggctgaagtaggagaattgcttaaacccagaaggcggaggttgcagtgagccaagattacaccactgcactccagcctgggcgatagagtaagaccctgtctcataaataaataaatagtggaaaaagtgctactgcaagattggcaaaattggggtaacgctttaacaccaaaatacgatgcaataaaattgtattaatctcaagattatttataagaattataaaaatattcatttatacttcaccataaatggggtcaattggtagcaggacatgtggaaagccgtaagatgaatgtcattcggttctgtcggtgtatctctgtgactctggagaaaatgccagactctttatctgaggcttttgtgagtgtgaaaactggggcataccccctcaccactccgaatcctgtctccacccttctacctcccaccctcacgccctccccttcaatccatgagagaccctggacatagttttctccctcctaccttctgttctttgcctctcaagaatttccaaagctaggtgccctgccactgggtcttatctgggtcacaaaatagccaagtgacaagaattaaatgtaacaagaaaacactggggggtccaggtcccttctgcaccactgaggacctgcagttagttactgatgacgggctcttttatctggctccagtctggcaagagatctggtggagaattctttctggctttcattttccttatttctctgagccatttctggcaggaatgttataagcaaatcaaattttgatcagttgaagactatttgaagactctaggagctgctgctgattcattcatttattaaacaaacatttatttaatacctcccttgtgccaaatcctgtactagacagtggggaagagggatagagagaggagatgaagagcacacagttcctccccttgaagcacggagagtggaggaaatggatacatgatatgtaagggggtaacagcagtccctgaggcagatcccatgacagggtgcaacgtagggtaccttggaagcacagaggaagggtggctaagctaaaccaagcggtcaggaaagccttgaactgcattctcaaggacaagtaggcattacctaggtgagaaagggttaaaaggattaaaagggagatggtagtttatgcaaagaagcttaaaaaaaacaaaagctatgtggttcgggaaactgcaagtagaatatctttgatatggaggaccctgggttcagaggctggttcctttgcttattagctgcatgaatgggactgaatttagcttctctaagctgcagtttcctcagcaggaaaccccaccttaaaggactgttagtatgcagatgagataatgcatgtagcactctcatatctagcatagaggccatacccagtacttgacagcttggtgatgaggatgaagatgaggatggtggtggctggcataaaggatacacataagggtgaaagactgagggagatatgaggccggagaagtaggtggggccaaagggtgagcccttgggctccatgctgaacaaaattgggctttacccctaaagccaaaggaagaatttcaagagtggagtagcctgatcaagtgtctgttttagaaagttctgtctgatggactgggtgcagggagtaaaacgggaggcaggaactgattttggaggctcttgcactaatgtaaagacagtgaaggcaatagacatggcacggatggagtgacggaagcctctccagggtgtggctgagggcgccattcctttatgatttctcaggctatggatgtgaattttcctaagccaggtctgctcactcacagcagggcccagctgcatggaggaatatagaatccagggtattatcattagaattaagctgcttcgttgagtccataaatgtcacactcgggcataccagcatgtctttttttctggcttacaatgtaaaaagtaacaatggttatctgtgggtagtgggattatgaattgtttttatattattccttttgcctgtgtctattttctaagtgttctacaaagaacatattttgtatacggaaaaatttattataaaaatgtttttttaaaaaaacaaaactatacatagtttcgatccaaacagcatcctctctccttactgcctgagtaaggaaatgcttgattgaattagaaatgggaggggaggttgttgataggatccaacttcaaacttctaagctatttattttcttccttttgctttggagattgtgctgtgccaatgaagatagactgaagacgtgaatagtcttgagtttgaaaaataatcgtcgtttttattgttacagcttcaggcatggattatttccatcatttatatttcaggaaacctcaagtacagcaaaattgcccaatagttagagaagatcggattattgatactctctttttaaagaaaataaaatatcttatcagagagaagtccaagtgacaataatatcaccatacgtctacagggttgcaaaagtaaggagttgaaaggaagctctggtttaagtacgtgatgtttaagagaactgcagacaggggtctaacagctgagatttttcagcaccatgttctaaagcactttcttgctgggcctaaatcaaatgtttgtctatataatgtcttagacattgtatgcatcatcgggccatcttcctaaaaggtggcattttgattacaatcttcaatttggatttttaaaaatttgtaataccagtaatgataaatagtgcacatagttgtatggttcataaagtgttctaacatttaatctttacaactctaagtgtttgagttcactttagtccattttagagatgaagaaggtaaggctcatagaagcttactgactggcctgagatcacacagctaggaagtagagagagaggattcagatcaagctcttcggacttgaataggaatgccctttacactgctcccttctaatgacaggttttagttacagatgcctctttacccaccatggggttacttcccagtgaacccactggaagctgaaaatatcctaagtggaaaactgacattttttaaaacataatgggatgtgaaaacacaaaatacaatatccaaaaaatgctggcaacacagtacactgtacagtatcggttgtttacccttgtgatcgagtggttgactgggagctgtggttcactgttgctgtccagcaccacaagagtatcatatcacaaattgctagcctcagaaaaggtcaaaattcgacgtacaatttttactgaatgcatatagctttcacatcatcataaagtcaaaaaattgttaagccaaactatcttaagtcagggactgtctgccttttattttcattagactcactaatcaaaaaggcaagcagggcccataggaattatatccattcctgttgctgttgtaacaaattacccacaaatctggtgccttggggtaacacaaattggttctcttacagttctggaggttagaagtccaaaatgagtcttacagggctgaagtcaagatacaagcagcgctggttccttcgggaggctccattgcacagtcagtggctgccagtcttccttggcttgtggccacatcattccaatctctgcttccattatcacagtaccttcccctctcctttagtcaaatctccctgtgcctctgtcttgtaaagacacttatatttagggcctaccctgataatccaggacaatctccccatctcaagatcattaacaatatctgcaaggcctttgtggacatataatgaagcattcacaggatccagggatcaggatgtagatattttggggggccgttactcagcttaccatggcaatattcgtttcattcatttatttagttattatttagttatttttgtagagacgcagtgtcactatgttgcccaggctggtctcaatctcctggcctcaagtgatccatctactcagcctcccaaatagcagggacttcaggcacaagccactacacccagctttatttcatttattaagtggtccctaaatgtaagattccctgaatttaaatttaggccatagctcttcacagttttctattttaacctttcacttttgtgtgccttgaggccttagtatttgtttgcttgcttgctggctggcttttaagcaaatttaactctgactttctattgaaaataactcacccaaaacccctcctcctgctctctgtcagggatggatgcagaccactgactttttccaggccaggcttggaaagggcttacagagaggtgcattctttattgttcggcctctcctaactactgccatttattgagcacttaatatgtgtcagaaactttgaaatcattctacatttatttacagctcatttgtaccttggaacaggcctgtaaggtagattattatccccattttaccaatgagaaaatcaaggctcaaagagttaagtaacattcccagggttacacagttaagccacagaccctccaaaacccagcctcttaataccatgcttttgcaaaattaaataattcccaaacctgcgtaatgtatagatctcttttaaagggcaaatacaagctcacaaacacccaaggttgagttataaggattttcattatcatattatttaaatatgtgcaaagataaccagatatgaactccttatgcttatagctctcttaagatgataaaaacaaaatagtgatactaataataacacaaataaaactgcaaacactttaaatgctaattaagaacattgctttaatgtgatgggtgatgctgttttgctgaaattaaatgactgctcacaatctcgatgcaatgctgaccctcgtagcctgggtccttccgagtttggtatgcatacaccagggccctttgggctaactcagttctcccactgttcttccaaccactgacaacacattgttcaggcagcagcacacgtatcctttgggctttacctagtcaaaatgtctttgatttgttaactctgctttccttttagaacccactctctttagcagctgggttctctgggaaggagacctgcatcaagattagagtgcaggaagttaccaaagaatgttcttgggaaccacagctgtgggaggcaggggaaggaagcaggatgtgcagagggagaagttgagctgtgtcgcaggcccaacaaagacctctaccaaccaactcactgggctgggtggctcttcagagttgtcctgccttggggacaagagcactgacctttgtgcccctggaggatcactggatgagggtcaccctggaaggaagtttgacctcacattaggctgtgttatctagccaatgccaaagaactgacagctaagagcaaccttttaccatcatccctgcagctgggaagtaagtccttcactcctgaagagagatctggacagagcgtcacattgtcttccacactaacgcacaataaagttgtatagggcaaccgtgagatgtgaaaacaaatgcatcccagccactgaactgcctggtgatgcttgactagatctttgagatgatccttaatatgtacacaatctattattttattctcacaaaaatataaatataaatgtttaaattcccacagagaactaagaagactctaacaacatatttacaggcccctagaggtcttcagaacctactccaagaaagaggaaggttaggaagcttccaccccagttacctctgctgggaattgctgcatatacctgtgatatctccgtggtgtgacaatcacaaagttttacgaatacttctttgggtggcagtaatcatgatggacagatcctctcacaattcacatgtaatatttgggaataaaaacttgattgaacattcattcaacatatttgatcaggcacatactatgacgtgggtactttgctagacacctggtggggaagatacctttatacgagtgaacaaataatcatggacaaagaggatctgagagtcttgggtcatcagtaagccttttcagaagaggagtggcttgaggggacaagggcaggagcattccagacagaaggatccaatgcaaaagcatgagcctttggtgcgtgggcatgacaggtgatgtaggagatttggtcaaaaggtgggtcaggcagtagtgagaggtcgcactgacagaagcggagtggagagcctgccagtatgattaagtcatcagaggcacccccttcattactattcacctggccctgactgataccgtctcatttaacctccatgcactgtgattaacccagtagggaacaagctccacaagggcagtctgtctggtctactgccctgtgacgggagcccagcacagtgtccgacccagaaaggagctcattaacatgtgttttacagacaaagagtcaggttcagagaggacagcactttccccaaacttgcgcagcatataagtgaccaagccaagagctgaaccctcggtctgcctattccaccataccgctcttcaattcctgctccgtgagccacgaaaataactaaaagagcgttttcacagtcagagaaacttctgttaccatgggaaacctggaagagaggccagcctgtgtgtgtgtgtctgtctgtctgtctgtgtgtccgtgtgtgtgtgtgtgtgtgtgtgtgtgtgtgtgtgtgttctcaaattcctagaacggacaccctttagtgtctgccacaacacaaaatttctcctgtcatctcccaagtctctccccaaacctcaaatatgtggggtactcgagaatgaaaagggttaacctttcacagcttaggagagctgttactttgcatttaaatagccgcatttaagaaagcagcattcccaggatccttatttgatactaatgtgctgaacaccttaaagcacacttacttctcccccattcgggtcacttggagcttcattacttaataatttgaaagctttttatggaaatcagttgataaagggagatgatgaagtgaaatgttattacatttaaagacccagcaaactaggctgccagaataacacctgcgtcagacatttctaagtaaagaaagagaaggagaaggagatattggtgtgtggatgaattctcatttcttttgaaactgccgttactttaaagatactccttgcctaacaaagcctaacactctttaaaattgtcaagtgaagaactcatcagctatcttatgaattctacccctgccatggcgctctgtccccctgcccaccttcccagccgctgccttggcttcaagcccattgggtctagaggtccgccctactctcctccacaggcagggtcagcctcacacagtgcccacctcaaaagccttcatgactaaccagttgagaaaaccctgggaaacaggcttggatgcgaccttttctttttactttccatttttctttctctctctctttccttccttccttccttccttcattttttcgtggtggtggtgagacagggtctcactctgtcacccagactagggtgcagtggcacaatcacagctcactgcagccttgacttcctgagctcaagcgatcctcccacctcagcctcctgagtagctgagtagctgggactacaggcatgtgccaccacacccagctaatttattttttatgttttatttgtattatttgtagagatgaagtctcactctgttgcccaggctggtctcgaattcttggattcaagcagtcttcttgccttagccttccaaagtgctgggattacaggcatgagccactgtgcccagccgccactttttttcttttttttctttttttttttttatttgagatggagtctcactctgtcacccaggcttgagagcagtggcatgatcacagctcactgcaaccttcacctcccaggttcaagcaattctcctgcctcagcctccggagtagctgggactacaggcgcatgccaccacgcctggctaattttttgtatttttagtagagacagggttttaccgtgttagccaggatggtctcgatctcctgaccgcgtgatccacctgccttggcctcccaaagtgctgggattacaggtgtaagccaccacacctggccccagcctccatttttttaatggcaatatattcacatggtttgaaaatcaaaagatatataataaggttacacagtgacaatcctcagccttttgcttgctccctggttacctagttcccttctcctgaggcaactgatttttgtaatgttcttatatatccttccagagatactttatgcaactagaaatatatacacacacaattttctttatccttaccacccctctccacaaaggtaaatagattacacaaatagattactatacaaactgtactgtagtttgcttttaacatttaatatatcttacagatactcttacttgtgacatgacttttttaatggtgaatccaaagactatacagcaatgtctaaaaaaaaaagattcaaaagtatatacgtgtgtgtgtgtgtgagttttgtgcataagttatgatgtcaactatgacaaacaaatgaatattgcaattgatgaaagctgctgggtaaggatggtgggattatagggtcattctttttgtttctctctcctcctacgccgtgtgtgtgtgtgtgtgtttgtctctgtgtgtgtggccaaaacatggttatgtttttaaattctaaagaccttatttcagtatgtgaggtatattttcattttggtagagttctttcctggccctttcatatgcatcagcatctgtttcttaaaatacttgagtcactttattggtgaaggcttcctccaccactctaaaattgcagcataactctctcaccccatcctggccctccccctcacccttcccggctatattttccccggagagctaatcagcactggacacactgtgtagctgttatgtctgcctcctcctccggaatgtaagctccttgaggacaaggatgggtgtgtcttctgttcagggctcattctccagcacgtggaataggcctggcacagactaggggctccatctatcattgctggatgaatgagtcctcaccatcagccccagcaacccaacccacatgctctctggctcatgcctgtaaccactaaccagagcacctgcagataaccagtaaccagagcatctgcagctctgtcctctgcttcccttttccctccccactctggcaactctggaagaccactcctccctcccaggtctggatctcaccttagggatccattcctgcaagtgcaccctccctctctcctgcaatatgagcttatcttctatattggattatacacttggacatacaaacttgccctcatatcacacatctttcaaaaaataatcacatgtccttcctgctactgccatttttctcaactccacagccgacttctcaaaaagcgctgtctgggcttgctggttccgctaattcacctctgtctttcctgaacctgcttccattgtattttcagtagtggccagtggggcagcggcggcagcagtgagcacatggcagggggggcagtagggcagcagtaaacagaggccgcagaggtagtggggtaagcacagggtttctgaagaggccctgggcaggtcctggtgtcctcctatctctctggccattataccttagtctgctttgctctcccccatcctctcctctgcctccattcactccccaggtaatctatcctgtggttttaactaccagtctctatgctgatgacttggagtttacgtctccagcctggacttctccgttgagctccggcctcatatatctaccttcctacatgacacctccttttggagtcatccttgacccctctttgttttatacctcacatccaatccatcagcagataacgctgagccgacctgtaaaatatatctgcatcccatgccttgaaccccttccattgctcttccctggccctatgtcgccagacacagcaatggcctcctgcctggggtccttgctccccagcttgccccactccagttactttccctgagcagccagcaggatcctttaaaaatatgaatcaggtcataccactcttctgctcacaaacccctcagccatgttccagtcccatcacactctgaacaacagcccctaaaccctctgggagggcagccaaggccagagacttcctctagcttattattaactaattgtttaattaactaattcattatttatcccttaaatattccctgcatacctctcacaagccaggctggtgctgaggatatagaagggatgcaatgcggcccctgctctaatgctggcttctgggacgggacctgccctgggatggcagtggggatgggaatcatggttgaggagtgtccaacactgtttctttttctttttttttttttttttttttgagatggagttctgccctcgtcgcccagtctggagtgcaatggtacaatctcagctcactgcgacctctgcctcctgagttcaagcaattcccctgcctcagcctcccaagtagctgggattacaggtgcccgccaccatgcccagctaatttttgtacttttagagatggggtttcaccatgttggccaggctggtctcaaactcctgacctcaggtgatccatcaaccttggcctcccaaagtgctgggattacagtgtgagccaaagcacccgacccccagtgctgtttcttgaagactacaggatgtgttcccatggggtagggttaggggtgctgaaaggggcactacccttacaggttgaggcacctccagtcagatctggcctggatcatgggctgggcttcctcacagccctttctgtttgaaggcagacagcccttgcttgatgttctctcctgtttggatttggcatcacctacgtgatgttcgaataccttctgctgtggcccccttttcccttctttgctctggccttggcactaaggtttttctgactgctgaaggtcaggtagaagatggggaggcggaccacggaagagcaggtcctgggggctggtgggatgggaggcaggcatgccccatcagcctcttctgctcctttgctcactgattttactcaggggagcagcagacttgtgtgagcactaaaaagaacataataaaaatgcagaaaatgaggttaaatccaggatggtacttcagttaccaaaggacaagctaagtaaatgccgatggccagtgccagcacacagaaggtcatagggtgatgtgagtcctcagagctcccacccaccggaggcagcccttgggcggaggggcagtggggcaggcccggaacagctctgatggtcccttcctctctggcttcagaaatgccaagctgcttccacaaaaccatctcaggggaaaatcattatctacggacattatgcaattttcccatcgaaattacaagctgtgtttgaaaagaaataaaaagaaattgaatttgaaatgcttctgtgcaaacgcatcatcttctagtggatctgctaatgggcttcagatactttctcttgctctaaaatagttgatcagacagcagcttgtgatggtggctgcttcccggggaacggggcatagaatgagcacttatgaacggccagccagcccacctgagccaggttcagaacctgtgagctctgaccacggttcccaaagtggtcactgtatgctgtcccttcccctcctctacctggcagtgctggcacggctctatgctgggactctcactgctcctccagcgcctccagctgacacccaggtcgatgagtgtcacttcacactgcgctggctccatcctaggtccagggagtgcccacggactgggcctcggaggacaccagccccttcctcatcacagcctctcattcacccaacaagtattagttaagcgtgttcccaacacagatctaaacactgatagtacagcagtgagcaaaacagacaaacaccctcgccctcttggagcttccattctagcagggggagatagacaataaaaagtaaataaggcaggacatggtggctcacgcctgtaatcccaacactttgggaggctgaggcaagcagatggcttgagcccaggagtgtgaggccagcctgagcaacaaagcaagaccccatctctacaactaattttaaaactaactgggcatggtggtaggcacctgtagtcccagctatttggtatgctgagggtagaaggatggcttgagcccaggaggtcattctacagtgagccatgattatgcccctgtactccagcctaggcaacagagaaagaccctgcctcaaaaaaaaaaaaaaaaaaaaaaaaaaaaagtaagcaaaatgcacagtcaactggacaatggcaaatgttatgaagaaaagatagtgggataaaggaatagggatgctgagtcaaaaagggggcagggacctgccatggacatcaaagtcctcactgagaagttgacatttgagcaaagacctggaggaaacaaaggagagagtgctctggtatctgggagaacagcattccaggcacagggaacagcaagtgcaaggtgtgcctggcatgtttaaagatacataagaagtccaggatgccgaaacccaggttgtggaagagtagtaagagatgaggctcaggaggacaggcagaccatggagggtgtgggggaccagagcaaggtcctgtctgctgtgagatgcaaagccactggaggattttggccagaggaatggcatgatatgactgctgcacgaacaagagtctggaggaagggaggggaggtagagagacctgctaggaagcaactgcactcatctagctgagcgatgatggtggcttggatcaggatggaggcaggcaggagacggaaagtggttggatcatgaagatattttggaagtggagttgacagggtgtgccgatggatcagttgcagggtgggagagaaagaggcatccagggtggatggaactgaaagtacggcattgccatgtaatgggatgggaagaatgaaggaggctgggcttagggaggggaagatcaggagtttggtttcaggcacgttgttgagtttgagatgccacttagatacccagatgaaaatgttgagtggctgatatgcaagtctagagtcagaggctagtttgcaatagaagattacagcttaggaatcatcagcatatacacagttggctttttaaggcaggggactaaatgaaatcaccaagggagtgtggataaaagagaagaccaaaggcttgagccctggggcacttcaagctttagaggaaagtgaataggagtcagcgagggagactgagaaggaagagttgatgaagtggaaagaaaatcagaggcagcaagtcccagagccaaggagaaagcttttcaaggcagagggagtgagtgaccagctgtgtcaaatactgctgaggggtcacaagagctgagagctgggcactgactttggctttggcacggagaggtcactggtgaccttgacgggagcagtgagtctgctgtcagaggagaggtgagtctcagttgcctcacctgagaaatggggacaccctcctgccttcctcagagagcagcagtgcagaccatgggcaaactgcaaagtgccaccaaatatgagctgttttatttatgacctgagaagcccagaggctgttgaaatgaggggaggctactgttgggcacaattggttttaaagatgcttacagccccgttatcacctcataaaatggctcatttcttgctactcatcaccagaacactcacccaggcatgaaaaagttaccttcagaggtagaagctgtcaggatggatattttttgtgcatggcaactgggaaagagaaaaagcaaataatggggccaaatagtgctcaccggggtctccacgcaagattccagacactgctctcccagagggaaccccagtgatcctgtgcctcaaagcaagggctccttggagaaagccaccaaccagggtcagctgtgctctcactgcaaaatgagcaacatgggggagggaggagagaaggatggagaagaaggacagtcagggaaagtggaaagaatgtgagtttggagtcagatacacatgcgttggaatcgtggttcctgtgtggtcagcaaatgacctgactcctctgagccacagcttcctcatctgcagtggacagcgtgatagctatttccaaagctttctgtaagaaacaagctgttgaatgggggaatgcacactgtgtgtgtggctgcgtatcactgcatttgcaattagtggcactgggttttcccctgtttagtagcagacagtttttcttcagcccaaggagcctgtgccttcccggcttcatcaaaccggtcgtcagaacagcagtaactttcagtgttgtgaacatggtctgatattcttccacgtgtggctgtgatatgcagaactgaaagtaggctaggacatgcccttaagagcagcagaagtaggaggggtgggcctggttctcctgggccacagtgtgcactttcaggccccatctgcctgggttcatggtggcaacgggtgtggcctctagaatcagactgaggtctaaactctagctcagccagttaactaactgtgaaactaatttggccaaataaatgtgtttctgaggattaaaacgtatatatccaccttgcaaatgtgttgtaaggattaaatcagatgctgtctattaggcaatttgcaaggttagcaagatgcttagcacataaaaaataaataattattgttttattattgttgctgtttccacctgtttctattcctttccctctctgatcatggattgcatcccatttctcttcctgtggggaggagagatggtaggggcatcaggcaagttggccaggctgactccacactgaggtctgagcctcagtgctaccagcagcaaaggaatgtttaggatgaggaaatggcttgtggttcaggactggaagacaaagtcaaaaagttaggaagaaaggggcagggggatgtgacagactctggccttctgctgtgggcacagctgggatgtgtggagctcttcctcattgggtggctggctctggagtgcagaggagggtcagcgtggggtaagattggttcagacaccagccccgaccctagactcacagtcttactttctgttctgctcagaccaccctgtttatctcctggtattgatgtaattgctgcctccagaacagatctgtcccagatctgttttcattccacatgaacccgcttccctccagacctgacctcagcccatggcctgttaggggatatgctcttcccatttggtaccagtaactgtgaggtacaagtacagctgttgtatccccacaatatgcttacaaaagcaaaatggaagatgaatatgagtgacctgtagtatctttgggttttttcctattttaattggtatgtctttagaaaagtgttggcatcatccaaatgaaccatgaacgatggatgccctgagacactttgtttgaaaagggtcctgtgggagctgagaaggggctctaagtattcttgaaagttcctgtctgtgccttagagacttgttaaaataagcttttcatttaagtctgaagtgtgggttgcttactctgaatttaagtccttcattcttcagaatgtgaaatgcccagggccctagtgcccccatccaagctacataagccttccatcatatgctccctgggactcagagcttggctttcaatggaggcaagttctcctgaggctttgtgggtttgtacctgcaactgtgtgctccagtctctgtactcaggcagcgcaagtcaattctgatatgaacttaccctgaatgtaagtaaaaataagaatgatcagtaatttttgtggagcacctgctatgtgccaggcacttcattgccacattacatgagttgtcatttagtccccctaacaagcacatgcagaagatcctctttttaccctatttcacagatgagaaaactaagagaggtcacaagacttgccaaaaaacagagtttggcagggcacggtggctcacacctgtaatcccagcactttgggaggccgaggcgggcagatcacttgagctcaggagtttaagaccaacatgggcaatgtggcgaaaccccatctctacaaaaatacaaaaattagccatgagtagtggtgcacacctgtagtcctagctactcaggaggctgaggtgggaggattgcttgagcccgggaggctgagcctgcagtgagctgagatcgtgccactgcactacaacctgggtgacaaagtgagaccctgtctcaaaaacaaaacaaaaacacagagctagtaaatggtaccattagcatatgacctcaggtatgattccagagcttatgcttctcaactatgctactttcctgcctgctggattcataaacattaaaaagatggatagtatcccgtgtgccctaaattgagaacatgggcacatacacatccttgctgggagtagaaattagtacagacatttggagggcaatttggtagggcagaccacagttttaaatttgcttcacattttgatcactcctatgactcaatgatacaggaatccttggatgtatgagcaaataaatacgtacatgagtcttcatcacagcatcatttatgaaaacaactaaatatttactaatggtgccagtggaatcaattagagaacatcccctgctacataactctctgcatacatcaaagagaatggtgtggctttgctttttcaacaatctactgagcggccgtaggcatggtgatatggccatgaatgagcaagattctctctgatccttatagaagttaagttctaccagataacttgctgcttcaacaaaaatatttagctttttaaataaatgtggtagaatgctcctgctttcttgtttcatttaactcaaatgatcaccaaaaaagagaacaataagctgttgaccctgcagatgttgtgtaaccactagatgaaaagatttacagcaggaagctgtcatgcccacacatatggtcccaccatccttggagcctccataggtctaaatggagtttcatcaccataaataaatggtaatgtaggttccaaactatacttgtggagttatacatttgatcttggccaaaaggccaagaagcaatattgtgtgtgtgtgtgtgtgtgtgtgtgtgtgtgtgtgtgtgtgtgtgtagttatatattacaaaagcaaaatcactatatcagctgggacctgtaaaccagaatttaactgtaaagcaaggtgaatctgcatggccagctaacttggcagccaccttcactccacccacattgattttattttctagtgaaatatttcttcaagagcaaacagactgtcatcagacagtatctcattaccaggatctgatatcttggatttcctttttctaagtcttgacctggcttgccataatttgaagatatccaacactttaaaaatcaaaaaagagagctaagatatatagtatatagtgtacatagtatgtagtacgtactgatggaaagtttcccgtgatatgatattaaggaaatattttaaagtcatggtacagaacaagatattcagtatgacacagatttggtgggaaagctaaatataatgcctgcacacacacacacacatccttacatgtgcatcgtagaagatctggaaagatacacaccatgctgtaatattctggaaacggagaaggagacagaaggcagggttgctgttgaagtagactgtgttcaacatttacattgtgagtttctgtgatgctaaaattttccacaatgtgtgtattattctggaattaaaaatcaaagaaaaaaaagtggagcagaactagatgatgaggaccccataagcaaaactcaggaagtaagaaattgtcatggaagttgtgaggagcctttgaagggttttggcaggagacagataccgtcagatttgcagcaagtggaggatgaattgggggaagcaagaagatactggagatggggtggccagaggggagactgtggaaggaggtgaacacaggaatcctcagcctgactggtgtcgggggtgaagggagctgctggtgtttggcacccggctcaggcacgcctgagctgtgccttcaacccaggctgggctgctggaggaggagcaggactctgaggtcagaggaagggctcagccatgaggcatatgagatgactggaggaaaaccaggtctggggagacatggagctggcactcaggagacagataggttgtgttccatatatgacttcaagataaacaacttctcggtcattcaacagatatttcttaggagggaagaagggatacactgtaaacaaataaatatatttctcagagcatgagaaatgtaactgctctgttgggaaatgctttgcctgcagacatgtgaatgttggggtgtctgtgcatcccaagatttttttcatctgatggaaagagggtaccccggggagcctgagcctaggaggaggctgcaagcttcctgggtggctcaccgccgctgccctgtccttgtgggcccttcccctcacccaggactgtctgtaggagcccagaccacgctgggtctggctaagccaacttcctctgcaccaccaccacccagcagccccttcctgcatggtaaatgggaagccatggaccagaaagctttttataacctctgggcctgagcctcagagacaccactgtcctccttcctttcagtttccatggggctgtgggattttctaggcaaggtacccaaccagggagaaggtcacaatgcattctaactgcattctaggcgcctgctgccaggcacgactctaaggactgtagccttgtcgctatgagccagccaagcaagtctcttcccctggaactcagggatctgttcagttggcaacaaagcccttccttccccagctggtgacattctggagttttccacacacaatggactattgtgtctgagcactgctgggcccaggccagggaaaggggccatacaggaccagctgactccactctagggaaagccccccaccagagctgaacttggacctgtggaggcctccagccttgcaaagatcatggcacccctcacccgcagtgtgtaattgaaaataaaaacccaaccaaacctcaaagttgagcaaaatcaacaaagttctgatttttgccctatgaagaccattcagtgctttccttcaaaatgttaattatcaaattattcctcaaaaaattactttagtttccccagttatccctaaaataactttatggtgctttattcaccatccaaagcaaaacagagccagagaacctgaggggcaccacgggtatggggccttggctttgtgctggcctcctcgtccaagggagtctgatccagcgcatgggtctcaccagcaggacaggcgttgaggggacagtcctcagggccaggtgttagccacattgcaactcctgctgacccagctggcctggagcaggccccactcagttgctggacacagagcatggctctgccctctgaaatggacatgacatgggagtctggccaaccaaggcagaatccaggccagatctctgctctagtggggaagggatgggctgagctggaaaccaaaggtgtgactcagtggcccttcagtgtccaggacatacctggacactcagtcccctctcccggtatcactgaggccccagggttcccccatcccagagagaggtggctgtacacccaggcaggaaaagccccaacagcaggtgagggagtgggggtgaatggtgtcaccaggtcaaagccctattgttcccatgagcccagctctgttcactaaatatttgtggtccttttttgcagagtgatgaggtcctcaccgtcatcaaagccaaagcccaatggccagcctggcagcctctcaacgtgtaagtaacacaagtcccttgcctggcctgtcttatcctagccccttctcaaagccacctacctaatggccaccacataccagttatgctgttgaagttagcactacttctcagttaacaagcaggcaagatgctttctatgtgcagagcatcacacctgccccatcttctcaaggatgcaggctcaggctctgttttcccccaatggctttaataccacagccagatgtgatggctttaataccaactcagatgggatgattaactgttctgtgttcactcatgctctcagccacaacagaccaaacatgccctcaccctcagagcacacaggtgtactcatgcttagccagtctgatgtgtggaaagccagatttaccctgggttccattctcagtcccgtttcttttctgtctcctctatcccagagagattttatctgcccttgagtcaggtgaccaagggtatgctgacagtccccaaaactacctcctgccaaatggatggatacagtggtatatccgtcaggtttttggacagctctccatggatggtccacctggaccttaaactcatcatgtccaaaatgggtcccatcaccttcaaacaaacctgctgttctccatgtggagaaatattgaaagtacagtgagtgtcaaaaccctgtggattctgccttctgggcagctcacaaatcagtccttacttgattctcctccccttccttcaagccatcaccctttctcacctggaccacgtcacctttttcctttgctgtagtctccctcagtccaattcctcatccacagttactagagtgatcttttaagaatccaaataccggccaggcgcagtggcttacgctgtaatctcagcattttaggaagccaaggcgggcagatcacgaggtcaggagatcgagaccatgctggccaacatggtgaaactcagtctctactaaaaatacaaaaattagctgggtgtggtggcacgtgtctgtaatcccagctatttgggaggctgaggcaggagaatcacttgaaccaggtaatcagaggttgcagtgagctgagatcgcaccactgcactccagcctggtgacagagcaagaatccatctcaaaaaaaaaaaaaaagaatccaaatcctccagctagcctgggcaacatggcaaaaccctgcttctactaaaaatacaaaaatctaactgggtgtggtggcgcatgcctgtagtcccacctactcaggaggctgaagtaggagcatcgcccgggtccagggagtcaagcagcagtgagccgtgatcgcaccactgcactccagcctaggtgatgggaataagactctgtctcaacaacaacaaaaaagaatccaaatctgttgtgtcctctccttcttcatccctctgtgacttcgcttagtctcaagatcaagtccacactccttagtttagcgtgcgcaggtgggcggaacacacgtcggggttcatctcttgtcctccccatgctgcacctcatacaggccaccccgaatcctgggcagttccttgaacaagctttgattttgctcatcctttaaagacgcaaggcctggagactgaccccaagaagatggtttacgaagaagccttggccagcccctctagggagtagtctacatccattaacacccgtattgaagacagcaacaatgtgaggaatgtgtgagatgctgctcagtgggagaaaaggcgaaatccacaggataggaagggaggaaagtgctggacattcaaaaggaagacgccccaggatagggcagtgggagtgagggaggaggcacactcatagctgactgcctgggagcagggaagctacggcgaggcacctgatacctgctcatttaaccattcagcaaactaatggctcatcccctactgtgcgccagccctgcacatgcagtcctagctctctggaacactcagccagagaggagacagacaacagaccaagttgggccactccaggttttccctttgcacaagtccaggcagcaccatataacctgaatatataaaatataatgtcatcatggcagccttgtatactccaaggggataaatgttagggtgaggaatggctctggagccccagagcaggggcagaaccctctcctgctgtgtggaggagggacatggggctgtgcctggaaggtgttccttgtgctggtcaggactggcccaggcttgggtggagctgaggctctgagtggaggcctgaggagggaaagagagactagcactcagacagctggcccagcgcagcccagctggctgcatggaggccttttctagcctgctgtgagctctaagccttgctctggatcctccctaaggaagctcacaccagggcaggagaaaacccacccagcccaggaaatgccttgccctccaaggagaagcaacacgaggcagggcctacccagggcactctcctggcaggtgcacctttgcccatctcatccctgtcctaccaaaaaacaaggatgtgaattcacaaaagcccttggtgccctttgcataattaacatcagttaccagtcaggtcaccctgaatctccttactctgctgtctcttcagattctcccagttccttggctcccagaacctatgtgtgaagaacccctcacttctggtcctctaagtgggcaggggatgaaaggcaggtaggggtggggagagtttgtgggtaccaatttttacaccattaaggagtctttataccagttttctcttgaggagcctgggcttaaacagatgtaaactgcaaatcaaagcacattcaggaaagagataggaagggagggagagaggaaagagagagcagtcctttttaccttcagcatccccttgggtccaagtaggcgctgacatttattatcccttttaatcctaataaccatgaggtaggtattgcaatgtccattttaccaatgaccaaactgagactcagaggtcctatgacagcaagggtggatatagaatgccaacagtacccagctgattctaatgcctgtgcttttcactataacacgatccttccaattaagtaacaattcattcattttcccatgtctaaattaatcaagacatatatacctgccaatgagccttctgattggcatgaaattaacaatgtgaccacaccaaatggtctcacacctaccccaaaacaaacaaaatcttactttcacttaccctgtatcctatcaaggaggactgaaacatccttgataggagggtccccccaaaaaaagtcctgtgaaaggtgcttagggcaactgtggtgagcacagcacagttccttatggagattacaattcagtggggagagatatttactaaatgatcacacaaataaatgtgacatgtctatgaaggaaaggcataaagtgccattaggggggttagagatagcttccccctaaaaaggcaatgaagctaagatctaaggaagcagtaggagttaactaagcaaagaagaaaacaaaggggagaacattttagaaaatctggagagaccatcatgtatctgcaaaggccctgtatgaggagggagtagagtatgtctaaggcactaaaaggctttggtctaactagatccagaaatcaaagatgagtttggtgtggggccaagccatgtaacatttgaaattttttatttgaatttttgcattaaaagtcatgagtaagaccaggtgtactggctcacacctgtaatcttaacattttgggaggtggaagcaggaggctcactcgagcccaggagtttgagaacagcctgggcaacaaagcaagacccccatctctacaaaaaattttaaaaactagccaggcgtggtggcttgtgcctgtggtctcagctacctgggaggctgaggcaggaggatcactttagccgaggaggctgaggctgcagtgaaccatgcactccagtctgggtgacagagcgagaccctgtctcaaataataatggtaaatcattgaagggttttaagcaaaagggtgacatgatcatatttgcattaaaaaataaaaagcaataacagcactcggcccctgtgtgaaagggtagatgcgggagcccagtgaggggggctacttcagaaaaccggagagaattaactgtgacttcactaggatggtggtggtggtggaaaaggagagaggtacagagatgtgtgaggcacgtaggaggtaaaatcaacaggctgtggcgataggtggagtaagggggtggagaaagagcagtcaagatgtttcccatgtgtctggctggcataatgaaagagtggtgaagccactcacaaggctgaaaacgttagatgaagttcagtgggaaagatcatgggatcagttctaagtgtaagttgttaagatgtattcaagatttccagttagaggtgttaagtacatggttggctagatagctctggaactcagggcaagaattctgcactgagatctaaaattgggagccctcaaggaatgggagacaatgccaagggcataagaataggaatcaagggcttaggactgagttccaaagatctctactattgaatgttgaggaatcttgcctgcaaaggacacagcaaaggagcagcaaagaaattggtaaggaagcttggtaccgagaaagccaggggaagaaagtgtttgaggcgggtggttggctgtgcccagtgcagccgagaaaacaagaaagatcaaggctacaggaagccctttgggtttatcgacaggaaggtcatcagtgaccttacggagaatcctttctgctgagtgatgagggggaaaaacagcccggagcaggtgagctgtgaacagagcatgaggttatggagtcagcaagtacagaccactcttctgtgaagtttgctatgaaagaagagaacctggctccaaggggatgaaagagtcaaaggagcattttttttttcttttttaagatgggagagactttctgaaaaactgaaatgaatattttgggacaccttcccacatttcacctacccctcagacttcctgaggcctccgtggaacaaaattaattgatggcaaacactcagacctcccaaacacccaaaacctctgcactcggcgctactggcttgttaagggaaaagaattttcctttgattttcccataccccagtctcccctttcctcttccaaatctcattaggaagtcaaattaggaagcctacatgcagccaagttttgttttgcagaaacagccttgcctctctttgctgagcctgcctgattgaggttaatgggattccagcctccctcgccgcccagtggaaagccagggtgacctactttgcaaggtcctgcccgttgaaactgacttgtttttcaatgatctgcatctttatccccaggaccacttctcaaaggacagccatgaatgagcaaattagctgctgacttgtttagctcaataaatcaagctgtggctccgacagcccagggtgcaggtagagacaggaaaggcagactctgaacaaaacccacatcctttcctagttcctccggtgcctaagtagaaaatgcccagatttcctacaaatcaattctgaatgtccatcatccagttcctccaattgcatctgaatgctaagaattactgggacttttacaaataacttttatttccttccttaaaatgaatcctgcaaaccactgtcaccaccttaaattattcccagccactctgccggattaacattgattagataaaggtcgtgtttgtgaggccagtggagtagagacatggtcaccttctccagaaatccaaagccatgctccccaggaggccagagatttcccttaaattgggccggaagagtcagggctctccctgcctcctgcaacacctgcacaggtccaccgatgtcctcgggatgctaaaggaagatgggctttggacagagaagcaggtggtaggtctaagcatccagatggacctggagtcctagatgcctcctggttataaacacagcgttttccaacgttgcaggaacctccctcaaacctttctccacacacacccctgcagaacttcagcctagtgaatggcttgggcgccctctcgtggccaaattgagtttttgcaactctgaaaattcagattattgaaaactcaggatgagagacaacacagcatatgagtgttttaggaaaccctcctgagtctcactggtgtggatctgtaatttaggaggggatggtaagtctctagaagcagtatcaaaatcctttcttacctcttttcttttatggtgttttggaacattttgtttggaaaagttgaatgagaagaaaatcaacctctaccaagccctgttatgtgtccctcacaatgataagcagttttctcacaataaaaccttggggtaggatgatgatgctcccatttggcagatgtagtaattgcaaagaaaggtgaggtggaagccctcatcacatagctattaaataaacagctgattcgaatccagctctgactgtcaccaatgccctgggttctttcctccacaccatgctgcctctccaaatgtagaaaaaggaaacatttctctgggtcttcatatctgatgtgaattgtctgttcataacttttctttatctagtgggatcattgtctttttctacatatttggattaactctgtagataatatagatattaacactttgtcagtcacactcaatggagacattttttgccagcatgtcatttttctctccaattcagtactgctgttttcattttacagaaggtcttcgttgatagataattcaattcttttctttataattgcttttattgtttcaaagttgaaaaaattaatatttctctagtagatctgaaagctttatttttttctatgatctggttattttctatttgactctgggtctgttttttttttttcttgtgtggtatattaaatgtgaatccagttttttttttattacagttaacttagcccaaccccacttgtcgcacaatctttcctttccccctaatttgaaaagcctattttgtatagtccttatctatagtttctgggatctccagtctgtattgctgatttatatttctatcttacctgaatatcacgctattttgtctatcatgctttatcatatactctggtatatggtatggctagatcaactctctgctagaaaacggatacaaatctaagtcccaggtagaaagatgaaaccaaattaacaaaatatatcttggaagacatggcatatacaaaagcataaaaatttttatgacagtttgaacaaattaaagcactccagtcctatctagcattttctaaggaaaactcatatagattcttattcatttaattatttttattatagaataaatactttgaagtgatgcttaattaaatttgaaggtcaaaggaaatacaagagctccatgttcatttcttagattaagtcatttacttcaacaaacatttgaagagaatccatggcatgccaagttctaagccagacattgggatatagctatgagcacggcagaaatggtcctcactctattggaacctgatgggaaaggcagatattaacaaaaaattccaaagcaagagtgagttcagcatgctatggggaggtagaataggagttctaagcaatttggggagaggtcaggaaatacctcctccaggaaatgttacataaatggggtcaaggagggattctccagtcaaggataagagaaagctgcagggcatatctgaaaatgctatcaaattgttctcaggcccttatagattcagatttactctatcacccaagataagtcagccatgtgacctcatagtcaggaattggccgccccacgtttcccacaccttgaaacacttaccagggtctagagggtatctcgcttcagctacagatttggatacaacagattgggccaaaatgcatttactgagaatgatttccacaaggccttggtctcagatggttacacccattggctgggcaggttccagggtaatgtgttagggtggcagttggtttggtttctacagctctggattagaactggttttgtccccttagattgtcattatgaatagtcacccatggggtacaggatatgaatgactaatctggccccaaatcacctacttaggaagacaggaaggcaatagatggagcggtcagtctctatgacaatggaagaggaaacctgcctcccaggggactgctggaccaccccagaggacagctgcacccaggtgccagtgctgtctgctcagcagttactagaaggcagaccagaaccccgtcctgtgagtccctaggcgaggtaatgccacacctccatagactgcaatccttgtgtgaaccaggtctttaaagaagctgctaaaatcactgacctacatgccagaaaatgcacacgtgggaaaaggaaattaaatcccctgatttgtgcctaagtagctgatgatgtcattgcaatactttagcagtttataaagacttcctaataaagcatctcatttgatcctgacagcaacactgcaggtatgtattgctagatgaagatattgagacttgaagagggtgagcaacttgcccaagatctaaagctagaagtggaggagttcaagtcatcatacgcatatttgttcagtcggcccactggacacctaggtcctggggtacagctatgaaacacagagttccttcaaggaactcccggtctaagctggggagagggaacagtgaggaagtgattacattcatggggtctggctatggagacctgcgcagagtgggaatccagcgctatgtatctgcctcagccgaaggcaagacctgcgcagagtgtgggaatccagcgctatgtatctgcctcagccgaaggcaagacctgcgcagagtgtgggaatccagcgctatgtatctgcctcagccgaaggcaagacctgcgcagagtgtgggaatccagcgctatgtacttgcctcagccgaaggcaagacctgcgcagagtgtgggaatccagcgctatgtacttgcctcagccgaaggcaagacctgcgcagagtgtgggaatccagcgctatgtacttgcctcagccgaaggcaagacctgcgcagagtgtgggaatccaacgctatgtacttgcctcagccgaaggcaagacctgcgcagagtgtgggaatccagcgctatgtacttgcctcagctgaaggcaagacctgcgcagagtgtgggaatccagcgctatgtatctgcctcagctgaaggcaggcagaaaggctgctggaagaggtgacatgacctgaggcttgaaagatgagtgggcccagcattctcaagcttgaggtgtattacaatctggagggattattaaaacaaattgctgggtcctaccccaagtctctaattcagcaaatatagggtggggctcaagaatctgtatttctaacaagttcctagaggttgctgatgctgctggtccaaggaccacacttttccaatcactgaagagcttgcccaatagatgcaagtacaagtggaacctgcagctaacctgcaggtagactggcctgtcagggcccagggagcttcttaggtagcaggtagtgtgggataagggagggggtgcatgggaggcagcaccaggaccttgtcaatcgacggatgccaaagccaaggctcaggccaggttcttctccactcctgtggcagaacctagactggcatcaggctaaaatggaaagtccattcaggaaggcttttcctcccacctgtcccctttctgatctccatacgatcctacagtacttctctcagtaacactaatggtaataagagctctagggccaggcaatgggctaagtactgtctgcaagctagctcatttgaaattcacaggaaccctttggagtagacgtatgtgatcaccattttaaagatttggacactgagacgcagaaaggtttgataatctgcccaaggacacacagctgtaacaggtgataccagagcccaaggggcccagttccccaggccccagtcgggtctgcagtcattgctttctggtgccaggtgagggcagccagaagcagctggtcccaacagagggcacagggacttccagacagctgaggcagaccagctgccagctggactgaacagaacagttggtctctggccaaggattccccatgattagcagccttggggtgcagagtcaggccaagctgccttcaagcctcagccccctcctagctgtgtctattagttcattaaccacttattcactttcatggcctctctatgagacaggataataattctaaccccacaggattgtcatgaggggaaaatgaaataatatgggactgccacccgctgtgtgctttgcgaatgtgactctttcctttccagccactctgagtggttgctgccatgtatctcacatggtcccagccactcctgagaatctgtgtgacacaaagagagaggttgaagagcggcctctgatagcttagactcaggatgttattcccagcaactgggggtgtcggccaaaggtctctgactctacagctggtccctgcttcccagctgtgagctgatgggtacagtctggcgctggacagtgcctgctattggcagccttctgagggcaatagaaacaggaagctgggggagatgacccctctgatgggaggttgaggtgcaaggatcacttgagcccagaagtttgaggcaacagtgagccatgatcacaccactgcactccagcctgggtgacagagcaagactctgtctctgaaagaaaaacaaaaagagaaactggatagggtggtagtatatggttctctccacatttgttcaatggatgggctcaggacagagaagggtataaacccacagtggccaaaggcagaattcagtgggagaccacgaatgtggatactctctgtccctctcattcttcataatccaggcagatttccctcagagtgaggaccaacccccagaactctaatataatggtctctgtatttcgtttccaggagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgaggtgtgtgtgtgtgcctggagtggtgagtggctccttgcctacccgcttcctgagtgtcctggacacagaggggatctgtcccaggctctgtcctaggtgaactttcagtctggctggggaggctggcatggtcgcatcatcacatatggtgtaatttgggctctgggaactgtctgtgcagtggccaggagagcacggagagggaactgctaaagagcagttcccaggtgagcaggggacagcattccaaagccatgactgcaagagcgaaggtttctggacagctgggctaaggagtttgcattctgtcctgaatgtcatatttctctgatatgatctattgcattgaaatctggagccatcagaaaaccaatgggagaacaatctagaacagacatctgcaaactatggtttggaagacaaatctgccctacaatgtgatttgtcaataaagttttcaaagccagttacactcctccaagtacatattatctgcggctgttttctcactaccacagctgagttgaatattagcaacagacacaatatggttcacaaagcctaaaatatttagcatctggccctttactaaaaaagttttccaatgccgggtctattagaaagagtttgggattcaggccaacctggctcagccgtttcctagctgggatggcctctctgaaacttggcttcttcatcttagcacaatcctaccatggacatggaagaattttaaaatatagttctagaaatttctcagcacagtatgtggcatgaacacaattccataaatataaatagtagttatgcttgttaaattcctatcaaggactttgctctgatccatataacaaatggcttttgtgggttttcccaattttatttcttactctctacctctgtatgttttcttgcagtcacccaacaaacccaccattccccaggagaaaatccggcccctgaccagcctggaccatcctcagagtcctttctatgacccagagggtgggtccatcactcaagtagccagagttgtcatcgagagaatcgcacggaaggtactgggttagaacccactctggcatcgacctttcccggtaggagtgccagggagattgtacacccttctgctctagaatcatagagtcactggcagaaagcacctcaggatatggaattcctgggcctccccaggtttctaacatgcaaattatttcataagatgaaaataagcaggccaggcactgtagcccatgcctgtaatcccagccctttgggagtccaaggtgggcagatcacccgaggtcaggaattcaagaccagcctggccaacatggtgaaaccccatctctactaaaaatacaaaaattggctgggcatggtggcagggacctgtaattccagctactcgggaggctaaggcaggagaattgcttgaaccctggaggtggaggttacagtgagccaagattgcgccattgcgctccagtctgggtgacaagagcaaaactccatctcaaaaagaaaaaagaaaaaaaaagaaaatgagcaaaattaactcagcagtgaggcccagtgctcaaatgaacaatttgatccaggcaaattgctttcattgtgagttctgcaattgattactaatatctgccatgggccaggaactggggagtggtggtacccaagttatgtatttatcatccctggttagccattcctgctttcttggcatttctttctcaggcagattgtaaatgttggtccagaactttgccatggcatacgatttgtatacagaatggcgattagattttagtcctctttcaccttccccctacacattcccttctttctctcatgtgagccctccaagtaaaattcctttttcagggtgaacaatgcaatattgtacctgacaatgtcgatgatattgtagctgacctggctccagaagagaaagatgaaggtacgttgttttcttttgttgcaggtggcaacataaattgacataaccctttgagaaagcaatttgctaacctgttttaagaaccataaaccatgtgctttgacttggtaatcatatctctgaggatttctcctcaagaaataatcaaaaacaaggccaaggttaggcccaaagcataagggaattggtgaagatatgacatcagaatatatactcaacaacatcaggcctttaaaacaatcatgtaaatctcattttaatgggcttcgcaggattcagaccactctctgcttcgattctcaggccagcctatgaggcaggtgtggatacattcactttcctagcaagcaaagaaaggcccagatcctacaatcaggagggagcgacagagtcatggttcaagctcaagttttcttatgggatctggagccagacaacctggactctcagtagacatgtgatcttgggcaagaagctaacctttctgtctcagtttcctcaacagtcaaatggggataataaaagaacttgcttcatacagttgtcagaattaaatgggataaaacatgtaaggctcttagaatggtgctggtacatgatgagtactcaatgaatagcagctgctcttattcttaccatgacaactgtgtatgggatcattgggaagatgaagccatggcatgtaaataagccttgagcttttcaaaattacctacaatgagcctgcatgtgtctggaaacaatgccaagatgagggactgaaaatgagaagacgttcatgtgttgagaggaagggataataagaatcattctgcttatttagattagatatttattagcaagatgttaaactattatctttaaagggaagtggatggctgcttccatcccaggagcacccaggctcactgaagtcagtctggcagcatggcttttcttgtccccagataagctggtatggggagagggccagtggcagctcccataggttcccagggaaaacatgtcaaacactctttccagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaaggtgaggagacaacccagaccagccaggggctggcaggagttcaggaagggagggtctgcctagcagtcagacagtgtccctggtgagggcacaaggaccctgacagtagatgtcagtggggtccaccttgggcaaactcctatctgcaacagtgtcttgagggctctgaacacagaatctctcttatatcaaaggaattcttgagattgaccaccccctccttcttttactgaagagctaacaaacatagatacaacttatgacaagttacagataacacatagcctgcttctgggccttaactccaatctcttcttaaggagcctgttaacagtcagcccagattgaatctagatccattgccctaattctgtcatttacagcccctcatctgtgttccacctcagcgtgagtcagagcactctcacttctttgtgtcaggacctttgggctgattgcagaaattctcagtctatttgcaacagtgcaaaggtcagcctttaagtataatcttgcaacacctatatcatgatggctcaagcttcaagattgcactaagctgattgctgtgcaaaggtcagctatctgcttcccaagccatgacccctttctctgcctgatagatctacgctattctgccctgatcttataggatgccataaggcaatgggaaggcactgtataggctggactggtgtatggcagggaaaaaaaccacttccaagccgaggataaagaaagcaagcttatcccatgcaggtcattaattccttggctctgcctagagggaggctcttaaacacctctcccagtgttgcactttcacgatggtttattgctagctcattttgcccacaataagcactttggaggggagtaaaccctccccgtagactaagtcattcctacaaacaggcgggaggaaagctgggactggcctgtcaacattgaagcctctttcttggggctgggactggggagctaagctgaggagctgaggtccttaacctccccttccacagggaaggattgttcctcatacaaatggattatgatttatcttaaattatatgtagattaaattatatcttatcttagatatatgcgtgtacattttttaaacaccatcctttccatacaagcatctttcgaatgtattttcatgagataaagagtaattctgagtgtcccatgcacctggaaaagaggcatttcctcttagagaactttgccagtttaaggatttagacctcttaggtgtgcagacaacctcaactgcctgactcctcttgattcccgctggcgggaagttcccaccgcgcagcctggcaggcgcccctgccaccgtgcactgctgcagcgttcactcggtgtgttgcagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctgtgagtgggggccccgggcgggcaggcgggcaagtaggtcggggaggcagcaggtgcgactccaatgccgctggcctccccagctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccgtgagtgagagcgggggtggacttggaggaggccactggggacaggcgtggagggccatggcatccactattaccaccataaaggtcggaggctgagcagaggaaagcatggcccatggtccttgctgggcactgctgggagccagatgagagacataggtgtgtagacatcaaccagacccagagagagtaacctccactgggggacattctaagcaatgctggggtggcaaactggtggcctctggatagagaattcacctgcagctgtgttttataggagtgtctttcttgcagtggtggggaggagggccaatacatttaggcgggacatacattacccaggtccagcccactcctcccactcctgttgtacattggacttggctgatcccataaagcatgacctcccctgctctgtgcacaaatgcatatgggcctgcccacacattagtatgcagatgtatacaggcacacaagtatatacacattctagggaattcaggacaatgtccaaaaatgcatccctgagcctctcctttagtgcctgattcttagtgagtgtgggatgtttctgtctctaggaagaccctgctaagatcctcagtggcctttctagtggggacttatgtagtcatattgctaccctcatgtcataaccatcggggggggtcagcagggagatgaaagagagtgaaaagaagagcagtaggctgctgagccacttcttgctccatagatttcactcttatttgaacccatgggccaattccactttattccaggggccaaagcaggggactcggtgtggaacactgtggggtcagggagatcaacgaaaacaaaaggaacctgttctcagtggcaaacctggttcttgatctagacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccgtaagtcctggagctcctcaaggcccatcacttctatgttcctgagtccagggagccccgaaccagccagtgctaatactgctagatcctagaataacatggtttgctggggaagagtttggggtttggctttcagtgtttgcagttacttaaacactgcagtcagtttcattaataaagtgagaatcccactaccgtctacagaacacccaaagttaaggttcctgtgaagtctaaatgacagacacatacgaaaaacagcacaaagctcaataaaccttagttctttccctcctctcccccaacaattataggcttgcctgacccatggattttccaagcattttaattctattttccctgtgaccattttaattccccatgaccagaggctggacattaaatcaatgactcctgcagactggtaagaaaaccagcaagaaaacaagccaagttctcaaaaactcaccccaccccgctccactcccagtcctgttttccaaagtctctgcgatcagctgtttatattacatgggactaatctccaagcagagcaagccagtttccttggctggtcttccaagagctgcttttttgggtggtaaaagggcaggcacactggctgtggctctggccccctccagcatgtacttgcagtcgttcatcctccctcccctagctagtaaccttcagccgatgactcagcacctctgttcctcagtttctccatctgtaaaatagcaggaaatacttcctaggttgctctgaggatgaaaccaagtaattggtccaaagtatgagcactggacatggcaaggataggccttacttaatccctgctccatgctccagctcctgggttgttttaggagactcagccatgggtggaggtaacttggaccacccactagagaaagcctggggttttcagtaactaagattggcccatggttcaggccagctcaccagagttggggccccatagccttctgacttagagtgcctggggtccactgaagtaagggagaagaaaatgaaaatttatggagcacttacagggctgggagcatctcatttaatccttacaacctaatgaaaaaaaaaataccatgatccccattttgcagataagaaagctgcctgagcttccacaggcgggataaaagaactgaaactgttgaactaaatgaggacatctaagtccaccaccctgactttggccttgcaagaccaacagagagcttggaataatttacctccctgggacacatcctgacagtcaaactgatgtgttattttcctttcacatttatgagatgctggcttagtaagaatttactggatctcgataaaccataaagcaccacttgctcctgaccctcttctctactgaatgtcccatttctggctcctgtgttttttgcatagaccaccatatatagaacacaggatgatgttgagaatgaaaagctgccagggtgtgttagaaccacaatgtccttggtattggtccacaagggtcagccgcctttagcttgttgacttgttctctccaaagagcagcagggggcttgctggccttgctctgaaaaatatcaccagtgagtttgggactgtgggaagctattctgtacttgaggctgatctgacaatattctagttcacagagcagggcaagaggctctgaacacatcctgaaagtcctccaaagccttcttgagtcatagagggagcatagaatgggtgatgacctggcaccaatcctgcctctgctgcttaccaaccacacgggctgaagtcagcctgcctctttggagcctcagtttcttcttctgtaaaatagcatgacacagcacctgctttgcatccctcataggcttgttgagatgttcaaaggagagcgtgaccatatcttgtttcagacatgtgatacactcatgcccatctgtgtcttgccagccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggtatggctcccaagtgtcagcctgggtggtctccaggacaggcagggttctgcactgggctaagtcttggacctgtttaaaaaaaaaaaaaaaaaaaaagtcggggagagtctgcatcttctggagtcttcaggccacattttgattctttagatccaagtttgttcccaaatattgagcaagcataatttataaaggagattggcggtgggggtcatttatcaaagaacatttagataacctaattacctgccaaaaataaattttcaagcaaagaatctttaggaattacagttccttctttacacacatataaaaccaataatgtgtccaactttgctcaaagtcagttatgacttagcaacaccattcactccttgcaaagagggaaaatgatacagatgtgtcaaaggagtcttgtcttgttcatcatttagggaatgttcctgagaacctcccagaacacatcatcttccattttaagggtgtggctcagacaaggcagccgtggcctgagactttatgatttttttttgcaaggctaaccagaagtttatcagcagtgtcatgtcagccttgagttttatttccccaaataatattgatccaagctgacaaataactaatagaacaatgcaccaagtgctcagggagctgaggaatgagcatcatcttacattgactggagttcagggagatgtcagagcagggaaaactagagtgggtcttgaaaaatctagaggagtttgccacttagaaaagtacattccaggccgggcacggtggctcatgcctgtaatcccagcaccttggtaggccaaggcaggccaatcacttgaggtcaggagtttgagaccagcctggccaatatggtgaaaccccatctctactaaaagtacaaaaattagccgggcatggtggcgcacacctgtaatcccagctactcaggaggctgaagcaggagaatcacttgaactggggaggcagaggttgcagtgagccaagagcacaccattgcactccagtctgggcaacaagagtgaaactccgtctcaaattaaaaaaaaaaaaaaagaaaagtacattccaggcagcaagaatagtcattacaaaggcacagagatgccaaagaccatgataggtccaagtgataggtccaagtgataaatgggatgcagatgaagcacagaggacaaggcaggcaggaaaccaggctgggaaggcagggaccagaccacacaaggccagtggcccaccaaggattttgggacctgattctgtaggtggttttaagcaagagggtgactgtatcagacctgtgttgactgatttggggatggcaaacagacacagaggccagataggttttatttgtaacccaagagaaagattatacatccccaaactccagcttaacttcagagttccaggacttcagaagaaaaagaaaatgcctgccagggacttcagtgctgaaggtgcccatgtaaaaaagtgaagattaacatgtacatcaagttttctgatttttaaaggcctattctttttgaagcatgaggatctccttgatggttcaggatccttatgattagggagctgtttgcatatcaaagtgctgtctgttctacatggtagtcagccagtcaacaaacattcattaaagcctactatgtggcaggtacatagttgtacggtacattcctccatgactcttagctgtagtgtggttaacaaatatctcatgtgtaaccataaatgtggtgggttctataaaagaggaatctagagtgctatggaagcagtaatcaaaagatctaacctaattaatctctggggtcagggaagttttcttggagagcagcatgtttatgctgagtaggaagaacaaaaattgtacttctctatacttagcatttgggagccaagtacttggggagtaaggcataagagaaagtggtttagtgttccttatatggctgctgcataagccatcccaaaacagtctttttaaacaatcacttagcaagattctgtggatcagtgatgtgaactgggtccactggatggttcttcttgggtctagtttggactcattcatgtggctactactagctggtggcacaattggaccagaccagcctcacctgcgtatctggggcctcatgagatggctggggcttctctgcacatggtctctccagtggtctagccaggcttgcttacatggtagtagaagggtcctagcagcttttaggcctgtttttgctcatgtcccattggccatggcaaatcatgtagtcaagcccagattcaagaggtggagaaacagagtctgccttttgatgagaagaaccgtgaagcatttgtggccatttttttgcagtcagtcacatacgacctaactgtccctaataacgactctaaccaatcattacatacttgagcagaggaggagcccagacaagcacatttcacagttctactagagttcagcatccctgttccgtcccgtttctgcgggcctaacaaggcattctcatgctttcaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaagtcctcatgtagaagcacccacttttgcaatgttgttctaagctatctatctaactctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaatgaaatttgtttggacttccacttgagacagtaaagagagtattagacacccagtaaaaactgccatataaagaagttgtaattgtttgttgtgtatgtatttttttcaatgccaaaccagctgtgatccaatttacatccacattttaggtccaacagcaagaagttcagagagagatttcccaaccagacattgggtcactcactggtcaccttgccagtgcattttattagaagggaatctgttgtagcaaatgggaataaacctgggtttctatagacccagaactgaaaaaataaacatcgtgctgtttttaatttgaa
